United States Patent 9,315,822 (GENES AND USES FOR PLANT IMPROVEMENT) - sequence listing, part 4

SEQ ID NO: 13365 - protein, 187 aa, Arabidopsis thaliana
  misc_feature (15)..(15): Xaa can be any naturally occurring amino acid
  unsure (1)..(187): unsure at all Xaa locations
MASSMLSSAAVVTSXPAQATMVAPFTGLKSSAAFPVTRKTNKDITSIASNGGRVSCMKVWPPIGKKKFETLSYLPDLSDVELAKEVDYLLRNKRIPCVEFELEHGFVYREHGNTPGYYDGRYWTMWKLPLFGCTDSAQVLKEVEECKKEYPGAFIRIIGFDNTRQVQCISFLGLQTPSFSRKPIFSF

SEQ ID NO: 13366 - protein, 259 aa, Corynebacterium glutamicum ATCC 13032
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 13367 - protein, 334 aa, Corynebacterium glutamicum ATCC 13032
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 13368 - protein, 339 aa, Glycine max
MDHSADAQRTDLMTITRFVLNQQSNHPESRGDFSILLSHIVLGCKFLCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 13369 - protein, 319 aa, Pseudomonas syringae pv. tomato str. DC3000
MLTLLKLLADGAFHSGQVLGESLGVSRSAVWKQLQQLESDLDIEVHKVRGRGYRLATPIVLLDPAAIVESGMPGEWSVRTYDSIDSTNAEASRLIALGAPMPLLVVAEQQTAGRGRRGRKWVSPFAENLYYSLVLRIDGGMRQLEGLSLLVGLAVMNVLRDMGVQGAGLKWPNDVLVGRQKIAGILLELIGDPADVCHVIIGVGVNVNMRASTEVDQLWTSVRLQTGAPADRNTIAARISSQLEALLVVHRQEGFLAFQKEWEQGHLWQGAAVKLLSGIETVEGVVLGVDSLGALRLEVNGLEKSFSGGELSLRLRDDS

SEQ ID NO: 13370 - protein, 441 aa, Arabidopsis thaliana
  misc_feature (328)..(328): Xaa can be any naturally occurring amino acid
  unsure (1)..(441): unsure at all Xaa locations
MYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAXALKAPESYFKELKRDYNVKKETLVKGLKEVGFTVFPSSGTYFVVADHTPFGMENDVAFCEYLIEEVGVVAIPTSVFYLNPEEGKNLVRFAFCKDEETLRGAIERMKQKLKRKV

SEQ ID NO: 13371 - protein, 425 aa, Clostridium perfringens
MDRNKEIFEESKKYMPGGVNSPVRSFGSVGINPPVIKSGKGAMIKDENGNEYIDFVLAWGPMILGHCDEDVVEAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYNHIEKIGSKLEKGVLEIAKKKGLGLVVNRQGGMITLFFTDLKEVKCYDDVKTCDGERFKRYFLHMLNKGFNIPPSQFEAMFLSVKHTEEHIDKFLEAFETFEG

SEQ ID NO: 13372 - protein, 449 aa, Streptococcus agalactiae
MTITAEDIRREVKEKNVTFLRLMFTDILGVMKNVEIPATDEQLDKVLSNKAMFDGSSIEAFVRINESDMYLYPDLDTWIVFPWGDENGAVAGLICDIYNAEGEPFCRRFHVKFQRNMKRMNRVGYNSFNFRTRPDFLLFKLMKCNQHLIDCYCPRRPTLTLAPTDLANNNRREIVSLNTNWALKLKLVIMKLAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 13373 - protein, 390 aa, Ralstonia eutropha JMP134
MSADSTLAPLTPPVSRLPSVGTTIFTVMSALAAEKNAVNLGQGFPDFDCDPRIVDAVTHAMRTGHNQYPPMAGVPRLRQAIADKIATLYGHRYSWESEITVTAGATQGILTAILCAVHPGDEVIVLEPCYDSYLPAIELAGATAVPVTLEAPDFRVPFDRLAAAITPRTRMILINTPHNPTGTIWRAADMDKLAQLLAGTDILLLSDEVYEHMVYDREPHASVSRHPELARRSFVISSFGKTYHVTGWKVGYVAAPAALSAEFRKVHQFNVFTVNTPVQHGLADYMADPAPYLELSAFYQAKRDYFRAGLANTRFKLLPSEGTYFQCVDYSAISDLSEAEFSMWLTREIGVAAIPVSAFYTQPRESGVVRFCFAKKEETLSRALERLAKL

SEQ ID NO: 13374 - protein, 535 aa, Streptococcus pneumoniae R6
MQEKWWHNAVVYQVYPKSFMDSNEDGVGDLPGITSKLDYLAKLGITAIWLSPVYDSPMDDNGYDIADYQAIAAIFGTMEDMDQLIAEAKKRDIRIIMDLVVNHTSDEHAWFVEACENPNSPERDYYIWRDEPNDLDSIFSGSAWEYDEKSGQYYLHFFSKKQPDLNWENEKLRQKIYEMMDFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAREALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGNVKSVLIENTLAQEVFEKQILVPWDAFCVELL

SEQ ID NO: 13375 - protein, 251 aa, Burkholderia thailandensis E264
MSKQRIKRVIGNWKMHGRLSGNQALLTEVAQGAQAVHDNVAIGVCVPFPYLAQAQAQLQGGRVSWGSQDVSAHEQGAYTGEVAAGMVAEFGAAYAIVGHSERRAYHGESNETVAAKARRALAAGLTPIVCVGETLAEREAGTTEQVVGAQLDAVLAVLSPDEAARIVVAYEPVWAIGTGKSATAEQAQQVHAFLRGRLAAKGAGHVSLLYGGSVKADNAAELFGQPDIDGGLIGGASLKSGDFLAICRAAK

SEQ ID NO: 13376 - protein, 343 aa, Vibrio sp. Ex25
MKIKALSKLKPEEGIWMTEVDKPEVGHNDILIKIKKTAICGTDVHIYNWDEWSQKTIPVPMVVGHEYVGEVVAIGQEVRGFEIGDRVSGEGHITCGHCRNCRGGRTHLCRNTIGVGVNREGAFAEYLVIPAFNAFKIPDEISDDLASIFDPFGNAVHTALSFDLVGEDVLITGAGPIGIMAAAVAKHVGARHVVITDVNEYRLELARKMGVTRAVNVAEEKLEDVMAELGMTEGFDVGLEMSGNPAAFNSMLTTMNHGGRIALLGIPPSDMGIDWNQVIFKGLVIKGIYGREMFETWYKMASLIQSGLDLSPIITHHYKIDDFQEGFDVMRSGMSGKVILDWE

SEQ ID NO: 13377 - protein, 132 aa, Arabidopsis thaliana
  misc_feature (6)..(6): Xaa can be any naturally occurring amino acid
  misc_feature (18)..(18): Xaa can be any naturally occurring amino acid
  unsure (1)..(132): unsure at all Xaa locations
LRSNYXFTARSGYSVCTXTTTTATNAALPNYMAITESAKARIRSQSAPRQRPSTPEKERISSARKRLSFPVPPLPQQMDGQSLRSPSFKSIGGSQLGALEQQSNYSSCCTESLGGGGEISPASTSDYRRWLR

SEQ ID NO: 13378 - protein, 590 aa, Leptospira interrogans serovar Lai str. 56601
MEHHSLSLLNDIALSIIFATFFSHIARITKQPLILGYVAGGLLLGPNLGLSLVINEESIELISEIGLILLLFIIGLEIDLKELARMGKSMFVLGIVQFVFCVLFGFFFFKWILANSTGRFDLLYFAIALAISSTMIVVKLLHDKFEVSTIAGRLTIGVLVLQDIWAIIFMGVQPNLQNPQILKIAGSLGIGLVLICVSFLISRFFLSKLFNAAASKPELILITSIAWCFLLCGFAEKAGLSKEMGALIAGVSIAAFPYGADVIAKLSGIRDFFITLFFVALGMKIPIPSIQILSISLIAVVFVIFSRVITVATPVYLSGKGLRAGIVTGLNLAQISEFSLVILSLGMGYGHISKELESTVLTSMILASVVSTYIILFNDPISRFILKILNMIGLKEKEDEEDQTESYITGQSKRDIVILGYFRIAQGLLEGIEREKPEWLNRILIVDFNPVFRQSLEAKGIRWAYGDLANPETLHHLGIEEAKYVICTISDMILKGTTSRRLLESLKVICHRTQPSIILTTDDVQEAEILVKSGAAHVIVPGRISGMSLFKEMKTIVDHSKRSLESQTSSVKKKKTMKKKVSSTSKIKVK

SEQ ID NO: 13379 - protein, 469 aa, Photobacterium profundum SS9
MSVENVLALIQENEVKFIDLRFTDTKGKEQHITIPSHQIDSDFFEDGKMFDGSSVAGWKGINESDMVMMPDASSAVLDPFTEDSTLNIRCDILEPATMQGYDRDPRSIAKRAEEFMRSTGLADTVLVGPEPEFFLFDDVKFNTDMSGSFFKIDDIEAAWNSGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHMSLNKDGQNLFAGDKYGGLSEMAIYYIGGIIKHARAINAFANPATNSYKRLIPGYEAPVMLAYSARNRSASIRIPVVPSPKARRIEVRFGDPAANPYLAFAAMLMAGLDGIQNKIHPGEAMDKDLYDLPAEEAAEIPQVAESLEIALKNLDEDREFLTAGGVFSDDFIDSYIKLKSEDVEKVNMTTHPLEFELYYSV

SEQ ID NO: 13380 - protein, 382 aa, Listeria monocytogenes
MNHSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVAETFQKRLEYIAKRVEKIPYLSLHPLKGSIYAFINISKTNMDSVSFTEYVLKETQVLVIPGLAFGESGDNYVRLAATQDISVLEEAFNRLAKLTF

SEQ ID NO: 13381 - protein, 410 aa, Oceanospirillum sp. MED92
MSQTTSLDKSKIKILLLEGVHQSAVDTFNQNGYTNIEFLTGSLPEEELIARIKDVHFIGIRSRTQLTEKVFAAAEKLVAVGCFCIGTNQVNLEAATMRGVAVFNAPFSNTRSVAELVIAEAILLLRGVAEKNAKAHRGEWQKSAKNSYEIRGKKLGIVGYGSIGSQLSVIAESLGMKVYFYDVVTKLPLGNATQVGSLKELLNISDIVSLHVPETPSTQDMMGEAQFAEMKQGSIFLNAARGTVVVIDELCKALDSGRLLGAAVDVFPVEPRTNNDEFISPLREYDNVILTPHVGGSTMEAQENIGYEVAEKLIKYSDNGSSITSVNFPEVALPEHPNVHRLLHVHNNVPGIMTAINSVFSENSINISGQYLQTNEKVGYVVVDVDADYSQVALQNLRQIEGTIRCRRLF

SEQ ID NO: 13382 - protein, 503 aa, Coccidioides immitis RS
MSDDDFMQESDQEEYDFEYEDADDDELGDIGIENKYYNAKQIKGENPEEAIEEFLGVPLLEQDKGDWGFKGLKQAIKLEFKLGRYDDAVEHYQELLTYVKSAVTRNYSEKSINNMLDYIEKGAEDEKAYHCMEKFYSLTLNSFQSTNNERLWLKTNIKLARLWLDRKEYGQLSKKVRELHKACQRPDGTDDPAKGTYSLEVYALEIQMYANTKNNKRLKALYQKALKVRSAVPHPKIMGIIRECGGKMHMSEENWKEAQSDFFESFRNYDEAGSMQRIQVLKYLVLTTMLMKSDINPFDSQETKPYKNDPRISAMTDLVDAFQRDDILAYEDILKKNQDLLADPFIAENIDEVSRTMRTKAVLKLIAPYTRFSLAFVSKQLRISVPEVQDILSYLILDGKLQDAKIDELTGIVTIGGWHDSERLAAVDMWMGELNKLWNTVLSQGDGFRADESGRMLGSLTGGASLGMGHGGSHLGSLRSLGRGPQQGHPKHAKGKPTKKAHR

SEQ ID NO: 13383 - protein, 265 aa, Triticum aestivum
  misc_feature (203)..(203): Xaa can be any naturally occurring amino acid
  unsure (1)..(265): unsure at all Xaa locations
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVCXITRIIYGGSVTGASCKELAGHPDLDGFLVGGASLKPEFIDIINAATVNLPKQDLDVVLSALE

SEQ ID NO: 13384 - protein, 422 aa, Corynebacterium glutamicum ATCC 13032
MSEHEQAHSQLDSVEEAIADIAAGKAVVVVDDEDRENEGDIIFAAELATPELVAFMVRYSSGYICAPLTAKDADRLDLPPMTAHNQDARGTAYTVTVDANTGTTGISATDRAHTLRLLADPEADRTDFTRPGHVVPLRAREGGVLVRAGHTEAAVDLARAAGLRPAGVICEVVSEEDPTGMARVPELRRFCDEHDLKLISIEQLIEWRRKNEILVERQVETVLPTDFGTFKAVGYRSIIDGTELVAIVAGDVASDGGENVLVRVHSECLTGDVFGSRRCDCGQQLHESLRLIQEAGRGVVVYMRGHEGRGIGLLAKLRAYQLQDEGADTVDANLALGLPADAREFGTSAQILYDLGVRSLNLISNNPAKKVGLEGHGISIASRTPIPVAVHEDNVRYLKTKRDRMGHDLPDVALWEQEHPEN

SEQ ID NO: 13385 - protein, 470 aa, Triticum aestivum
MRTMTHRLPPAVAAVAVVLVALTCLHRPAAASGHAADRIARLPGQPAVDFDMYSGYITVDEGAGRSLFYLLQEAPEDAQPAPLVLWLNGGPGCSSVAYGASEELGAFRVKPRGAGLVLNEYRWNKVANVLFLDSPAGVGFSYTNTSSDIYTSGDNRTAHDSYAFLAKWFERFPHYKYRDFYIAGESYAGHYVPELSQLVHRSKNPVINLKGFMVGNGLIDDYHDYVGTFEFWWNHGIVSDDTYRRLKEACLHDSFIHPSPACDAATDVATAEQGNIDMYSLYTPVCNITSSSSLAASRPRPRGRYPWLTGSYDPCTERYSTAYYNRRDVQMALHANVTGAMNYTWATCSDTINTHWHDAPRSMLPIYRELIAAGLRIWVFSGDTDAVVPLTATRYSIGGLGLPTTTSWYPWYDDQEVGGWSQVYKGLTLVSVRGAGHEVPLHRPRQALVLFRYFLQGEPMPGQTKNATVA

SEQ ID NO: 13386 - protein, 229 aa, Prunus armeniaca
MAMLKSALAFLVLAFAFFFCYVMSSGSYDYFQFVQQWPPTNCRVRTKCSNPRPLQIFTIHGLWPSNYSNPTMPSNCNGSKFDDRNVSPQLRAKLKRSWPDVESGNDTRFWEGEWNKHGTCSEQTLNQMQYFERSQNMWRSYNITEILKNASIVPSATQTWTYSDIVSPIKTATQRTPLLRCKPDPAQNKSAPKPQLLHEVVFCYEYNALKQIDCNRTAGCKNRQAISFQ

SEQ ID NO: 13387 - protein, 226 aa, Prunus armeniaca
MAMLKSPLAFLVLAFFLCFIMSTGDGTYDYFQFVQQWPPTTCGVRGKPCSKPRLLQNFTIHGLWPSNYSNPTMPSNCNGSKFEARKVYPQLRSDLKISWPDVESGNDTKFWEGEWNKHGTCSEQILNQMQYFERSHAMWTSYNITKILKNASIVPSAKQKWKYSDILSPIKTATGRTPLLRCRTDPALRNVQFLHEVVFCYGYNALKQIDCNRTAGCKNQVDIVFK

SEQ ID NO: 13388 - protein, 830 aa, Arabidopsis thaliana
MDLKENSFEHMGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNVGPTWAFFNNSQDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 13389 - protein, 299 aa, Solibacter usitatus Ellin6076
MIAAITFVNYRGITLGATVQKLFTFTKVAALAILVAAAFVGPAHAVSENAAGPVTLSGFGVAMISCLLSYDGWVALSFVAGEVRDPKRTLPLALALGVGGAIAIYVLANIAYLRVLSVGEIAATARVGALAAERTMGPTGGAFVSFSILMSIVGAINGWVLAAPRIYFAQARDGLFFRSFAAIHPRFQTPYVSILTFGAWSALLAITGTYETLASYAMYAAWVFYALTALAVIALRRRQPDRPRPYRMTGYPVTLLIFAAVAFGFVINTFYATPGPAIVGTLLIGAGVPVYFIWRGTAG

SEQ ID NO: 13390 - protein, 309 aa, Glycine max
MAATSTSLASQLYIGLRRPCLKLDSFNSQSFSLFDPNLRLSLSPPKPSRAVIAMAGTGKFFVGGNWKCNGTKDSISKLVADLNNAKLEPDVDVVVAPPFLYIDQVKNSLTERIEISAQNSWVGKGGAFTGEISAEQLKDLGCKWVVLGHSERRHVIGENDEFIGKKAAYALSQGLGVIACIGELLEEREAGKTFDVCFQQLKAYADAVPSWDNIVIAYEPVWAIGTGKVATPQQAQEVHVAVRDWLKKNVSDEVASKTRIIYGGSVNGGNSAELAKQEDIDGFLVGGASLKGPEFATIVNSVTSKKVAA

SEQ ID NO: 13391 - protein, 377 aa, Yersinia pestis CO92
MIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 13392 - protein, 248 aa, Alkaliphilus metalliredigenes QYMF
MRKPIIAGNWKMNKTVAETLQFINEIRDQAETTDVEVVLCCPFTALSEAKKALGASKIKLGAQNMHWEDNGAFTGEISAEMLKELGVDYILIGHSERRQYFNETDETVNKKIKKALEQKLMPILCVGETLQEREAAQTFDVIKNQITIDLEGILPDSMKDIVIAYEPIWAIGTGKTASSQDANHVIAYIRQLIQEKYDDGISETVRIQYGGSVKPENATEIMNEEDIDGALVGGASLKADAFLGIVNF

SEQ ID NO: 13393 - protein, 511 aa, Alkaliphilus metalliredigenes QYMF
MKNPVALVILDGLGNREGELGNAVKKANLPNYHRLMSQYPHTEVEASGLAVGLPEGQMGNSEVGHLNIGAGRVVYQELTRISRAIETGDFFKNEHFLKLLRKLKTSGKALHLMGLVSDGGVHSHMNHIVALLKLAKREGLKRVCLHCFLDGRDTPPQSGLDYIKSLEASIAEIGVGRIVTISGRYYAMDRDQRWERVQQAYDAMTLGKGRLAEGAITAVEMAYSLKETDEFVIPTVIPNDEGEFELIEPDDGIIFFNFRPDRAREMTRALMDETFEGFKREKGYFSLNFVSMTSYDKTIENAEVAYPPQSLANTLGEYISKQGIKQLRMAETEKYAHVTFFFNGGVEIANIGEQRKLVPSPKVATYDLQPEMSAYELTEELIKEIDKDQYDFIVVNFANPDMVGHTGIEIAVIKALETVDECLGKVIDKLIEKGGKAIVTSDHGNAEEMIDEVTGGPVTSHTINPVPLILVGEEQTSLRDDGKLCDIAPTLLEMMNLSKPLEMTGKSLIKK

SEQ ID NO: 13394 - protein, 255 aa, Enterobacter cloacae
MRHPLVMGNWKLNGSRHMVNELVANLRKELAGVTGCAVAIAPPDMYLDLAKHAADGSHIILGAQNVDVNLSGAFTGETSAEMLKDIGAKYIIIGHSERRTYHKESDEFIAKKFAVLKEQGLIPVLCIGETEAENEAGKTEEVCARQIDAVLKTQGAAAFEGAVIAYEPVWAIGTGKSATPAQAQAVHKFIRDHIAKADAKVAEQVIIQYGGSVNASNAAELFTQPDIDGALVGGASLKADAFAVIVKAAEAAKQA

SEQ ID NO: 13395 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTIGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 13396 - protein, 367 aa, Picrophilus torridus DSM 9790
MPHWVEVNFGPVHPSAHGIYRFKVLLDGEIVKDVDIQIGYLHRNAEKICELNPYPDAIIYFDRMDYLDAMNMELGYLTAVEKLTGIEPPERAIWIRMIMAELSRLASRLVGLGALGLDFGMLTPFFHCFIEREKIQKIFVEASGGRQEVNYMSIGGVYQDLTDKIIDDIKTFIEQFKKRLEDIYNQFIHSEIFYERNNNIGILERETALDYGVTGPLLRSTGVPYDIRRVEPYLFYDKVNFDVPISNKKDNLARFVLRVEEMRQSIRIIEQCLSKIPAGPYFNPKAKKSLMLRVTGNGEAYSRIESDKGEFGVYIVGNGTTKPYRVHVRSPAFKNLSVLPELARGYMIADLISIIGTIDAVTGEVDR

SEQ ID NO: 13397 - protein, 338 aa, Gibberella zeae PH-1
MAPIKVGINGFGRIGRIVFRNAVEHPDIEVVAVNDPFIEPHYAVYMLKYDSSHGIFKGEVGNQGNDLVVNGKTIKFYSERDPANIKWSETGADYVVESTGVFTTIDKAKAHLQGGAKKVIISAPSADAPMYVVGVNENKYDGSADIISNASCTTNCLAPLAKVINDKFGIVEGLMTTVHSYTATQKTVDGPSSKDWRGGRGAAQNIIPSSTGAAKAVGKVIPELNGKLTGMSMRVPTANVSVVDLTVRLEKGASYDQIKQVIKEASEGDLKGVLAYTEDDVVSSDLNGNTNSSIFDAKAGISLNDNFVKLVSWYDNEWGYSRRVLDLLAHVAKVDASK

SEQ ID NO: 13398 - protein, 337 aa, Ustilago maydis
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKRVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 13399 - protein, 746 aa, Bdellovibrio bacteriovorus HD100
MHHLPHLITDLGFILMIAALSTLLFKKLGQPQVLGYLIAGFLVSPHVPFLPTVTDKVSIQVWSEIGVIFLLFSLGLEFSFKKLFKVGGSASFTAVFEVVFMVALGYLVGHLLGWNNIDSLFFGGILSVSSTTIIVRAFQELGMKGKKFVELVFGILVVEDIVAILLLVLLTAIASSDTFSTAELAFSGLRLLFFIALWFVVGIFLIPIFLRKIRSLLEDETLLLVSIGLCFMMVMIAAGVGFSPALGAFVMGSLLAETPEGHQMEHVLQPVKNLFAAIFFVSVGMMIDPKVIIERWDLVILVTLVTIVGKFVSTFLGAVLSGQGRKQAFQSGMSLAQIGEFSFIIAALGVSLKVTSDFLYPLAIAVSAVTTFTTPYLIKVADPFYRWVEARLPEGVKRNLDQYHASFSQAGEQKAGTLIMKTYGMKILLNTVMVIAIMAAFKAVVNLEIQKYLQESPWAGGISMFICLLISAPFIWGIVMSGPSLRAQRELEELQKLRGLQAGLFVGRLALAVILLGVLVSQFATLKVASGVIVAVIGVAALAGQLWVQRLYQFIEKNFQKNLTEKERKELVSSSVAKNFLPWETTLGNYDIAAESSLVGRTLRDLSFKENYGVTVAAVFRGAKRYFAPDGEFVLWPHDKLICFGSEEELQSFHTFLEGEKAAQVLEPEMTTRQDDYRLSSFVVLDDSKFKDKTIRESGIRESYHGMVVGIERGPQRILGPRASFTLRENDLVWVVSDKKQSQVTV

SEQ ID NO: 13400 - protein, 269 aa, Oceanospirillum sp. MED92
MTKTILITGSTDGIGLATALRLAEEGHHILLHGRSEKKLAEAQNKLKQVEGSGGVSCYQADLSVMADVVRFAEKVKAEQTHIDVLINNAGIFKTEERITSDGLDVRFAVNTVAPYLLTEKLLPMLGNQGRVINLSSAAQSEVNLEALLGVVSVEQDFNAYAQSKLAITMWSRVLAKSLTAGPAVIAVNPGSMLGTNMVQKGFGVSGNDISIGVNILTALALDDKYQQCSGQYFDNDAGHFADPHIDALDQHKSVAVVDAIKNILTELKL

SEQ ID NO: 13401 - protein, 231 aa, Prunus armeniaca
MAMLKSPLAFLVLAFALFLCFIMSTGSYVYFQFVQQWPPATCIRSKKPCSKHRALQNFTIHGLWPSNYSNPTRPSNCVGSHFNESKLSPQLISKLRISWPDVESGNDTQFWEGEWNKHGKCSQEKLNQMQYFERSHDMWMSYNITDILKNASIVPHPTQTWTYSDIVSAIKSKTQRTPLVRCKRDPAPNKNAPNSQLLHEVVFCYEYKAKKQIDCNRTAGCWNNVDIKFPP

SEQ ID NO: 13402 - protein, 307 aa, Solanum virginianum
MGSKHSKETTSTSHRVPFVDLQEATNNFDDNFLIGEGGFGKVYRGVWRDGTKVALKRYNPKSGQGIAQFRTEIKMLSQLRHPYLVSLIGYCDENNEMTLIYEYMENGNLRKHLYGSDLPTLSWEQRLEICIGAAKGLHYLHTTAVIHCDVKCTNILLAENFVAKVADFGLSKKGTVLDETHTTTMMKGTFGYLDPEYYRTLRLTEKSDVYSFGVVLLDVLCARPAVASSSSKGIINLAEWAMKWKKKGQLERIIDPNLVGKIIPDSLRKFGETAEKCLAESGVDRTSMNTVLWNLEYALHLQEPVIQ

SEQ ID NO: 13403 - protein, 491 aa, Candida glabrata CBS 138
MKPELKNPDLIKGLGYINGEWVKDSNEFFEVDDPSTGEIIAKLPEHDIAVVDRAVDAAYDAFQKYKNTLPRQRATWLRNLFNLMTENAEDLAKIITWENGKSLPDSRAEIKYAASYYEWYAEEAPRIYGATIQPSIPNNRVITKRQPVGVCGIICPWNFPSAMITRKVGAALAAGCTVVVKPDSHTPLSALAMTVLVEKAGFPKGVFNVVLSQHNTPKLGKRLCEHPKVKKVTFTGSTRIGKTLMEQASSTLKKCSFELGGNAPFIVFDDADLDLAVDQAIASKFRGMGQTCVCTNRFYVQDTIADEFAEKLVTKVKQFKIGDGMKEGVTHGCLTNAKQADKVDEHKKDAIEKGAKVLLEGGRMPDLGKNFYAPVVLKNVPQSAMVAKEETFGPLCPIFTFKTVEEVLGYANDTELGLASYVFTKNVNTLFTVSEALEAGMVSCNTGLFSDSSVPFGGVKESGFGREGSLYGIDDYTTVKSIIIGNLPDSL

SEQ ID NO: 13404 - protein, 1038 aa, Pichia pastoris
MMKPYTLDTGYPVYGAKFITKRTLLTAGGGGEGNNGIPNKLSGFRIDFTKVKAVQKFRELTLSANEDCPMSLDAANNVILLGVNENTSSIKQGKNNHLRKFGYINHHLKYLDKQQLSNSRDNRDYQKFTHLSSDASVACIATSKVPTTIYVVDPQTLEKKFDLETGVDVKDMHISPDGKIVCYVCANSLHGYSTVTAKLLFKDDSFKNHTLMKVKFLDQHHLLIVGSQKQGISLIHYSLAKNSIVNSRVISKKLKGVTSLDTRNGVIALSGNDNSLLLIKVSNLKPIKQFNKIHKFSITSCCFNKTGDLLATVSAANTVSVMEIPKGLATKKSLPRKIFNYFILTVFMAILAIVLQWSIENGHLQHAWQKLLNGDVIDSSRYFKVESIPDEELSASLLESSYSGLSSETKSVTDAISASVPIIETTVDTTTTSNSVRRTIPEGYSTAKEFQPDKIKLYKSSLDSDPSADSTGSFTVSITETQSSSIKPQKSKKTKKLKKKTSSTATPGSSTALVETLIVSTSPQSVDTSLSVTSPVASSTAQDSYLTSSAHSALTTKGAKKLKKKRKIKTKTVKTTKTTETETETETIVQDDLADITISSDIVSDISSEVSNSETVVQEGLPTEVIESLLNKDPTVDEPIAEESAIIDLPLGKPVTEKLTLDTQEAIESSVDEPAIGIDIEDAIVADEKEEPLTADDAVLDGEEREIEDPDEIPSEVLTDVADSPEEYQDDININNSQEATSTHDSNVSEETAAPVEETQESVGTDDQAEPEKFDEEEKTENEHQYEKDDHSELAEETQESHDDQVDEVEEVLEEVKDFLGETKDVLEEAKFVLEEAQEGAEVSDKTELTEQDETEKFIESSDALRSSVGTVEATEQTTATSVDPNTEIDTKTTSEAVIESNTPVENEESTVEDREINSSIDEIAEKSISQEEIVSKLEDSSSENNEGEREEEEIEESEDEKAGDIEEEEEEYEDDDDEYENVGTEEEKDEEEVQGDHEEQEDEEEVDDEEEEDDDEDEEDEDEDEDEEGENINHDEL

SEQ ID NO: 13405 - protein, 429 aa, Xanthomonas campestris
MNHSRSHALFAQAQTLLPGGVNSPVRAFKSVGGEPFFVARADGPYLFDVDDNRYIDYVGSWGPMIAGHNHPAVREAVEQSIRNGLSFGAPCAAEVTMAQTIARLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDVVESYAQATACDITSFNRFFHAMLQRGVYLAPSAYEAGFMSSAHDEAVIEATLAAAREAFADVAR

SEQ ID NO: 13406 - protein, 604 aa, Corynebacterium glutamicum ATCC 13032
MTDTSPLNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 13407 - protein, 467 aa, Xanthomonas oryzae pv. oryzae KACC10331
MSDVLPIILSGGSGTRLWPLSRESYPKQFLPLVGDKSMLQSTWLRAAPVAAHAPILVANEEHRFMAAEQLQQLGVKPSAILLEPKGRNTAPAIAVAALEATRDGADPLLLVMPSDHVIQNEAAFQAAVTAAAAAAEQGKLVTFGIKPTAPETGYGYIKAGTGNGVSAVERFVEKPDLATAQSYLASGEYYWNSGMFLFRASRYLEELRKFHPAIVDACQKAWENGKRDADFTRLDKDAFAASPSDSIDYAVMEKTADAVVVPLDAGWNDVGSWSSLLDVSKQDAQGNAHHGDVIQLDCKNTYAYGSRLIAMVGLEDVVVVETPDAVLVGHRDRIQVVKDVVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 13408 - protein, 266 aa, Bacteroides thetaiotaomicron VPI-5482
MKITIIGAGNIGSAVAACLAKGHLYNEKDIIISTPHTDKLENLHKQFPAIRIMTENQYAISEADIIILAVKPCIVDEVLSPLRFSRTQILVSLVTGISISHLAHLSETEMPIFRVVPNIAITEHSSLTLITSRKAGKEHQQLIKQTFEEGGKCLFAEEKQLDIISALTSSGIAFALKYIHAAMQAGIELGISAEDAMRMTAYSMEGATELILNHDTHPLLEIEKAATPGGATIKGLNELEHRGFTSAVIHAIKSSATVSTDKETEE

SEQ ID NO: 13409 - protein, 393 aa, Ehrlichia ruminantium str. Gardel
MSDHVKITPMTLNFGPQHPAAHGVMRLVLEMGGEVIERIDPHIGLLHRGTEKLIEYKTYLQALPYFDRLDYVSPMAQEHAYSLCVEKLLKCEVPIRAKYLRVIFCELTRILNHLLNISSQALDIGAMTPLLWMFEEREKILNFYERASGARFHSAYIRPGGVAADIPEDLIHDIFQFVNTFPKFMDDVDSLLTENRIWKQRNVDIGVVSKKQALNWGFSGPMLRACGIPWDLRKSQPYEIYDELEFKIPIGEKGDCYDRYLVRMAEIRESISLVEQCLNRIPDGPVKTDDRKIAPPKRSEMKKSMEALIHHFKLYSEGYIVPAGETYMAVEAPKGEFGVYIVSDGTNKPYRCRIRAPGFAHLQAIDMMAKGHMLADLTAIIGSLDIVFGEIDR

SEQ ID NO: 13410 - protein, 464 aa, Bacillus licheniformis ATCC 14580
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIGKNGENKRVDGKSA

SEQ ID NO: 13411 - protein, 95 aa, Prunus mume
LWPSNYSNPKMPSNCIGSRFNFTKVSPRLRSKLKISWPDVESGNDTKFWEGEWNKHGTCSERTLNQMQYFQRSHEMWNFHNITEILRNASIVPHP

SEQ ID NO: 13412 - protein, 282 aa, Zymomonas mobilis subsp. mobilis ZM4
MMSPISIPSIRLNDGNDLPAVGFGTYKLNGSAGVSDIVSAIKVGYRLLDSAFNYENEGAVGEAVREAGIARDKLRIVSKLPGRHHHFEEAIATVEESLYRAQLDYYDLYLIHWPNPSKDLYVEAWQALIEARKKGLIRSIGVCNFLPEHLERLIKETGVTPVVNQVELHPYFPQEEQRAWDKAHGIVTESWSPLGRASKLLQDDTIKKIADRLGKSIPQVILRWHVQLGAIPIPKASSKERQIENLSLFDFELSPQDVEIIATLARPDGRLADQDPARYEEF

SEQ ID NO: 13413 - protein, 438 aa, Rhodococcus sp. RHA1
MSEDTVFTVAGQDWDDVVDAVKASSGGGGSEGGEERIVVNMGPQHPSTHGVLRLILEIEGETVTEARCGIGYLHTGIEKNLEYRTWTQGVTFVTRMDYLSPFFNETAYCLGVEKLLDITDEVPERASVIRVMLMELNRISSHLVALATGGMELGAVTAMLFGFRERELVLDVFEMITGLRMNHAYIRPGGLSQDLPEGAVEKVRELLALMPERLRDMENLLNDNRIWKGRTQGIGYLDLTGCMALGITGPMLRATGLPHDLRKSQPYCGYENYEFDVSTDTGCDAYGRYLIRVDEMKESLKIVEQCLDKLRPGPIMAEDKKIAWPADLTLGPDGLGNSPGHVREIMDSSMESLIHHFKLVTEGFRVPPGQVYVAVESPRGELGVHMVSDGGTRPFRVHFRDPSFTNLQSVAATCEGGMVADVIAAVASIDPVMGGVDR

SEQ ID NO: 13414 - protein, 80 aa, Arabidopsis thaliana
  misc_feature (12)..(12): Xaa can be any naturally occurring amino acid
  unsure (1)..(80): unsure at all Xaa locations
MASSMLSFSTMXASPAEGFICRSWSGDHKTSPSFPTPPKANNDITSITSNGGSINCMQVWPSIGKKKFETFFFPSDLTHS

SEQ ID NO: 13415 - protein, 479 aa, Cytophaga hutchinsonii ATCC 33406
MLERGQILESVAIEELGAEGKCVSRYNNIVIFSERTVPGDVVDLKVTHFKKKKFGEANVYKIITPSEHRVEAKCQHFGLCGGCKLQHIDYSTQLHFKQKQVKDNLERLGKIEIPEIMPIVGSGKTYEYRNKLDFTFSNKRWLLEEEMSLEHDTLYGLGFHLPGKFDRVIDISTCHLQPEPSNSIRLEVKAYALKHGLTFYNVRAHEGLMRNLIIRTTNTHEVMVLVQFGEDNKPAIQGLLSHLITTFPQITSLVYFINTKKNDTYSDLDVHVFHGPGYIQEEMEGLIFRVGPKSFYQTNSDQAYELYKVTRDFAGLTGNEVVYDLYTGTGTIANFVAKKAKQVIGIEYVADAIEDAKVNSKINNIDNTLFYAGDMKDVLNKEFIAQHQRPDVIITDPPRAGMHEDVINTLLFIGAPKIVYVSCNPATQARDLSMLDSDYEVSRIQPVDMFPHTAHVENVVLLTKRAVKKIIQKPVSEPA

SEQ ID NO: 13416 - protein, 429 aa, Listeria monocytogenes str. 4b F2365
MQNYSKSEKAFKEAKKVLPGGVNSPVRAFNSVDASPVFMDHGKGAYITDVDGNEYIDYVLSWGPLILGHADPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAELAFQKYGEEIAAVIVEPVAGNMGVVPPIDGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTEKEIDKTLEAFDTTCKILRG

SEQ ID NO: 13417 - protein, 531 aa, Staphylococcus epidermidis RP62A
MSHKILVSDPISEDGLQSILKHPEFDVDIQTDLSENDLVNMISTYDALIVRSQTQVTERIINAATNLKVIARAGVGVDNINIEAATLKGILVINAPDGNTISATEHSVAMLLAMARNIPQAHQSLRNKEWNRKAFRGVELYGKTLGVIGAGRIGLGVAKRAQSFGMKILAFDPYLTEDKAKSLDIQIATVDEIAEKSDFVTVHTPLTPKTRGIVGSSFFNKAKQNLQIINVARGGIIDETALIEALDNNLIDRAAIDVFEHEPPTDSPLIQHDKIIVTPHLGASTVEAQEKVAVSVSEEIIEILTKGNVEHAVNAPKMDLSKVDKTTQSFIGLSTTIGEFAIQLLDGAPSEIKVKYAGDLAQNDTSLITRTIITNILKEDLGNEVNIINALAILNQQGVTYNIEKQKKHSGFSSYIELELVNDQDKIKIGATVFAGFGPRIVRINDYSLDFKPNQYQLVTCHKDKPGIVGQTGNLLGSHGINIASMTLGRNDAGGDALMILSIDQQASEEVIKILNETSGFNKIISTKLTI

SEQ ID NO: 13418 - protein, 1193 aa, Arabidopsis thaliana
MEYASTFQRPILFHGGDGASYCFPNRLISPKGISITSGDSKVHSCFRLRRNVAQSGTLNLMNACFSGRFYSGHLHSTKSILGNGHQAKRIPFGFRLRCQGHESLGNADSNDHRIGESSESSDETEATDLKDARVENDTDSLEELKELLHKAIKELEVARLNSTMFEEKAQRISERAIALKDEAATAWLDVNKTLDVIRDTVYEEALAKEAVQTATMALSLAEARLQVIVESLEAGAGNDIPHVSEETEETIDVNDKEEALLAAKDDIKECQVNLDNCESQLSALLSKKDELQKEVDKLNEFAETIQISSLKAEEDVTNIMKLAEQAVAFELEATQRVNDAEIALQRAEKSLSISQTPEETQGQLSDEETSQEDAMVLSGNVEDVTHQVEKESPKDGDLPVVQITAELVPDIVGQRNKKLTQPYESSDHENGKPSVESSKVVEADSEKPKINVQTKKQETQKDLPKEGSSLNSPKASFNKSSRFFSASFFSSNPDGTATVFGSLVGSVKQQWPKLVLGLALLGAGLTLYSNGVGGNNQLLQQPDVTSTSTEDVSSSTKPLIRQVQKLPKRIKKLLEMIPHQEVNEEEASLFDFLWLLLASVIFVPLFQKIPGGSPVLGYLAAGILIGPYGLSIIRNVHGTRAIAEFGVVLLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPYVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 13419 - protein, 197 aa, Triticum aestivum
  misc_feature (143)..(143): Xaa can be any naturally occurring amino acid
  misc_feature (154)..(154): Xaa can be any naturally occurring amino acid
  unsure (1)..(197): unsure at all Xaa locations
MGAAATATATAVRLHAAATRRAAPRRPARLAVRADAARAATALTQDDLNLLAAVRAVEQVQSGMVLPLGTGSTAAFTVAEIGALLASGKLSGIVGVPTSKRTFEQATSLGIPLSTLDDHPVIDLAIDGADEVDPNLNLVKGRXGGALLREKMVXEAASGKFVVLTDETKLVNRLGREAASPLPGGSCAISAWKPQPK

SEQ ID NO: 13420 - protein, 766 aa, Candida albicans SC5314
MSSKSSSKKKNNGVSTPESSTAPAKKIKIPKSFIVRPNVPTNNKSVANVYINPEILSAMELNNGNLVLVSSSDSGSAGVVATVYSSNDIVDKNVITISFPYRQLCGLLLGDRVELVKFMNQPQYASDISISGVEETVTEDVRSALLDIGLVYPGLQINVDNKRITIVDVNDSLDASMDKLSIKDSDSLLSVHTVSPPYLFSPTTSINVATSSFPARSKYPNLPQQITYDQVGGLSKQIELLKSTIELPLNNPTLFSDFGISPPRGILLHGPPGTGKTMLLRCVANSITEAHVLTINGPSIVSKYLGETENAIRDIFNEAKKFQPSIIFMDEIDSIAPSRTSDDSGETESRVVAQLLTVMDGMGDNGRIVVIGATNRPNSIDSALRRPGRFDQEVEIGIPDVEAREEILTKQFAKMNSEKCQITKEEIASIASKTHGYVGADLTALCRESVMKAINRGLTVGIPQTAIKVTVDDVYHALPEIRPSAMREIFLEMPKVHWSDIGGQEELKRKLIEVVQLPLEASDSFKNLGVSSPKGVLLYGPPGCSKTLTAKALATESGLNFLAVKGPEIFNKYVGESERAIREIFRKARAASPSIIFFDEIDAIAGDRDGDSSTTAASNVLTSLLNEIDGVEELKGVVIVGATNKPTEIDPALLRPGRLDRHIYVAPPDYDARLQILQKCSRKFNLQSGDESVDLQKLAELTDGCSGAEVTLLCQEAGLAAIMENKEATTVTNKHFEHALKGISRGITPEMLEYYEKFSKKSGLNI

SEQ ID NO: 13421 - protein, 341 aa, Hanseniaspora guilliermondii
SCVFPSIVGRPRHQGIMVGMGQKDSYVGDEAQSKRGILTLRYPIEHGIVTNWDDMEKIWHHTFYNELRVAPEEHPVLLTEAPMNPKSNKEKMTQILFETFNVPAFYVSIQAVLSLYSSGRTTGIVLDSGDGVSHVVPIYAGFSIPHAIQRIDLAGRVLTDYLMKILTERGYSFTTTAEREIVRDIKEKLSYVALDFDQEMETAAQSSSIEKSYELPDGQVITIGNERFRAPEALFQPSFIGLESAGIDQTTYNSIIKCDVDVRKELYGNIVMSGGTTMFPGIAERMQKEMSALAPSSMKIKIIAPPERKYSVWIGGSILASLTTFQQMWISKQEYDESGPS

SEQ ID NO: 13422 - protein, 257 aa, Picrophilus torridus DSM 9790
MKISIIGAGTIGRAMAEALKDDYEIGLSSRDFSKLESWSGGRFKLFKNNAENAAYGDLIILSVKPFNIDDVLNEIKDNIKNKIIVSFLAGINIDYIESYAKTSIFRAMPNLPIITGDAITAVAYKNADENTIKIVDDIFKKTGECIFIDEKSMDAVTGLSGSGPAFISIMIDSMIVAGIRMGLPRDTARKLTLKTFEGTARLMEKTGLPPSEIRDRVMTPAGTAAAGVFEIENGNIRTTIARAVEASTKRSMELKRK

SEQ ID NO: 13423 - protein, 232 aa, Antirrhinum hispanicum subsp. mollissimum
LSLIVVGIVLLSKSCTITTAYFQYFRLVLHWPFSYCSLPDSKCKRTPLPSIFTIHGLWPNNYSQPLSDCNILVPFTNIYDQPLLQRMMRSWPDLNQPMNTGPSHNFWSYQWKKHGSCSLPRYSQTSYLFKALELYDRFNVLQILTDGRLAPGDNYTVSQINITIIQEIGAIPTVKCRSGFLTEVVICFDRRGKAVINCPFQFSYPCTDAKVEFPISGPPVTPLLHINIKDRI

SEQ ID NO: 13424 - protein, 234 aa, Methanosarcina acetivorans C2A
MTERNTSTDSPEKRAAGIAAAGLVSSGMLVGLGTGSTVAYTIKELGRRVREEGLDILGVVTSYQSEMLAIEAGIRLTTLAQHPELDLAIDGADQIDSELRAIKGGGAAHTREKIVSVSARRFVVVADESKTSKQLDKLVPVEVLPFAKEPVVKKIRELGGKPQLRSAVKKDGPVITDNGNFVLDVEFGVIKDPEALALQLSSIPGVVEHGIFCNVSELYIGNKDGAIKIITRQK

SEQ ID NO: 13425 - protein, 495 aa, Bdellovibrio bacteriovorus HD100
MLADRRAKIVATIGPATRDEKNLEKAIKAGMNVARLNFSHGSHEDHLKVVHSLRKLSKELQAPVAILQDLQGPKIRVGKFENGSIEIKPGEKLVVTTAKVLGKPGLVPSDFQELPLACVPGTRILLDDGLMEVKVLQVRGEEIDVEVVYGGILKDRKGMNLPGVNLPVDCMTPKDLEDLQFGIANKVDYIALSFVRHARDIRKLRELIEAGNSNAKIVAKIEMVEAIENLEEICRLSDAVMVARGDLAVEVGQSRLPGYQKRIISVCNQLGKPVITATQMLDSMVENPRPTRAEITDVANAVLDGTDALMLSAESASGKYPFKCIRTMHEIITEVERNEEEYYKISLENEFLSTPASIAASASLSALKLNATAIICLTTSGKTANIISAFRPKARIISVTQHLDVLNGMELGWGIQTHAIKPYKTMEDILREVDLLLVSHGLGKTGDRVILTLGQPIACGAKTNSIYVHTVGGENVAKLPNDKLPLRCQEEPVVE

SEQ ID NO: 13426 - protein, 354 aa, Arabidopsis thaliana
MKISALGRGGSSPLSACFHPSATAINDDLPSALPSPSNPSYISTSGDATTTCQYHTNVGVFFLSWSRSFLRRSLHLHFYSCNSTNCYLHSLDCYRHSIPFAFRLEIKPLTFWRKNGSKKLSRKPDIRVVWDLTHAKFGSGPDPESGFYVAVFVSGEVGLLVGGGNLKQRPRRQILVSKKENLFGNRVYSTKIMIQGKLREISIDVKVVNDDASLRFSVDDKSVLKISQLQWKFRGNTKIVIDGVTIQISWDVFNWLFGGKDKVKPDKIPAVFLLRFENQEVEGNDVLMMNKRVRDDVILRKENCRTPSFWASTYSHWSSSRMSSVMEWSSCREEDERSFGSKSWFSLIIYAWRK

SEQ ID NO: 13427 - protein, 353 aa, Euglena gracilis
MAPVKIGINGFGRIGRMVFQALCDQGLLGTTFDVVGVVDMATDADYFAYQMKYDSVHGKFKHTVSTKKSDANLAEADIIVVNGHEIKCIMATRNPEDLPWGKLGVEYVVESTGLFTEADKARGHLKAGAKKVIISAPGKGDLKTIVMGVNHTEYQASMDVVSNASCTTNCLAPLVHVLLKEGVGVEKGLMTTIHAYTATQKTVDGPSKKDWRGGRAAAINIIPSTTGAAKAVGEVLPAVKGKLTGMAFRVPTPDVSVVDLTFLAEKDTSIKEIDSLLKKASQTYLKGILGFTDEELVSTDFVHDNRSSIYDSLATLQNNLPGEKRLFKVVSWYDNEWGYSNRVVDLLKHMSGN

SEQ ID NO: 13428 - protein, 356 aa, Galdieria sulphuraria
MEHWSQYKDELIATAKALVTPGKGILAGDESTGTIGKRFASIQVENNEENRRSYRELLFTAPNFGHYISGVITFEETLYHKTSQGKPFVDVMKEAGVIPGIKVDKGVTPIPGTKDETSTQGLDSLLSRCQKYYETGARFAKWRAVIKISIADGCPSDVAIKENAWGLARYAAICQQAGLVPIVETRKFLWMEITLLKTLTSDREVLYEVYYALDQQHVLLEGTLLKPNMVLPGTDCKDKASPKKIAECTVRTLQRTVPAAVPGIVFLSGGQSEEEASVNLNAMNQVEMVKPWKLSFSYGRALQSSCLKAWQGKAENVRAAQEAFLARAKANGEATLGKYAGGTGNNESLFVKDYKY

SEQ ID NO: 13429 - protein, 131 aa, Candida glabrata CBS 138
MSGGKGGKAGSAAKASQTRSAKAGLTFPVGRVHRLLRRGNYAQRIGSGAPVYLTAVLEYLAAEILELAGNAARDNKKSRIIPRHLQLAIRNDDELNKLLGNVTIAQGGVLPNIHQNLLPKKSAKPSASQEL

SEQ ID NO: 13430 - protein, 87 aa, Arabidopsis thaliana
QVDAAVVTFKLKHPRDYPDVSSTKNFFSLVNSAFNGKRKMLRKSLQHISSSPDIEKALGVAGLPATSRPEELTLDDFVKLHNVIARE

SEQ ID NO: 13431 - protein, 419 aa, Galdieria sulphuraria
MTVAFVGSTNFSANLFGSKNKHGLQSKSFLGVSVSSEHPISRVQFTPAGGKSRIVCLAWGVKGGVEKFADSLIETARSIASPGKGILAVDESTKTIGKRLASIGVENTEENRQAYRELLFTCEGLGQYISGAILFEETLYQNARNGKSFVDCLRGVGVIPGIKVDKGLSPLPGGEAIETWCTGLDGLSERAAAYYKQGARFAKWRAVLQISPETPTELCVQENARGLARYAKTVQEQGLVPIIEPEILMDGDHDIERTAQVQEHVLATVYKECDSNGVLLEGSLLKPNMTVPGADCKRQVSAEDIARYTIRTMERRVPSAVPGIMFLSGGMSEEEASVYLNVMNKIQRRGPWSLSFSYGRALQQSCLKSWKGKQENVKAAQEALLARARANSKANLGKYVPGSEPTLDKTGTFEKAYVY

SEQ ID NO: 13432 - protein, 325 aa, Arabidopsis thaliana
MADPRFMLLLSLSNLGLKSFSDFDCSFFFFLFVSRVAVVTGSNKGIGFEICRQLANNGITVVLTARDENKGLAAVQKLKTENGFSDQAISFHPLDVSNPDTIASLAAFVKTRFGKLDILVNNAGVGGANVNVDVLKAQIAEAGAPTDISKIMSDTYEIVEECVKTNYYGVKRMCEAMIPLLQSSDSPRIVSIASTMGKLENVSNEWAKGVLSDAENLTEEKIDEVINEYLKDYKEGALQVKGWPTVMSGYILSKAAVIALTRVLAKRHKSFIINSVCPGFVNTEINFNTGILSVEEGAASPVKLALVPNGDPSGLFFDRANVSNF

SEQ ID NO: 13433 - protein, 249 aa, Xanthomonas oryzae pv. oryzae KACC10331
MTRKLVLLRHGQSQWNLDNRFTGWVDVELTDQGRQEAVAAGKLMKDEGLQFDVAHTSVLKRAIHTLQGALKELDQDWLPVSKSWRLNERHYGGLQGLDKAETAAKHGEEQVKIWRRSYDIPPPAMDVDDPGHPCHDRRYATLDRNALPGTESLATTLVRVLPYWHDAIAPQLKAGQTVLVTAHGNSLRALYKYLNDVSNEQILELNIPTGIPLLFELDDNLQVRSFRYLGDPEAAKRAAEAVANQGKAK

SEQ ID NO: 13434 - protein, 70 aa, Zea mays
MAEQTFIMIKPDGVQRGLIGEIISRFERKGFYLKGLKLVTVDRPFAEKHYADLSAKPFFSGLADYIVSGP

SEQ ID NO: 13435 - protein, 283 aa, Streptococcus pneumoniae TIGR4
MATIQWFPGHMSKARRQVQENLKFVDFVTILVDARLPLSSQNPMLTKIVGDKPKLLILNKADLADPAMTKEWRQYFESQGIQTLAINSKEQVTVKVVTDAAKKLMADKIARQKERGIQIETLRTMIIGIPNAGKSTLMNRLAGKKIAVVGNKPGVTKGQQWLKTNKDLEILDTPGILWPKFEDETVALKLALTGAIKDQLLPMDEVTIFGINYFKEHYPEKLAERFKQMKIEEEAPVIIMDMTRALGFRDDYDRFYSLFVKEVRDGKLGNYTLDTLEDLDGND

SEQ ID NO: 13436 - protein, 393 aa, Physcomitrella patens
MAKTKQIKNFTLNFGPQHPAAHGVLRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLSFDVPVGTRGDCYDRYCIRIEEMRQSIRIIMQCLNQMPSGMIKADDRKLCPPSRSQMKQSMESLIHHFKLYTEGFSVPASSTYTAVEAPKGEFGVFLVSNGTNRPYRCKIRAPGFAHLQGLDFMSKHHMLADVVTIIGTQDIVFGEVDR

SEQ ID NO: 13437 - protein, 327 aa, Trichoderma atroviride
MATDTSQKTLSSTTYTLNTGAKIPAVGFGTFANEGAKGETYAAVTKALDVGYRHLDCAWFYLNEDEVGDAIRDFLARRPDVTRKDLFICTKVWNHLHEPEDVKWSAKNSCENLKVDYIDLFLVHWPIAAEKNADRTVKIGPDGKYVINKALTENPEPTWRAMEELVDSGIVKAIGVSNWTIPGLKQLLEFARIKPAVNQIEIHPFLPNTELVEFCFQNDILPEAYSPLGSQNQVPTTGERVRDNPTLNAVADRRGSSLAQVLLAWGLKRGYVVLPKSSTPSRIESNFIIPELSEEDFAAIQKVAEGRHVRFVNMKDTFGYDVWPEDK

SEQ ID NO: 13438 - protein, 140 aa, Parvularcula bermudensis HTCC2503
MALERTFSIIKPDATRRNLTGQIIAKLEDGGLRVVAQKRIRLSEDQAKSFYAVHKERPFYSDLVSFMTSGPVVVQVLEGENAISRNREIMGATNPSEAAPGTIRAEFAENIEANSVHGSDGPDTAAEEIKFFFTDDEIVG

SEQ ID NO: 13439 - protein, 178 aa, Glycine max
  misc_feature (178)..(178): Xaa can be any naturally occurring amino acid
  unsure (1)..(178): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGX

SEQ ID NO: 13440 - protein, 582 aa, Candida albicans SC5314
MTTNESIDITELRTHLYHSACKLNNLSLYQASKWCAEALNGLKDKQQPVTYPPLALDSDDLLDQDILILAKSYFDCKEFDRAAHVLKDCKGGDAKFLRLYSMLISVDKRSTEETDGSLNIGMINETNEDTGTTSKESALNSLNSQLSKIILESENYLKQKQNAFLLYLNGIIYNKKKKYQLARQSLHDSLQIFPYNWSCWQELIASFSSFEEAHNYINKCKNTNNPLANNVMFQFFEVVILQEFYHQSNTLFDNLSNLAALFPGFVFLKIQQFLISYHNLDYFQAEATFDQILVEDPLRLDDLDTFSNMLYVMEKRSKLSYLAQYASQIDKFRPETCCILANYYSMKCEHEKAIMYYKRALTLNKNCLSAWTLMGHEFVELKNSHAAIESYRRAVDTNPKDFRAWYGLGQAYEVLDMHLYALYYYQRATNLQPLDKRMWQAIGNCYEKIDQLEEAFKSFAKALSIGKVMHGDSAFDNKDFDECDFSVEPHICYRLATISEKLGNHKDTYKYMRLCFAQEFEWGVGDETSKARLWLARDALNNWKFEEAYELAKDLNYSNAHDIEEARAIARDARNRMKNQMH

SEQ ID NO: 13441 - protein, 497 aa, Arabidopsis thaliana
MLKKLGLHRKPRVEKDPGIPNDWPFKEQELKALEVRRARALEEIEQKKEARKERAKKRKLGLVDDEDTKTEGETIEDLPKVVNVRDNSERAFYKELVKVIELSDVILEVLDARDPLGTRCTDMERMVMQAGPNKHLVLLLNKIDLVPREAAEKWLMYLREEFPAVAFKCSTQEQRSNLGWKSSKASKPSNMLQTSDCLGADTLIKLLKNYSRSHELKKSITVGIIGLPNVGKSSLINSLKRAHVVNVGATPGLTRSLQEVHLDKNVKLLDCPGVVMLKSSGNDASIALRNCKRIEKLDDPVSPVKEILKLCPKDMLVTLYKIPSFEAVDDFLYKVATVRGKLKKGGLVDIDAAARIVLHDWNEGKIPYYTMPPKRDQGGHAESKIVTELAKDFNIDEVYSGESSFIGSLKTVNEFNPVIIPSNGPLNFDETMIEDESKTQTEEEAEHESDDDESMGGEEEEEAGKTKEKSEAGRQNVKLYAAESMLNTKKQKAEKKK

SEQ ID NO: 13442 - protein, 341 aa, Kloeckera lindneri
SCVFPSIVGRPRHQGIMVGMGQKDSYVGDEAQSKRGILTLRYPIEHGIVTNWDDMEKIWHHTFYNELRVAPEEHPVLLTEAPMNPKSNKEKMTQILFETFNVPAFYVSIQAVLSLYSSGRTTGIVLDSGDGVSHVVPIYAGFSIPHAIQRIDLAGRDLTDYLMKILTERGYSFTTTAEREIVRDIKEKLSYVALDFDQEMESAAQSSSIEKSYELPDGQVITIGNERFRAPEALFQPSFIGLESAGIDQTTYNSIIKCDVDVRKELYGNIVMSGGTTMFPGIAERMQKEMTALAPSSMKIKIIAPPERKYSVWIGGSILASLTTFQQMWISKQEYDESGPS

SEQ ID NO: 13443 - protein, 341 aa, Hanseniaspora guilliermondii
SCVFPSIVGRPRHQGIMVGMGQKDSYVGDEAQSKRGILTLRYPIEHGIVTNWDDMEKIWHHTFYNELRVAPEEHPVLLTEAPMNPKSNKEKMTQILFETFNVPAFYVSIQAVLSLYSSGRTTGIVLDSGDGVSHVVPIYAGFSIPHAIQRIDLAGRDLTDYLMKILTERGYSFTTTAEREIVRDIKEKLSYVALDFDQEMETAAQSSSIEKSYELPDGQVITIGNERFRAPEALFQPSFIGLESAGIDQTTYNSIIKCDVDVRKELYGNIVMSGGTTMFPGIAERMQKEMSALAPSSMKIKIIAPPERRYSVWIGGSILASLTTFQQMWISKQEYDESGPS

SEQ ID NO: 13444 - protein, 390 aa, Nostoc sp. PCC 7120
MQFAKRLEKIPPYLFAEINRKREALIAKGVDIINIGVGDPDKPTPAHILQAMREAIDDASNHNYPPYEGTQEFREAAVEWMERRFGVMDLNPNTEVVSSIGSKEAIHNTFLAFVEAGDYTLIPDPGYPVYRTSTIFAGGEAFSMPLKAENKFLPDLDLIPEEVARKAKMLWINYPNNPTGALATLEFFEELVALCQQYSILLCHDHAYSEMAYDGYKPPSVLQIPGAKDIAIEFHSLSKSYNMTGWRIGFAVGNAYAIKGLSQVKTNVDSGVFKAIQKAAIAAYATDEVELQAVMSVYQSRRDIIVKGLQSLGWPIEPPKATLYVWVPVPPGYTSTEFTTLLLDKCGIVVPPGVGYGASGEGYFRVALTISDERLHEAIQRMQDAGIRYA

SEQ ID NO: 13445 - protein, 331 aa, Kluyveromyces marxianus
MVRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 13446 - protein, 754 aa, Bacteroides fragilis NCTC 9343
MSHLPTLIADLALILMSASIITLLFKWLKQPLVLGYIVAGLLAGPYVRIFPTVGDMENINTWAEIGVVFLLFALGLEFSFKKLMNVGSAAFITATTEVISMLLIGFMVGHLLGWSTMNSVFLGGMLSMSSTTIIIKAFDDLGLRSQRFTGIVFGTLVVEDLIAILMMVILSTMAVSKEFVGEELLMSVLKVAFFLILWFLVGIFILPFFLKKAKRLMNNETLLIVSLGLCLAMVVLATRTGFSAALGAFIMGSILAETVEAEHIEHIIQPVKDLFGAIFFVSVGMLVNPSVLLQYAWPVVIITLVTLVGKSIFSSLGVLLSGEPLKVSVKSGFSLAQIGEFAFIIAGLGASLKVLDPFVPPIIVAVSVITTFTTPYFIRLANPFSEWLYKVLSPRTREFLDRYASGKKTVNHDSDWKRLLKTIVGRVIIYSVLLTAIWLLSVQTVYPTINGMFDSPGRWLSVVMCLLTLLLMIPFLWALVSDKYNSPDVFLKLWNDDNYNHGRLVALILFRVSVAVFFIAGVVISYFSLNYGIGIVIAVAVLGLILLLRENLTQYSHLENHFLTNLNGREEAARNRYPLKSRFNSEFSDKDIELTSVWVSPYSSYIGKSLEELPFRREFGVNVVGIVRGERRIYIPQSDECIYPQDKLIVVGTDGQLQKFRSELDIRQDFPDEKNVRQEVTLHSFTVDEESPLLNKSIAQSRLGKQYDSLIVAIEREDELISMNQSTVFRLGDLVWIVGDREKIRQLLMRKKHV

SEQ ID NO: 13447 - protein, 476 aa, Agrobacterium tumefaciens str. C58
MNEQSRKITPVLLAGGAGSRLWPVSRDQLPKQFQPLVGNLSTYQQTLKRVGDKSLYSEPLVITNEDFRFFARRQAEEIDLPATVVLEPARRDSAAAMAAAAVLAERREPGCLVLALAADHVVLDVDKFSEAVKLGAKAADQGNIVVFGLVPTEPRTSYGYIKPGDAIDGEKDLSTVDAFVEKPDVTTAISYLEKGYLWNSGNFLFRSDVMIAELKAFAPEILAAVTQAVEQYESDLGFVRLHQASFEASPKNSIDYAVIEKTKRMAVVHGHFRWSDIGSWDAIWEIADKHDNDNALEGDGVFIDSEGCLIHSTQLLTTVVGAKDLVVVATKDAVLVVPKNRVQDVKGLVDTLKGGDHAPQTQTHKRVYRPWGYIEHMYVDQRYRVGHITVDPGHRISFQKHYHRSEHWIVVKGTATVTIGEETRLLTENQSVYIPIGQPHRLANEGQIPLELVEIQTGAYLGEDDVIRIEDDYKRQ

SEQ ID NO: 13448 - protein, 146 aa, Brassica napus
  misc_feature (51)..(51): Xaa can be any naturally occurring amino acid
  misc_feature (56)..(56): Xaa can be any naturally occurring amino acid
  misc_feature (67)..(67): Xaa can be any naturally occurring amino acid
  misc_feature (83)..(83): Xaa can be any naturally occurring amino acid
  misc_feature (104)..(104): Xaa can be any naturally occurring amino acid
  misc_feature (116)..(116): Xaa can be any naturally occurring amino acid
  unsure (1)..(146): unsure at all Xaa locations
MAYSMLSSAAVVTSPAQATMVAPFTGLKSSSAFPVTRKANNDITSIVSNGXGRVSXALQVWPPIGKXKKFETLSYLPDPYRKXMGVREVDYLLRNKWDFLCVEXFELEQRDFVYRXEHGSTPELLTMGRYWTNGESFPLVRMHCSG

SEQ ID NO: 13449 - protein, 450 aa, Lactobacillus sakei subsp. sakei 23K
MKRNLNARQMQMIALGGTIGVGLFMGANTTIKWTGPSVLIAYGIAGLLLYLIMRALGEMLYVDPDTGSFAKFATEYMHPIFGYLTAWSNVFQFVVVGMSEMIAIGGYLEFWWPNLPGWVPGLVAITFLCAANLISVSMFGELEFWFALIKVVTIVLMIVAGLGLIIFGIGNHMHPVGISNLWAHGFFTGGFKGFVFALAIVLASYQGIELIGITAGEAENPQETLVKAIQSTVARILIFYIGAIFVILSIYPWNELNQVGSPFVQTFAKIGITAAASIINFVVITAALSGANSGIYSASRMTFTLANNGQLPKRFLKLNRHGVPFYAVGAISLGILIGVILNAILPLVYPKAGNIFVLVYSSSVLPGMVPWFVILISQIAFRKQHAEKMATHPFKMPWSPYSNYITLAMLCLTLVFMFINPETRISLIVGLIFLVLMIVIYFVKFGRQKE

SEQ ID NO: 13450 - protein, 279 aa, Bacillus cereus E33L
MKNLQSKAVLNNGVEMPWFGLGVFKVEEGPELVEAVKAAIKAGYRSIDTAAIYGNEKAVGEGIRAGIEATGIAREDLFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 13451 - protein, 250 aa, Mycoplasma penetrans HF-2
MKKLIIANWKMFKTLNDIKTFKEEFDKNIKNVKVNADYSVGVPSIYLNQAKEILKGIKVIAQDAHFKNEGAYTGNISWSQLKDCGIDGSIIGHSERRQMFNETDETVNLKTISLVENNMQAVVCVGETLEEYEANKSFDVVWNQTKKALANVSEAQLKNVVIAYEPVWAIGTGKVPTGKEVDDLIQKVRDELSKLYSKQAVESLVVLYGGSVNDKNAEEFFKQKNINGALVGSFCLKAENFVKLIELGGN

SEQ ID NO: 13452 - protein, 367 aa, Triticum aestivum
DPRVPPSACFQTLEGAWQDLCADIRDGVLSERITVPSIRGAVSKILKPNPELADSIHNKCAGLSNWYGVIPALWPKAKYVYGIMTGSMEPYLKKLRHYAGHLPLISADYGASEGWVGSNIDPTVPPEQVTYAVLPQTGYFEFIPLEKPTGEETENSAAIHYIESEPVGLTEVEVGKIYEVVLTTFAGLYRYRLGDVVKIARFHNSTPELQFICRRSLVLSINIDKNTEKDLQLAVEEAAKLLEGEKLELVDFTSYVEKSSDPGRYVIFWELSSEATDDVLSGCANALDLAFLDAGYMGSRKIKTIGPLELRVLRKGTFREILLHFLTLGGAVSQFKTPRFVSPANGKVLQILNRNVAKSYFSTAYGL

SEQ ID NO: 13453 - protein, 506 aa, Mycoplasma penetrans HF-2
METKMKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 13454 - protein, 423 aa, Mycoplasma penetrans HF-2
MKPKERWNLNKKKRNHFFEKKPINHYIKDPVHKEINFADEKWLLEFAYSFEMLRLLEIRQLGIGYKIFPSATHNRYSHCLGAYAVAKKFTKHFMNHISKDDSKLFLLAALLHDIGHGPYSHVFEKISHIHHEELGKRIIQNPKLGILRLLKKNNINANTLASVYTGECKQEWIGRLISSNLDVDRIDYLLRDSYSVGTKFSTIDIDFLVERSIIMDNDVFFQKSAINYIESFLLGRHYMYEDIYDNKNTYIFEWTLMKIFDRLKEIKQLFFEKKDKIYFYDFYEWIVFESNVNVHKTYIYLNDGNLNSFIWSLKCLDDHILNSFINSFLNNSVNVDAKNYSQQSEKDLKELSKKKNIDPKYLYSIQEKKKKDIFLLEDKNAINIYDRDRNLSYKFPSERITTFNEVTRRENNKIILINKTLIY

SEQ ID NO: 13455 - protein, 294 aa, Staphylococcus aureus subsp. aureus Mu50
MVIQWYPGHMAKAKREVSEQLKKVDVVFELVDARIPYSSRNPMIDEVINQKPRVVILNKKDMSNLNEMSKWEQFFIDKGYYPVSVDAKHGKNLKKVEAAAIKATAEKFEREKAKGLKPRAIRAMIVGIPNVGKSTLINKLAKRSIAQTGNKPGVTKQQQWIKVSNALQLLDTPGILWPKFEDEEVGKKLSLTGAIKDSIVHLDEVAIYGLNFLIQNDLARLKSHYNIEVPEDAEIIAWFDAIGKKRGLIRRGNEIDYEAVIELIIYDIRNAKIGNYCFDIFKDMTEELANDANN

SEQ ID NO: 13456 - protein, 502 aa, Pyrococcus horikoshii OT3
MYRQARWDEPLIFELSRPGRVGYTLPKPIEDVKVEIPEKLKRKTPLELPEVSEPEVVKHYTRLSEMNYGVDSGIYPLGSCTMKYNPKINEEIANHPKVAFIHPYQDERTVQGALKIMWELEQWLKEITGMDRFTLQPAAGANGEFTGVMIIKAYHLDRGDTQRTEILVPDSAHGTNPASASMAGFKVVEIPSNENGTVDLEALENAVSERTAGLMLTNPNTLGIFEDEIEEIAKIVHKVGGLLYYDGANLNGILGKVRPGDMGFDIVHLNLHKTFSTPHGGGGPGAGPVGVKEFLKDYLPVPLVSYDEENDRYYLDYNVPKSIGKVKELFGNFAVLVKALTYLKIMGKEGLREVSEVAVLNANYLARKLKGTRGYELPHKELRKHEVVFSAEPMKKETGVRTLDVAKRLLDFGLHAPTIYFPLIVHEALMIEPTESVSKEELDAYVEALKKISEEAYTNPEIVKSAPHNTAVRRVDDVLAAKKPVITWKMYKELKEKGEIDY

SEQ ID NO: 13457 - protein, 626 aa, Silicibacter pomeroyi DSS-3
MESFLYQATIYLAAAVIAVPLAARLGLGSVLGYLAAGLIIGPVLGLVGAETADLQHVAEFGVVMMLFLIGLELEPRALWDMRDKLLGLGGLQVGVSTLAIMVVAMVAGQPWSVALAVGLTLSLSSTAIVLQTLSEKGLMQTNGGRATFSVLLTQDIAVIPILAFLPLLASAPVAHFAGDGSINRVHKAGAGHEASLSLVEGLPGWAVTLVTIAAVAFVVLAGIYLTRPLFRFIHASRLREMYTALALMIVVGISFLMTLVGLSPALGAFLAGVVLANSEFRHEMESDLEPFKGLLLGLFFITVGAGIDVGFFLADPLDLIGLALLVILFKGVILYIVGRAFQLKGRDRWLFTLGLAQAGEFGFVLLAFSTQQNVIPAHLSQKLLMIIALTMMITPLLFILYELLSRRMRDHVADMVPDTIDEQGPVIIAGIGRFGQIVNRLVTASGFKTIVLDHDMETIQLMRRFGVKGFLGDPTRPELLKAAGLAKAQVLVAALDDDNQVTKLVAYARRQRPDLHIIARARDRNHVYELYRAGANDIVREMFDSSVRAGRYVLENVGLSEYEAAQAAQTFYHHDRQAVRDLAEVWDPNIPTADNKAYVERSQALQKDLETALMELSEELASRRSA

SEQ ID NO: 13458 - protein, 449 aa, Pyrococcus horikoshii OT3
MGNHYIPNSAHKEEMLKEIGLSSIEELFADIPEKFIKEELNLPEGKSEYEVFLEMNEILEKNKTVLEMPTFLGAGTYFHYIPAHVKHLIERSEFLTSYTPYQPEISQGMLQALFEYQSLIAELVGLPVVNSSMYDWGTAMAEAALMTVRLHKGKRKKFVVPKHTHPERLQVLRTYTRGPEVEIVTVNWNERGQVDVEDLKEKVKDAAGVYIEIPNFFGLLEEEIREVGEIAHEAGAYFVVGVDPTILGIVEAPGELGADIVVGEASYFGNPMNFGGPRAGIFAVKNDMKLIRQMPGRIIGMTKDAEGKRAFVMTLQTREQHIRRAKATSNICSNEALVAVAAAIHIASLGPKGIRELGEVILKNTAYLKKRLSEVAEIPFDGVNFKDVLVRFDKPYREIHEELLKRNIHGGYYVGSHFPELGEAALFAATETTRKEWVDALISALKEVI

SEQ ID NO: 13459 - protein, 278 aa, Staphylococcus epidermidis RP62A
METVQFYNGRTMPKIGLGTYRVKDGDECRESVKYAIEQGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNELRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFNGK

SEQ ID NO: 13460 - protein, 327 aa, Oceanicola granulosus HTCC2516
MKTYKIVGIGNAIVDVICQTGDESLDLLGIEKGVMQLIERERAEMLYGAMKDRVQAPGGSVANTLAGLGALGLKTGFIGRVRDDALGRFYAESMEEQGSRFVNTPVAGGDLPTSRSMIFVSPDGERSMNTYLGISAEIGPDDVSDDVAGEAEILFLEGYLYDKPKGKDAFDRAARVCREAGGMAGITLSDPFCCDRHRADFQRLVGELDYVIGNQEEWQALYETDLDSALKRAARECRLVVCTRSGEDVVLIRGEERVVVPVTRVTPVDATGAGDQFAAGFLYGLSTGQPLEVCGRMGVVAAAEVIAHIGPRPASNVLNLFRAAELV

SEQ ID NO: 13461 - protein, 189 aa, Triticum aestivum
  misc_feature (123)..(123): Xaa can be any naturally occurring amino acid
  unsure (1)..(189): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTLELAGTNGETTTQGXDDLGKRCAKYYEAGARFPKWGAVLKIGATEPSQLSIDKKAQGLARYAITCQENGLGALCGSRKFLV

SEQ ID NO: 13462 - protein, 276 aa, Bacillus clausii KSM-K16
MNVGFIGTGSMGSLLIESFIDAGALKQTNISIINRSPEKAAALKATYPGITVSTSLEEIASTCEWLFLCVKPKEMPALFHALQPHVAADQIAISITSPISVESLDAALPCKTCRIIPSILNRALSGSTLVTFGNKCTQEDQANLLRFVSAVSEPLQIEEEITRVASDIVSCGPAFFSFLAQRFIDGAVSETSISQEEATELTTSMIIGLGKLLESGHYTLPALQKRVCVPGGITGEGLAVLDDELGDGFGSLFKRTHEKYATEKEKLLAEVLYEPK

SEQ ID NO: 13463 - protein, 314 aa, Fragaria x ananassa
MAVASTSLASQLSGPKSLSQPYSGLRRSCPKLDQSHSSLFQHLSLSSSSRKASRAVVAMAGTGKFFVGGNWKCNGTKDLISKLVSDLNSAKLEPDVDVVVAPPFLYLDQVKSSLTDRIEISGQNSWVAKGGAFTGEISVEQLKDIGRKWVILGHSERRHVIGEDDQFIGKKAAYALNEGLGVIACIGEKLEEREAGKTFDVCYEQLKAFADAVPSWENIVVAYEPVWAIGTGKVASPQQAQEVHVAVREWLKKNVSAEVASKTRIIYGGSVNGGNSAELAKEEDIDGFLVGGASLKGPEFATIVNAVTSKKVAA

SEQ ID NO: 13464 - protein, 341 aa, Hanseniaspora uvarum
SCVFPSIVGRPRHQGIMVGMGQKDSYVGDEAQSKRGILTLRYPIEHGIVTNWDDMEKIWHHTFYNELRVAPEEHPVLLTEAPMNPKSNKEKMTQILFETFNVPAFYVSIQAVLSLYSSGRTTGIVLDSGDGVSHVVPIYAGFSIPHAIQRVDLAGRDLTDYLMKILTERGYSFTTTAEREIVRDIKEKLSYVALDFDQEMETAAQSSSIEKSYELPDGQVITIGNERFRAPEALFQPSFIGLESAGIDQTTYNSIIKCDIDVRKELYGNIVMSGGTTMFPGIAERMQKEMSALAPSSMKIKIIAPPERKYSVWIGGSILASLTTFQQMWISKQEYDESGPS

SEQ ID NO: 13465 - protein, 324 aa, Psychrobacter arcticus 273-4
MLPLDSLSDCASKSYLLTHLPDLNHRHLSSSVSTNSELIAAVQDGTLNATAMHLLTAETQSAGRGQHGRSWQSPRGNVYLSLYHPVHIPISGLLSLIIGVELAKMPIIQTLNDQLCAQGLTPIGVKWANDLGFYSYQYHHQSELHKILLANEMTPFHKLAGILIEPVTQAGKLVGIVMGVGLNVQATPKLTAQTCEGMSYQAISLQDIKQLLEPDKSASALLSLRELYQQMSKALMAAMTRFEHLGLEKPTGQTYNLDSFLKQFDSMDALAGLRLRITQEHNGQTETLTGYACGIDTHGCLQLRQDNGNISALFTGRIDVIDNA

SEQ ID NO: 13466 - protein, 398 aa, Brassica napus
MASTSLLKASPVLDKSEWVKGQSVLFRQPSSAAVVLRNRATSLTVRAASSYADELVKTAKTIASPGRGILAMDESNATCGKRLDSIGLENTEANRQAYRTLLVSAPGLGQYISGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHDIDRTYEVAEKVWAEVFFYLAQNNVMFEGILLKPSMVTPGAESKDRATPEQVAAYTLKLLRNRIPPAVPGIMFLSGGQSELEATLNLNAMNQAPNPWHVSFSYARALQNTCLKTWGGRAENVNAAQTTLLARAKANSLAQLGKYTGEGESEEAKEGMFVKGYTY

SEQ ID NO: 13467 - protein, 140 aa, Nostoc sp. PCC 7120
MAQTQETTTKTHTLPLPTTITSRGVAATELRPWGSFTVLEEGRGYKIKRIEVKPGHRLSLQMHHHRSEHWIVVSGTARVVCGEKEILLGNNQSTYVPQCTAHRLENPGVIPLVLIEVQNGEYLGEDDIIRYQDDYSRTSN

SEQ ID NO: 13468 - protein, 341 aa, Glycine max
MVSEGTLLGMGNPLLDISAVVDEDFLKKYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAGDAFVGGFLSQLVQEKPIEECVRAGCYAANVIIQRSGCTYPEKPDFH

SEQ ID NO: 13469 - protein, 502 aa, Arabidopsis thaliana
MSEKFPDVFTWIQNIPQITKWRTTSLPFCICPSTSDFPNSTLNLTAQKSPSPKVVTFSIIVQSNNHSPLYLWTTKQELSINPNSPNPFDELTIISLLFNFVETILTYTSNSSNYSTIKIPNSDSSKIGGLKDIVNTVILTLSFVVCVYEAPLYLRENCLNTLKNHLITCHTRRATISLMKLLGSNLEEQWMRTVNLAFTNWIIEQRRSQSTKITTTPLFSYAVSAYGLWKVQLYCPVEAMEVERSSNPTADSRLLFSLKFNQLEGVMQFNHKVVVRDNWIDVIVKIDNIRYDVIKLVNEKLMSRRGAGEHEKHFPSRISLQLTPTLQTDFISVSVSKSSNNPGREFEVERSIEGSFDPPNSLGLRVAGREASTMTMTPWKLEQSVLGYTANLNWILYDSSVGGREVFSTKPSRFSIMSPRSWFKDRYARAYRSFTRRGGVIFAGDEYGESVVWKIGKGALGGTMEWEIKGFIWLTYWPNKYKTFYHETRRLEFTQLLNLTIA

SEQ ID NO: 13470 - protein, 252 aa, Caulobacter crescentus CB15
MPIVCLTAYTAPVAAALDDACDVLLVGDSVGMVVHGLPNTVGVTMEMMILHGQAVMRGSKKAMVVVDMPFGSYEASHEEAYANAVRIMKETGAQAVKVESGPTVPETIAYLTRRGVPVMGHVGLRPQAVLLEGGFKAKGKDDAGRAKVLEEARLTAEAGAFAIVVEGVAESLAREVTESVSVPTIGIGASAGCDGQVLVVDDMLGLFDWTPKFVRRYADLKGEIERAAAQYASDVRDRSFPGPAETYYAKKP

SEQ ID NO: 13471 - protein, 469 aa, Xylella fastidiosa Ann-1
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMHSYVRDPRGIAKRAEIYLNSLGIADQAFFGPEPEFFIFDSVRFANDMGHSFFQIASEEAAWNTGAEFERCNSGYRPAVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFINGYIALKMQEVTQFRAATHPLEYQMYYAN

SEQ ID NO: 13472 - protein, 338 aa, Candida glabrata CBS 138
MSPSLICLCNPLLDIQATVNDDYLKKYNLNANDAVLLETGSTDPRFAIYEELPTFPDVKYVAGGAGQNTARGSAYVLGKGQVGYFGSVGEDKYSKKLLEENEAAGVISLYQVQKDISTGKCAALITGHNRSLVTDLGAANHFKPEHLDKHWDQVTGAKMFYIGGFHLTVSPDAIVKIGQHAKETGKPVVLNLSAPFIPQFFKDALVKVLPYVTIVVANESEAASYAEAFGLTCDKTDLVAIAKEIIGDSSEKKVVFTHGLEPTVLVTKDSDKSFPVKPLDSSKIVDTNGAGDAFAGGFMAGLVQGKSLEQSIDMGQWLAALSIQEVGPSYPKEKIEYA

SEQ ID NO: 13473 - protein, 275 aa, Arabidopsis thaliana
  misc_feature (61)..(61): Xaa can be any naturally occurring amino acid
  misc_feature (74)..(74): Xaa can be any naturally occurring amino acid
  misc_feature (92)..(92): Xaa can be any naturally occurring amino acid
  misc_feature (144)..(144): Xaa can be any naturally occurring amino acid
  misc_feature (217)..(217): Xaa can be any naturally occurring amino acid
  misc_feature (249)..(249): Xaa can be any naturally occurring amino acid
  misc_feature (254)..(254): Xaa can be any naturally occurring amino acid
  unsure (1)..(275): unsure at all Xaa locations
LYYNLLLFYKYFLYIKLHFSFINLPNSKSSLTSSITFSNSIYSPPFQQFTIYLHIFILHSXYKYYKTLYINFFXSFYSFNSLLYPISFFILXTLKKQKHIIQSYYFSLIISSNSLLHYLFPYLYSIKSFSYSHSKSSFNFFYNXLLYYKAQLEDDPIVHRHLSSLYDTLLEQNLCRLIEPFSRVEIAHIAERRGGPRDQGEKKRAPSRRDKKGAGTXDQGAGCLIIFKDPKADAIYSATLETIANMGKXVDSLXPVCQNQVTERVSEMVENLNLS

SEQ ID NO: 13474 - protein, 336 aa, Emericella nidulans
MAPKVGINGFGRIGRIVFRNAIEAGTVDVVAVNDPFIETHYAAYMLKYDSQHGQFKGTIETYDEGLIVNGKKIRFHTERDPANIPWGQDGAEYIVESTGVFTTQEKASAHLKGGAKKVVISAPSADAPMFVMGVNNETYKKDIQVLSNASCTTNCLAPLAKVINDNFGIIEGLMTTVHSYTATQKVVDGPSAKDWRGGRTAATNIIPSSTGAAKAVGKVIPSLNGKLTGMAMRVPTSNVSVVDLTVRTEKAVTYDQIKDAVKKASENELKGILGYTEDDIVSTDLNGDTRSSIFDAKAGIALNSNFIKLVSWYDNEWGYSRRVVDLITYISKVDAQ

SEQ ID NO: 13475 - protein, 272 aa, Cytophaga hutchinsonii ATCC 33406
MSTAKSDIKKVTTHQLQEMKNRGEKISMLTAYDYSMAKILDAAGVDVILVGDSASNVMAGHETTLPITLDQMIYHASSVIRAINRALVVVDLPFGSYQGNSSEALRSAIRIMKESGAHAVKMEGGIEIKESVLCIISAGIPVMGHLGLMPQSIYKFGTYVVRAREEEEANKLIADAKILEESGCFGLVLEKIPASLSKTVTHQLQIPTIGIGAGPDVDGQVLVTHDLLGINNEFHPRFLRTYANLQATISTAVTSYIDDVKSKNFPNENECY

SEQ ID NO: 13476 - protein, 183 aa, Zea mays
  misc_feature (28)..(28): Xaa can be any naturally occurring amino acid
  misc_feature (88)..(88): Xaa can be any naturally occurring amino acid
  misc_feature (104)..(104): Xaa can be any naturally occurring amino acid
  misc_feature (117)..(117): Xaa can be any naturally occurring amino acid
  misc_feature (156)..(156): Xaa can be any naturally occurring amino acid
  unsure (1)..(183): unsure at all Xaa locations
KRPTTRRLASSMFFSADAITSPAQATMXTPFTGLKSSAAFPDTPKRNNYITSIASNAGRVSCMKERPPVVKKNDNTLSLSFLIVTVSXIAVIECKYLLHNKRIXCVEFELEHGFVYXREHVNTPGYYDVRYWTMSNLPLIGCTDSAQVLNEVQECXIYDPNAFMTIILFYNNRQVQCISFIAY

SEQ ID NO: 13477 - protein, 448 aa, Streptococcus agalactiae 2603V/R
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMKHAYNYTAIINPTVNSYKRLVPGYEAPVYVAWAGRNRSPLIRVPASRGMGTRLELRSVDPTANPYLALSVLLGSGLEGIENKIEAPEPIETNIYAMTVEERRQAGIVDLPSTLHNALEALEEDEVVKAALGTHIYTNFLDAKRIEWASYATYVSQWEIDNYLDLY

SEQ ID NO: 13478 - protein, 390 aa, Oryza sativa
MGKGGKGAEAAASAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQASKQFSSISISLQEEDAILINIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 13479 - protein, 176 aa, Triticum aestivum
MAPTVMSSAATAVAPFQGLKSTAGLPVSRRSSSAAGLGSVSNGGRIRCMQVWPIEGIKKFETLSYLPPLSTEALLKQVDYLIRSKWVPCLEFSKVGFIFREHNASPRYYDGRYWTMWKLPMFGCTDATQVINEVEEVKKEYPDAYVRIIGFDNMRQVQCVSFIAFKPPGCEESGKA

SEQ ID NO: 13480 - protein, 420 aa, Picrophilus torridus DSM 9790
MKGDDLFSEALKLFPSGVNSPVRFYRPVPVMFERGRGSRIYDVNGKEYIDYSLGFGPMILGHADPDVASAIKRQADNGILFGSITENEVRLGNIIKNHVKSIEKMRFTNSGTEATMHAIRLARGYTKRKYILKMEGGFHGAHDYALIKSGSGTMTFGVPSSNGVPEEITKTVLVGKYNDENSIESLFNEYGNDIAAVITEPILGNIGVINPEPGFLEFLREITNKYNSLLIFDEVITGFRFAFSGYQDIINIKPDITTMGKIIGGGAPIGLFGSSSEIMDLISPSGNVYESGTFSGNPLSMAAGIAAMEKLQGMDYSRINNYTADLVKSLYDIFNDKNIDVNINHYGSMFQIFFNKNEVKTYDDAIKSDKDRFFKFFKKMLDHNVYLPPSQFETNFVSFAHGRDDLNKTIEAAKEAVSCI

SEQ ID NO: 13481 - protein, 149 aa, Zea mays
  misc_feature (69)..(69): Xaa can be any naturally occurring amino acid
  unsure (1)..(149): unsure at all Xaa locations
ASFPVSRKQSLDITSIASNGGRVSCMQVWPPINMKKYETLSYLPDLSDEQLLSEIEYLLKNGWVPCLEXFETEHGFVYRENHKSPGYYDGRYWTMWKLPMFGCTDATQVLAEGQEAKKAYPQAWVRIIGFDNVRQVQRIRFIGYKPEGY

SEQ ID NO: 13482 - protein, 250 aa, Zea mays
MAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDTKGEIAAVFP

SEQ ID NO: 13483 - protein, 160 aa, Triticum aestivum
  misc_feature (151)..(151): Xaa can be any naturally occurring amino acid
  unsure (1)..(160): unsure at all Xaa locations
MEASSCLLYQVRGFGSFRIWLCLLLLLVLQNCSPVLSDSPYLVGMGSYDITGPAADVNMMGYANTEQIASGIHFRLKSRAFIVAEPNGKRVVFVNLDACMASQLVNIKVLERLKARYGDLYNENYVAISGIHTHAGPGGYLQYVVYIVTSXLGFVRQSFD

SEQ ID NO: 13484 - protein, 78 aa, Zea mays
  misc_feature (49)..(49): Xaa can be any naturally occurring amino acid
  unsure (1)..(78): unsure at all Xaa locations
VVPRCLVLSPTRKLAQQPQGDHIELHQKRHGKHLDHEVRKHEAREVHRXSKDTHNLIGTKGKRFVKKRYAEKAQMKKT

SEQ ID NO: 13485 - protein, 399 aa, Bacillus cereus E33L
MDTLIFEVGTALVLVAIAAVIAGKFKFSVIPFLIVLGMLVGPHAPTIGVIDFKFIESANVISFLGRIGVLFLLFYLGLEFSMKKLIKSGRSIAIGGTIYILINFSLGLLYGFIIGFPLLEILIIAGIITISSSAIVAKVLVDLRRTGNNETELILGIIMFEDIFLAVYLSVVSGLVLGDHASFLGALTSIGIALGYMLLFFIVARKATTLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 13486 - protein, 406 aa, Cytophaga hutchinsonii
MAETHLNYTYNPLHMESSEPLVLDVGNLKRGEIIINMGPQHPSTHGVLRLEILTDGEIVKDVIPHMGYLHRCYEKHAEKLPYNQVIPFVDRMDYLAAMNSEHAYAMGVERMLGIENDIPKRVEYIRVLVAELNRISSHFVAIGTYGLDIGAFTPFLWVMRDREHINRLLEWVSGARMLYNYIWVGGLFYDLPVGFEERCKDFISYLKPKLAELQKVIIDNKIFIERTANIGVLPLDLAINYGITGPMLRASGLKFDLRKVDAYSVYPEIDFDIPVGTGAVGTTGDCWDRTHVRVAECFESVKIIEQCLEKLLGEHKRTREFDPQAIVPKKIRPKVMDFYVRAENPKGELGFFFRTTGNTDIPFRCKVRAPSFVNLSVLQAISKNVMIADLVAILGSFDIVMGEIDR

SEQ ID NO: 13487 - protein, 262 aa, Legionella pneumophila str. Paris
MKIHDFKMKKQEQKKISMLTCYDYPSACIVAESNIDCVLVGDSVAMAVHGHPTTIMATIEMMELHTQAVARGLGKQFLITDLPFLGHKSSQGHTVENVKRLLQAGAQAVKIEGADKDTCQTISHLVNAGIPVMGHIGLTPQSIHQLGGYKVQGKNSEQAETLLQQAATLEQAGCFAVVIECVPQDLAKTITDSLVIPTIGIGAGPGTDGQVLVWHDMLGLQTSFNPKFVKKYFRAKDHFIEALNSYVQQVQQMHFPANEHSF

SEQ ID NO: 13488 - protein, 337 aa, Nitrosomonas europaea ATCC 19718
MRQLTFAILRMMSDGNYHSGTTLGQALKVSRSSISNTLRDLESYGLTIHKIPGRGYRWLNPVQWLDSEQIHQHLAEYADSIQIEIVEAVESTNSLLLQRAVEQGISANRIKQVLVTELQTQGRGRRGRSWSSGLGDSLTFSVLWPSQCPVNTLSGLSLAVGVAIVRALTLLGIRDIALKWPNDVLSGSHAKLAGVLIELHGDMLSLGTVVIGVGLNLRLSGVTKARIDQKVTDITSITGQMPDRNQLLAVLLKELARVLDTFERHGFEPFIEEWTRYHAYQDKMVQVSFAEGSVRNGVAISVAADGALLVDTSTGVVQLRSGEISLRSLAEHSSPFN

SEQ ID NO: 13489 - protein, 486 aa, Synechococcus sp. CC9605
MAATPLIPVILCGGTGTRLWPLSRASYPKQYWPLSGDGEATLLQQTQQRLTGLEALAAPLLICNEDHRFIVAEQMRQIGVEPNAILLEPMGRNTAPAVTVAALQATANGEDPLLLVLAADHLIRDGAQFRQAINAGRKPAEVGRLVTFGIVPTAPETGYGYIEASEPFSLGEPAHVPIKRFVEKPDQATAEQFLATGRFTWNSGMFLFRASAMLAELERLAPEVVSCCRAALEQDTADLEFHRLEREAFAKCPNVAIDVAVMEKTELGSVLPLDAGWSDVGSWSALWDTSEQKDSQGNVLQGHVIAEDSHDCYLRSEHRLVVGLGVENLVVVETDDAVLIADRSKAQEIKTVVKQLEAEGSPEGKAHRKIYRPWGHYTGVVEDSRWQVKRISVKPGASLSLQMHHHRAEHWVVVKGTALVERDGEEQLVGENQSTYIPMGCKHRLSNPGRIPVELIEIQSGTYLGEDDIVRFQDRYGRSDMSISAS

SEQ ID NO: 13490 - protein, 291 aa, Triticum aestivum
  misc_feature (162)..(162): Xaa can be any naturally occurring amino acid
  unsure (1)..(291): unsure at all Xaa locations
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNITGFGLNFLLTLFAFHGETRVVSLGWICVGFSVCVFVAPLSIIGRVIKTKXSVEYMPFTLSLTLTLSAIVWFLYGLLIKDKYVALPNILGFTFGVIQMVLYVFYMNKTPVASEVKEGKEAWKAPAEDHVVVINVGKTDKGSCAEVRPVTEMASAVDVPRRCAAEAAAAPGVDFARSVDVV

SEQ ID NO: 13491 - protein, 559 aa, Prunus dulcis
  misc_feature (46)..(46): Xaa can be any naturally occurring amino acid
  unsure (1)..(559): unsure at all Xaa locations
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 13492 - protein, 571 aa, Gibberella zeae PH-1
MGSTGQTLRAWWKESSVYQIYPASYQDSTGSGVGDLKGIISRVDYLKDLGVDIIWLSPIFKSPQVDMGYDISDYYTVDPPYGNVSDVDVLKDKLHERGMKLVLDLVMNHTSDQHEWFKESRKSKDNPYRDWYIWKPAKYDADGNRHPPNNWDAHFQGSAWEYDEITDEYYLCLFCKQQPDLNWENPAVRKQVHQVMRFWLDRGVDGFRMDVINFVSKDQAFPDSDKTVLRGTEYYACGPRCHEFLKEIGSILQEYDAFSVGEMPCVHDERELIKAVHGDRGELSMIFHFELMDLDHGVEGKFTPRSWKLSELKATTLKWQRFMYDNEGWNALYLENHDQPRAVSRFVHDDPEHRVASAKLIALFLGFQSGTPFIYQGQEIGMTNVPKDWDLEEYKDLDCLKHWDLHKNDDVAAQNSYKVEYQRKSRDNARTPMQWDASPNAGFTTADANPWMRVNDNYTDINAASQTSDSNSVYSCYRQVLGKRKEYKDIFVYGNFQLVDESNDKIFAYSRRADSGETALVVCNFSVDSVAWKLPGEAREVLTSPAGRTLNDLNSGEIKLAPCEAFAVLLK

SEQ ID NO: 13493 - protein, 485 aa, Pseudomonas fluorescens Pf-5
MSTLIPCIIAGGAGTRLWPVSREAMPKPFMRLPDGESLLQKTFVRATALKDVGRLLTVTNREVFFRTLDDYRLLNKARVELDFILEPFGRNTAPAIAAAALHVSRLYGDDAQLLVLPADHLIKDVQAFANAVDSARQLAEQGWLVTFGLVPTHAETGFGYIEKGQGLNKDSFQVSRFVEKPDAATAQRYVDGGLHLWNGGMFCMRADVILQELREFVPEVVSAVEHCLEQSHRKEGKHELQVELDGDSFAQAPDISIDYAVMERSKKVAVVPCQLGWSDIGSWQAVRELTPADEHGNQCNGETVLHDVSNCYIDSRKRLVGGVGLNNLIIIDTPDALLVADGNRSQDVKLIAQELKRLGHDAYKLHRTVTRPWGTYTVLEEGPRFKIKRIMVKPNASLSLQMHHHRSEHWIVVSGMALVTNGEDEFLLNTNESTFIKPGRTHRLVNPGVIDLVMIEVQSGEYLGEDDIVRFNDIYGRAPAEAAKT

SEQ ID NO: 13494 - protein, 341 aa, Hanseniaspora meyeri
SCVFPSIVGRPRHQGIMVGMGQKDSYVGDEAQSKRGILTLRYPIEHGIVTNWDDMEKIWHRTFYNELRVAPEEHPVLLTEAPMNPKSNKEKMTQILFETFNVPAFYVSIQAVLSLYSSGRTTGIVLDSGDGVSHVVPIYAGFSIPHAIQRIDLAGRDLTDYLMKILTERGYSFTTTAEREIVRDIKEKLSYVALDFDQEMETAAQSSSIEKSYELPDGQVITIGNERFRAPEALFQPSFIGLESAGIDQTTYNSIIKCDVDVRKELYGNIVMSGGTTMFPGIAERMQKEMSALAPSSMKIKIIAPPERKYSVWIGGSILASLTTFQQMWISKQEYDESGPS

SEQ ID NO: 13495 - protein, 235 aa, Parvularcula bermudensis HTCC2503
MPRICLVRHGQSRWNLENRFTGWVDVDLTEKGEAEARRAGELMKAETFKPVRAFTSVQTRAIRTLNIALHALDRLWVPVTKDYRLNERHYGGLTGLDKAETAVKHGEDQVKIWRRSYDTPPPPLDDPSPFPSLTDERYAGIEVPKTESLKLTLDRVAPYWQSTIVPAISEGDLLIAAHGNSLRALVKLLFAVGDDEITSVEIPTGNPLLVELNNQMRASSAKYLDDSRAQALPKI

SEQ ID NO: 13496 - protein, 336 aa, Idiomarina loihiensis L2TR
MKTIDVVGIGNALVDQEFEVSEDFLKKHDLKKGMMELIDEYAQNTLIAELSQLGELKKQSGGGSAANSLVAFAQFGGKAYYCCKVADDEAGMFYRQDLEKIGIETSLHQQKNPGTTGRCLVMVTPDAERTMRTHLGITADLSSAEIDDHAIAAADYLYIEGYLITSEIARGAIQHAKKVARENNTKLVMTCSDPAMVKFFRSGIDEILDGGVDLMFCNREEAELLTGKDDPQAALSVLLKQADTVAITLGKDGAVIANRERQVHIPGVPVKAIDTNGAGDMFAGAMLYGLTRNMSLEDAGRLASHAAAELVTEFGPRLNKDRQQQLIERVMSAQTA

SEQ ID NO: 13497 - protein, 341 aa, Hanseniaspora opuntiae
SCVFPSIVGRPRHQGIMVGMGQKDSYVGDEAQSKRGILTLRYPIEHGIATNWDDMEKIWHHTFYNELRVAPEEHPVLLTEAPMNPKSNKEKMTQILFETFNVPAFYVSIQAVLSLYSSGRTTGIVLDSGDGVSHVIPTYAGFSIPHAIQRIDLAGRDLTDYLMKILTERGYSFTTTAEREIVRDIKEKLSYVALDFDQEMETAAQSSSIEKSYELPDGQVITIGNERFRAPEALFQPSFIGLESAGIDQTTYNSIIKCDVDVRKELYGNIVMSGGTTMFPGIAERMQKEMSALAPSSMKIKIIAPPERKYSVWIGGSILASLTTFQQMWISKQEYDESGPS

SEQ ID NO: 13498 - protein, 377 aa, Trifolium pratense
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTESLMKILTERGYMFTTSAEREIVRDIKEKLAYVAVDYEQELETAKSSSSIEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 13499 - protein, 632 aa, Oryza sativa
  misc_feature (204)..(204): Xaa can be any naturally occurring amino acid
  unsure (1)..(632): unsure at all Xaa locations
MADQKVILAEPLLPGKEADFADDDDVEAQLTSYHTGASFSRTCLNLTNAVSGIGVLSMPYAVSQGGWLSLLLFVLVGAVCYYTGTLIERCMRADGSIASYPDIGQYAFGATGRRAVAFFMYVELYLVAISFLVLEGDNLDKLFPGATMEILGYQLHGKQLFIVLAAAVILPTTWLKNLGMLAYVSAAGLIASVALTASLIWAGXVAETGFHRNSNTLNLAGIPTSLGLYFVCFTGHAVFPTIYSSMKNSKHFSKVLLISSVLCSLNYGLTAVLGYMIYGDDVQSQVTLNLPSGKLYTKIAIVMTLVNPLAKYALLVAPITAAVEERLSLTRGSAPARVAISTAILASTVVVASTVPFFGYLMSFIGSFLSVMATVLFPCLCYLKIYKADGIHRTEMVAIAGILLLGVFVAVTGTKRGSHKRSGVTGFSSVETTSTAAVAMAGSQTQSQRLPTPTRQVAGERGWSRWRGGGQWESAVAAAQAAGERQQAAVRGRSRWKGGVGGCRRRKAAVWSRGLEEKETRAPGPRRVGSWSRNAATSSGLKRNLRWCTSSSPGRSLSLASSDAGSYSGWSYAGRGGWRASRGSLAHTGQTLCAFRELTDGLQELRDPRRVDEVVADLGAEHEAATPQSRHL

SEQ ID NO: 13500 - protein, 269 aa, Nitrosomonas europaea ATCC 19718
MDQSAAKRMTITTLQNACEQGEKIAVLTCYDATFAAVLEEAGVDILLVGDSLGNVVQGKSSTLPVTLDEMIYHVRCVERGTHRVFIMADMPFGTFQVSPQEAFGNAVRLMAAGAQMVKIEGGQHMAETVEFLSCRGIPVCAHIGLMPQFVHQLGGYRVQGKTPNDARQLREDALLLQEAGAAMLLMELIPAVLGEEITRLLSIPTIGIGAGAACSGQVLVLHDMLGISSGTLPRFVRNFMMDADSIQTAVSNYVEAVKLGAFPAYEHTF

SEQ ID NO: 13501 - protein, 585 aa, Bacillus cereus ATCC 14579
MRKTKIVCTIGPASESIEKLEQLIEAGMNVARLNFSHGSHEEHGARIKNIREASKKTGKTVGILLDTKGPEIRTHDFVDGQAELVTGAEVVLSTEQVLGTAEKFSVSYAGLYDDVDPGSRILIDDGLIELEVIEKADGNIRTKVLNSGTVKNKKGVNVPNVSIKLPGITEKDVKDIIFGIEQKVDFIAASFVRKASDVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEIAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 13502 - protein, 314 aa, Oryza sativa (japonica cultivar-group)
MWGLLRRSSSSGFSSSSTAEEVTAGIDGSGLVALITGASSGIGAETCRVLVMRGVYVVMGVRNLSAGARVRDEILKQVPSAKMEILNLDLSSMSSVRRFAEIFKALNLPLNILINNAGVCFVPFKLSEDDIELHFATNHIGHFLLTDLLIEKMKVTAIESGKEGRVVIVASVSYSLSYPGGICFDKINDESGYNRFLAYGQSKLANILHSNLLSSHLKEQDAKVIVNSLHPGAVATNILHHWCPLYGAIRAIGKYFVKGVEQGAATVCYVALHPQVAGVTGKYFSDCNITELKSHALDMDLAKRLWDFSLSQIR

SEQ ID NO: 13503 - protein, 239 aa, Triticum aestivum
TRPAQANGEEDDDANADDDLGSEDDEYSGSDEDDQEEHQEEGKEANKPTGKIAIALQRAVPPPKINPFDDKPKMKFGFEEEEEEVPNKKAKVAGKATDTRRSAIDDLMKEEEKAKERSNRKDYWLCPGIVVKVMSKSLAEKGYYKQKGLVKRVIDKYVGEIEMLESKHVLRVDQDELETVLPQIGGLVRIVNGAYRGSNARLLSVDTERFSAKLQVEKGLYDGKVLKAIEYEDICKVAQ

SEQ ID NO: 13504 - protein, 258 aa, Oryza sativa (japonica cultivar-group)
MRGLHVVMGVRNSSAGARVRDEIVRQLPAAKIEMLDLDLSLMSSVRRFAENFNALNLPLNILVNNAGIAFVPFKLSEEGIELHFSTNHLGHFLLTDLLLEKMKVTAIESGIEGRVVIVASNSYKHPYREGIRFDKINDESGYYFLTQRILLFTFVYLFNRSKEQDAKVTVNSLHPGAVVTNIMRHWYFVNGMLSTLGKFFVKGVEQGAATVCYVALHPQVAGVTGKYFVDCNVTELKSHALDMGLAKRLWDFSLNLIH

SEQ ID NO: 13505 - protein, 435 aa, Solibacter usitatus Ellin6076
MTNRRQLGLFDATMIVMGGIVGSGIFMNPSVVARQVHTPFLILGVWLAGGALAILGAFIWAELATRLPGAGGQYLYLREAYDPAVAFVYGWVLLLVTQTGGMAAVAVTFARYYREISGVAWSDSAIAAAVLLGLTAINCMGARAGSNVQSALMLMKTGAIAVLVIAGIALGGGTIHPLPLLDRPVSLGLLGALGAGMIPVAFAYGGWQTATFVAGEMRNPGRDLSRGLVAGVTGVVVLYLAVNVVCLKVLRPEGLAATRTPASAVMRAAMGDRGAWWIALGIAISTLGFLSQGMLTAPRVYNAMARDGLFFERVGRLSPRTGAPVTAIVLQGIASTVIAFSGKYEQILNYEVSVDFIAFALAGGALFLFRREGRGDQQGGIYRAPGHPYTTALFVAACVAIVASTVITDPLNSARGWGIMLTGVPVYLYWRRKAQ

SEQ ID NO: 13506 - protein, 552 aa, Oryza sativa
MVAEAFTVDLNEPLVFQVGHLGEQYQEWVHQPIVSKEGPRLFANDVLEFWNLIRLITTPTTTHGVFGGGLLGYVMYDCTHYYLHHGQPSSDPGKHLKKYLHNMAGGSADAVTKEMEALLVGQNPNAVSGETCETSSKEGKVADSNGSHSSPPEDDDDEAQGDGPSQDGGSEAAKKKKKKSKSKKKKGPLQQTDPPSIPIDELFPSGDFPEGEIQQYKDDNLWRTTSEEKRELERLQKPMYNAVRRAAEVHRQVRKHMRSILKPGMLMIDLCETLENMVRKLIKENGLQAGIAFPTGCSLNWVAAHWTPNSGDKTVLQYDDVMKLDFGTHIDGYIVDCAFTVAFNPMFDSLLQASKDATNTGVKEAGIDARLCDVGAAIQEVMESYEVEINGKVFQIKSVRNLNGHSIGPYQIHAGKSVPIVKGGEQTKMEEGEFYAIETFGSTGKGFVREDLECSHYMKNFDVGHVPLRVAKAKQLLGTINNNFGTLAFCRRYLDRLGETKYLMALKNLCDVGIVQPYPPLCDVRGSYVSQFEHTILLRPTCKEVISRGDDY

SEQ ID NO: 13507 - protein, 370 aa, Glycine max
APPPVVAALVVIVILVTVYICLMRVKRFMRQTSEVASSMPSPTVEIGRVNNAHVNAFSPHYTHNTRQLTILEVEQATRNFSHSNIIGEGGFGFVYKGLLQDGSIVAIKRRLFVLTQDFVLKVKQIAHIHHNHLVKLIGYYEDSYQQLLVYEYLPNGNVGSHLYDSEGLPIGRLDLWRRISIASGASKGVEHLHSLVPPLIHTNFRTSNVLLDENYTAKVSDYGFCNSKTQVDNVGSSSNVDCFLDPELSFPQNYTEKSDVYSFGVFLLELICGCEAQNKSMSNPDENIVFQAKNSVDLDKFVDITLGEQEKHGARRVMKLALLCVDVTSRRPSMAQIVHELEQIQREIAPMYSQFNEEIGAVTLGSELFQ

SEQ ID NO: 13508 - protein, 393 aa, Exiguobacterium sibiricum 255-15
MLSKRVQQLTPSTTLAITAKAKALREEGQDIIGLGAGEPDFNTPEFIIQAAFAAAEAGDTKYTPSGGTVALKDAIIEKTRRDLWVSYDRSEVMVASGAKHALSTLFQAILDPGDEVIVPAPYWVSYPEQIKLSDGVPVILETTEASRFKVTRDLLEQHITPKTKALVLNSPSNPTGMVYTKEELEMVAEVAIAHNLLVISDEIYEKLLYNGVTHLSIATLPDMRERTVIINGVSKSHAMTGWRIGYAIGPKDIISAMTNLASHSTSNPTSIAQAASVAAYAEGDAPVEAMRVVFEERLEQIYDRLIQIPGLTCLKPEGAFYLFPHALQAAKMCGFSNVDDWCTAVLSEAKVALIPGSGFGAPEYVRLSYATDPKRVLEALDRIEGFITAHTAV

SEQ ID NO: 13509 - protein, 454 aa, Rhodococcus sp. RHA1
MTDSTSTLGRGLKVRHLTMMGLGSAIGAGLFLGTGVGIATAGPAVLVSYLLAGIIVVFVMRMLGEMGAAIPASGSFSHYARIGIGEWAGFVMGWLYWFMLIMVLGAEITGASGIVSGWLPGVPQWVVALVFVIFFAAVNLAKVSNFGEFEFWFAAIKVTVIIAFLVIGVLLVFGLLPDTEPVGTTNLFGHGGFMPEGFAGVAAGLLVVAFAFGGIEIVTIAAAESEDPERSIAVAMRSVVWRISVFYLGSISIMVLVLPWDSSDLKSGPFVAVLNQAHIPYVAGFMELVVVVALLSAFNANIYGTSRMAYSLSRRGDGPAFMARISNSGVPLNAVLLSVFFGFVSVLLNWWLPDDLLGLLLNAVGSALLVIWIFIVVSHLRLRPRLEREGKLTVRMWLFPWLSYLTLAMLGGFVVLMLFDSDARTQLISTCVLFLVIAALGVLNTRLRQRSQTV

SEQ ID NO: 13510 - protein, 659 aa, Skeletonema costatum
MASYESDLLSTWDEDPSLQKGFDWEIEKLRRYFAGLRQTPDGRWVRKSTLFEFLVTNSPSKVVGVGPDGERYESPPKPVNIFDVGVLVGKNTLTWLGFGPNLGMAAVPDAVIQKYEGSFFTFIKGALGGDLQTLAGGPLFLLLAKYYTDHGPIFNLSFGPKSFLVISDPVMARHILRDSSPEQYCKGMLAEILEPIMGDGLIPADPKIWKVRRRAVVPGFHKKWLNSMIGLFGDCGDRLVDDLEKRSTSDKPVIDMEERFCSVTLDIIGKAVFNYDFGSVTKESPIVKAVYRVLREAEHRSSSFIPYWNLPYAEKWMVGQVEFRKDMGMLDDILAKLINRAVETRQEATVEELEERETSDDPSLLRFLVDMRGEDLTSKVLRDDLMTMLIAGHETTAAMLTWTMFGLVSNDPGMMKEIQAEVRTVMGNKSRPDYDDVVAMKKLRYALIEALRLYPEPPVLIRRARQEDTLPPGGTGLSGGVKVLRGTDIFISTWNLHRAPEYWENADKYDPTRWERPFKNPGVKGWNGYDPEKQSSQSLYPNEITSDYAFLPFGAGKRKCIGDQFAMLEASVTLSMIMNKFDFTLVGTPEDVGMKTGATIHTMNGLNMMVSPRSETNPIPGTNEWWTKQHLMRGLSSTGRPYTSDEDAAWTTSANGMRP

SEQ ID NO: 13511 - protein, 224 aa, Zymomonas mobilis subsp. mobilis ZM4
MIGLYIWKPAPLLPTIASIAVAILGFPLVWYVTHRWIMHGHWMFKVPFLSGLWKRIHYDHHLDPDHLEVLFGALYTTLPSVALATALPGYLIGGFGGACIGYAVGLLSTCFYEFCHCIQHLGYKPKNKRLALMKKRHLEHHFHDEDGNFGITNFFWDKLLGTYYVRRERPNKSPTVFNLGYTPEIAKKYPWVAEHSGGEVLCSPKEKDRYKSSFEEVDKIQDIR

SEQ ID NO: 13512 - protein, 250 aa, Gibberella zeae PH-1
MVTYMKEVAKLGGELTVDERNLLSVAYKNVVGTRRASWRIISSIEQKEESKGSDKHVSTIKDYRNKIETELEKVCQDVLDVLDDFLIPNAATGESKVFYHKMKGDYHRYLAEFASGEKRKGAATAAHDAYKSATDVAQTELTPTHPIRLGLALNFSVFYYEILNSPDRACHLAKQAFDDAIAELDSLSEESYRDSTLIMQLLRDNLTLWTSSDSAEGEAAGAADAPKKEEGEAAKPAEEAAEEPAPAPAS

SEQ ID NO: 13513 - protein, 429 aa, Staphylococcus epidermidis RP62A
MKFTESERLQQLSNEYILGGVNSPSRSYKAVGGGAPVVMKEGHGAYLYDVDGNKYIDYLQAYGPIITGHAHPHITEAIQDQAAKGVLYGTPTELEINFSKKLREAVPSLEKIRFVNSGTEAVMTTIRVARAYTKRNKIIKFAGSYHGHSDLVLVAAGSGPSQLGSPDSAGVPQSVAQEVITVPFNDIESYREAIDYWKDDIAAVLVEPIVGNFGMVMPQPGFLEEVNKISHDNGTLVIYDEVITAFRFHYGAAQDLLGVKPDLTAFGKIVGGGLPIGGYGGRQDIMEHVAPLGPAYQAGTMAGNPLSMRAGIALLEVLEQEGVYDKLDQLGRRLEEGLQKLIDKHHITATINRIYGSLTLYFTNEKVTHYEQVENSDGDAFAQFFKLMLNQGINLAPSKFEAWFLTTEHTEEDIDRTLEAADYAFSKMK

SEQ ID NO: 13514 - protein, 341 aa, Hanseniaspora clermontiae
SCVFPSIVGRPRHQGIMVGMGQKDSYVGDEAQSKRGILTLRYPIEHGIVTNWDDMEKIWHHTFYNELRVAPEEHPVLLTEAPMNPKSNKEKMTQILFETFNVPAFYVSIQAVLSLYSSGRTTGIVLDSGDGVSHVVPIYAGFSIPHAIQRIDLAGRDLTDYLMKILTERGYSFTTTAEREIVRDIKEKLSYVALDFDQEMETAAQSSSIEKSYELPDGQVITIGNERFRAPEALFQPSFIGLESAGIDQTTYNSIIKCDVDVRKELYGNIVMSGGTTMFPGIAERMQKEMSALAPSSMKIKIIAPPERKYSVWIGGSILASLTTFQQMWISKQEYDESGPS

SEQ ID NO: 13515 - protein, 579 aa, Halobacterium sp. NRC-1
MRNAKIVCTLGPATNDDASVRALADAGMTVARINASHGDAAARRELIETTRAVDAQTDKPLAVMLDTQGPEVRTAPIDDDGTIHIETGSDVAFVEGDTATPDRIGISTSIAAAEPGDTVLLDDGRIEADVDRVAGDTVHATVVSGGSLGSRKGVNVPGVELDVDVVTEKDRRDLALAAELDVDYVAASFVRDADDVLAVNRVLESHGADIPIVAKIERAGAVENLDGIIDAAQGVMVARGDLGVECPMEDVPMIQKRIIAQCRDAGVPVITATEMLDSMVHARRPTRAEASDVANAVLDGTDGVMLSAETAVGDNPTRVVETMDRIVREVEGSAEYSERQEQAVPTADGTAKTDALARSARYLARDIDASAVVVASESGYTARKAAKFRPSVPVVCATPSHDVRRQLALNWGVHANYAAVAEGDATTVVERAVQAAVDSGVVASGDTVVVLVGMMTELEGASTTNTLKVHVAAETLSTGRAVVDGRTTGRTYRADSGDLSDAPENAVVLLAHGFDGEFDGDLSKIGAIVSADAGLTGYPAVIARELDVPMVGDVDVDAVPAGDLVTVDGERGVVYEADQ

SEQ ID NO: 13516 - protein, 333 aa, Neurospora crassa
MQSILQKATGIGPKPVQPTDLNGRVAVVTGGAFGIGFEVSRALANAGCRVIMVNRKEEQGDDAKATITAETPGAVVEWRECDMGNLSQVRSVFSELREQLDRLDFLVLSAGINTNQYGLDADGIDRHFGVNYLGQYYVVNQLYPVLKKTSKLPNTPAPRVVFEASEMHRAAPSAVHFASLDEINNPDLGPTELYGRTKLAMILFAKYGLAEKVIKKNGDNIYAASVHPGAVNTAMQQQWKDAYPGITGKLLTWATLAFGRDVKQGSYSALWALTDPKIEEQNLNGWYFSDPDQPGKETSQASDPVLGQALWDLSERIIKDKLGEDALVDWYSA

SEQ ID NO: 13517 - protein, 387 aa, Medicago truncatula
MEGKLSRAAKKLTSSPIQELSHLAQRCNAINLAEGFPDFPAPLHIKNAAVSAINSDLNQYRHVQGICEHLAKIVKEMHGLDIDSETDVAICCAIDPGDEVILFDPSYETYQGCVTMAGGVPIHVPLDPPQWTLDPRKLLTSITERTKAIILNSPHNPTGKVFTKDELETIAGACCSRNCLAITDEVYEHITYDNQKHISLASFPGMQERTIITSSLSKTFSVTGWRIGWAIAPASIASAIRNIHIIVTDSAPAPFQEAALTALRSPPEYFESLRRDYQSKRDYIIKLLAGVGFKIQFIPQGSFFLFAELPEDCPLSDVEFVKKLILEAGVVAVPGQGFFHTNLSTNETSSASCNYQKRYIRFAFCKSETTLAAVSEKLGDQTVEKQY

SEQ ID NO: 13518 - protein, 567 aa, Dehalococcoides sp. CBDB1
MEELGSSFGLDLIIVLVAAVLAGLLARRFKLPLLLGYLGAGIAIGPNGFGLVQSPGVIESMATVGVILLLFTLGLDFSLDELKRVGRVAVLGGLIQIIVTAGFGFLLGRSLGWDINASIFFGFMVSLSSTLIVLKILMDRGEMEAPHGRVMLGILLVQDICLIPLMIILPALGGDGGDIGFTMGIAFAKATAFILAMFALGFWVFPRLLGRVASHSHELFLLSVITLSLGAAMGATALGLSPAVGAFIAGLLIGQSMYAKQALADIIPLRDIFGALFFVSLGMLANLNFAVENMGLVLLVVAFLVVIKSLVAGVVPWLFGYTFQTSFTTGIGLMQIGEFSFVLAGVGLAASVITDSIYAITISAAVITMIITPFALSFSGAAYRKVSQWPLASKLVSLRTSGQTEYKDLDISNHAVICSQGGVAKTLTRVMSRRNFPFLVIDLDPQTIAELRRQKAPAIYGDAANPEILKFARLDKARLLICAMPGFADTEQVVKNARKINSRLDIVARVTSDMQAEKLKKMGVSEVVQPEFEVGLELSRHAMHRFGMTTIEIQYILNSLRNMGKPE

SEQ ID NO: 13519 - protein, 812 aa, Clostridium acetobutylicum ATCC 824
MFVDKKTFKNDFKKKLMTLYAEDIDTSSKLHQYLALGSLIKEYASQGWMNTNNQYSRQARKQIYYFSMEFLIGRLLGSNILNLGIYDICKEGLYELNISLDELEELENDAGLGNGGLGRLAACFLDSMASLGIPGHGCGIRYGYGLFEQKIVNGYQVEIPDNWLRDGNVWEVRREDKAVIVKFGGEVTMNEKDGRLYFEHKNYEPVLAVPYDTPIIGYKNNTVNTMRLWSAETIDKDFDLDSFSKGQYSKAVEHKYSIESISQVLYPDDTRIDGKILRLKQQYFFVCAGLKSIVRSYKKTGRPMREIYKYVQVHINDTHPSVAIAEFMRILMDEELLSWDDAWSITTRVMAYTNHTILAEALEKWPIELFKKLLPRIFMIVSEINERFCKEVYEKYNDLEKVHKMAIVSDGFINMAYLAIVGSHSVNGVAKLHTEILKTRELHNFFEFYPKKFNNKTNGITHRRWLIKSNPNLASLITNTIGDKWIYSPERLIDLLKFAKDESFKEKLHDIKQKNKLKFTEMIQRKYNISVDPNSIFDVQVKRLHAYKRQLLNVFNILNLYYKLKENPNLNIVPRTFFFGAKAAPGYYLAKRTIKLINTVADIINNDSSVNEKLKVLFLENYSVSLAEKIIPCADVSEQISTTTKEASGTGNMKFMMNGAITIATLDGANVEIHEKVGDDNIVIFGMKKDEVIEYEKNKNYRAVDFYNSDARLKRIVDGLINGSLGVPKSEFEDIYKYLLANNDEFFVLKDFSDYVEAQDKINSLYSDKSKWLEMSAINIAHSGDFSSDNTIKNYAKEIWHIGPVNIRLKKN

SEQ ID NO: 13520 - protein, 140 aa, Rickettsia conorii str. Malish 7
MTIQYTFSMIKPDAIKRNKIGQVNTYLENAGLKIVAQKMKFLTKYEAACFYDEHRARPFFNSLVEYITSGAVVLQVLKGEDAITLNRTVMGATNPAEAEAGTIRKDLGESIEANSIHGSDSENSAKREIEFFFNKSEIIE

SEQ ID NO: 13521 - protein, 307 aa, Pyrococcus horikoshii OT3
MKRMKVLVAAPLHEKAIQVLKDAGLEVIYEEYPDEDRLVELVKDVEAIIVRSKPKVTRRVIESAPKLKVIARAGVGLDNIDVEAAKEKGIEVVNAPAASSRSVAELAVGLMFSVARKIAFADRKMREGVWAKKEAMGIELEGKTIGIIGFGRIGYQVAKIANALGMNILLYDPYPNEERAKEVNGKFVDLETLLKESDVVTIHVPLVESTYHLINEERLKLMKKTAILINTSRGPVVDTNALVKALKEGWIAGAGLDVFEEEPLPKDHPLTKFDNVVLTPHIGASTVEAQERAGVEVAEKVVKILKG

SEQ ID NO: 13522 - protein, 270 aa, Burkholderia sp. 383
MKIAFIGGGNMAAALIGGLIKRGVAADGLYAIDVNEEVRARAAQQFGVHTGAAIDATLADYDAVVLAVKPQVLKDVAQALAPHLKSQLVISIAAGIRGTDLARWLGGYDRIVRTMPNTPALVGMGVTGLTALPGVDAAGRELASNVLGAVGEIVWFDDESKLDAVTAISGSGPAYVFYFIEALQEAARQLGMNDEQGRALAVATFTGAAQLAAQSGEPASVLRERVTSKGGTTAAALASFDAQGVKDAIVRGALAAEARAKEMGDELGRA

SEQ ID NO: 13523 - protein, 279 aa, Exiguobacterium sibiricum 255-15
MHTMTPLLKKQQAGEKLVMLTAYDYPSAKLAEAGHVDLLLVGDSLGNVILGYDSTIAVTVDDMVHHAKAVRRGAPATFMVVDMPFASYHGSFDRTLEAAARIFQESGADALKLEGAGDILTTIRRLTEAGMPCVAHLGLTPQSVGVLEGFKVQGKSLAAAEQLIADSLAAEQAGAKMLVLECVPHPLAKRVQELLTIPVIGIGAGADVAGQVLVYHDILTYGVGRLPKFVKAYADWNTSGTEAIARYVEDVKNGTFPELAHSFLMDEELIGALYGGFKE

SEQ ID NO: 13524 - protein, 323 aa, Exiguobacterium sibiricum 255-15
MEKSTRDRVLQALMKADWISGQELADQFNISRTAIWKQIAALKEDGYIIEAHKKTGYHLADRGDRLTPLAIQQYVRTDTLGQQIIHLEQTETTQRIAHEQAQQAASEGTLIVCDFQTDGRGQLGRTWHETRSAGIAMSLILRPTAPLHQAGQLTLLAGIALAETLRTLDVPATIKWPNDLLIAGRKVAGILTEMQTEADRINSVIIGIGINVHHTQFPELLSDRATSLHLATGKLIARAEIVGLFLNTFEPMYKKWLTEGFASFVPAWEKYADRLNDLVTLRTRQETVTGILRGIQADGTLQIETETGLKAFHSAELVYWTEM

SEQ ID NO: 13525 - protein, 362 aa, Oryza sativa
MASATLLKSSFLPKKSEWGATRQAAAPKPVTVSMVVRAGAYDDELVKTAKTIASPGRGILAMDESNATCGKRLASIGLEKHRSQPPGLPDPPCHRTGLGTVHLRCYPLRGELYHSTVDGVRMVDILTEHKIVPGIKVDKGLVPSAGSNNESWCQGLDGLASREAAYYQQGARFAEWRTVVSIPNGPSELLRSFSTVSMASTGSFQVAQKVWAENFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 13526 - protein, 192 aa, Glycine max
MASGGTEAFPDLGKHCQHRDCNQLDFLPFTCDGCQQIFCLEHRSYKSHACLKSDHNSRKVVVCEACSMSIETTGHVGQDEEAILQKHLKSGNCDPTKKKKPICPVKRCREVLTFSNTSTCKTCHIKVCLKHRFPADHACSRGASASSSACVSNGLWNNRFLTAFAKRTGQECAKNGATCSTSPPSTPSVKAY

SEQ ID NO: 13527 - protein, 840 aa, Synechococcus sp. CC9605
MTTSQPFDLRLPTPGCYNDPERAGLDAKSVFDGMTEHLFFTLGKLAPTASRHDLYMALSYAVRDRLMMRYLATTEAMRAHPQKSVAYLSAEFLIGPQLNSNLLNLGIQKEAEEALKNFGIDSLQQILDVEEEPGLGNGGLGRLAACYMESLASLKIPATGYGIRYEFGIFDQLIRDGWQVEITDKWLKGGWPWELPQPDEACFVGFGGRTESYIDDKGNYRSRWIPAEHAIGIPHDVPVLGYRVNICDRLRLWRADATESFDFYAFNIGDYYGAVEEKVGSETLSKVLYPNDGTDEGRRLRLKQQHFFVSCSLQDMLRSLDNRGLAVEDFPNYWTVQLNDTHPAIAVAELMRLLIDDRHLEWDRAWDITSRSVAYTNHTLLPEALEKWDLDLFGSLLPRHLELIYEINRRFLQQVRLRYPGNDAIQRKLSIIDEEGSKAVRMAHLATIGAHHVNGVAALHSDLVKTDLLPEFAALWPEKFTNVTNGVTPRRWVALANPEMSALLDEHVGPDWISNMESLRKLEERQNDQGFLELWGNTKLSVKRKLAAYIHRNTGVLVDPSSLFDVQVKRIHEYKRQHLNALQVITQYLRIKNGQTDGMAPRTVIFGGKAAPGYYMAKLIIRFINGIADTINADPDMDGLLRVVFLPDYNVKLGEQVYPASDLSEQISTAGKEASGTGNMKFAMNGALTIGTLDGANVEIRELVGAQNFFLFGKTVEEITTLKQSGYRPSEVVAALPELQEALRLIEMGHFSNGDGELFRPLLDNLTGNDPFYVMADYADYLRAQEAVSHAWSDRMHWNRMSLLNTARTGFFSSDRSISEYCNNIWAVDPLNVEITCDVR

SEQ ID NO: 13528 - protein, 458 aa, Synechococcus sp. CC9605
MLLPTLLSEISSHDFEVAETLIGVLRFVLIFIAARTLAEILVRFELPTILGELLAGVIIGASGLHLLVPPETQVQLSGAFSNVLGGLAHVPPEEIGLIYNESFGSLRSVSNLGLYSLLFLTGLESELDELMAVGAQAFSVAVVGVVLPFALGTFGLMALFHVDPIQAIFAGASMTATSIGITASVFGELGYLRTREGQIVIGAAVLDDILGIVILAVVVSLAAGGSLEIAPIVQLVVAAVLFVVVALVLSRKAAPAFDWMIDQLKAPGAKLVGSYLLLGASCFIATAIGLEAALGAFAAGLIASTSRHRHEIQAAVMPIVGLFATVFFVLVGAGMDLSVINPSDPEARSALVIAGFMFIVAIIGKVVAGWAVFGKQKTNHLVVGLGMLPRGEVGLIFLGLGTAAKLLSPGLEAAILLMVIGTTFLAPVLLRLVLKGKPPEDGDQVPEELAADPLAGAS

SEQ ID NO: 13529 - protein, 651 aa, Pseudomonas fluorescens Pf-5
MFANLLIILASSLVVIALFRRLSLPPVLGYLSVGLMVGPTALDWVNDSEDLPDLAELGVVFLLFSLGLEFSLSKMLALRHVVFGLGSLQVLCTGLILGVLLALFGMPLTAALMLGTGLALSSTAIVSKELTSLGEIFSSHGQNAIGVLLFQDVVAVLLLTLVPVFAGSSEHAWYWALPATLGKTVVLFVGLLLASRWLLPRLFHEVAASHSAELFVLLALVIVLLTAWLTHLLGLSPALGAFLAGMLLGESHYRHQIEADIRPFRDILLGLFFVSIGMLIDLQLFIDHALLITGLTLALLLIKGSVVATLLKLRGSDGETAWRSGLALAQGGEFCFALMAQMQLSQMIPPDISSLLLAATFCSMLVTPLLLRAAPVITARLHRKPNQTAQLEEISAQNAELQGHVLICGYGRVGQSIGRFLRHEQLRYIALDDDPVRVQEASAGESCVHYGDCRRGDLLAAVGLERARLLVIAVDKSDIALTVLKAARRLDRTVPILVRTRDDSQLAELKAAGANEVVPELLESSLMLASHALIMLGLPEQRVQRTVDEVRHSRYQLLHGFYHGTQNSAQDNREPPAVQMHAVSLDADAYACNRPLQELGLEALGVDIRGVQRNGNDLPLNPSPRLQAGDRVLVSGPQAAIEACEARLQAG

SEQ ID NO: 13530 - protein, 149 aa, Methanosarcina barkeri str. fusaro
MEQTYVMVKPDGVQRGLVGEIISRIEKRGLKIVALRMNVISEATAKEHYSEHAAKPFFPGLVGFITSGPSVSMVVEGKDAIRVMRAINGATNPVDAAPGTVRGDFALDVGRNVVHASDSPEAAAREIAIHFKDSEIGNYSRIDEVCLYE

SEQ ID NO: 13531 - protein, 479 aa, Streptomyces coelicolor A3(2)
MTDTPTQLFLGGAWADAADGAVMPVDDPATGEILAHVADAGPKDARLAEEAAVQAQEEWARAAPRARSEILRRAYEIVLERTDALARLMTSEMGKPLAEARGEVAYAAEFFRWFSEEAVRIDGGHGVLPDGRNRMLLSRRPVGPCLLITPWNFPLAMGTRKIGPAVAAGCTMVLKPAPQTPLSSLALAAILKEAGLPDGVLNVVTTSRAGEVCEPLLRGGRIRKLSFTGSTAVGRLLLAQCADTVVRTSMELGGNAPFVVFDDADLDAAVDGAMVAKMRNMGEACTAANRFFVHRSVAGEFADRLARRMGALVVGPGTGDGVDVGPLIDAAGRAKVEELVADAVERGARVLVGGTTPEGPGCFYPPTVLTDVAPESRLMATEIFGPVAAILTFDDEDEVVRRANDTPWGLVGYVFTEGLDRALRVSERLDVGMVGLNTGLVSNPAAPFGGVKQSGLGREGGRVGIEEFLEYQYVALPTG

SEQ ID NO: 13532 - protein, 277 aa, Bradyrhizobium japonicum USDA 110
MARFERAALLRRFRGMARRGEPIVGGGAGTGLSAKCEEAGGVDLIVIYNSGRYRMAGRGSLAGLMPYGDANAIVLEMAGEVLPVVSKTPVLAGVNGTDPFRDMDVFLDQLKALGFAGVQNFPTVGLIDGVFRANLEETGMSYALEIDMIAKAREKDLLTTPYVFSEKEAAAMAIAGADIIVCHLGLTTGGTIGAQTAPKLQDCAARIDTWASAALSVNPEILVLAHGGPIADPADADFIMKNTRNCHGFYGASSMERLPVERALTEQVRQFKAIGAR

SEQ ID NO: 13533 - protein, 738 aa, Bradyrhizobium japonicum USDA 110
MNEVRRTAAALEVRGLDVYYGHSHALQGVDLALESGVFSVVGRNGMGKTTLCKAIMGLVPVSGGSIRIRGEDITRRSPAHIARLGVGYVPQGRRLWRSLSVDEHLRLAGSMRSGAWTVERIYDTFPRLAERKDHGGGQLSGGEQQMLAISRALLTNPHLLIMDEPTEGLAPVIVAQVEEMLLRLGEDGDMAVLVIEQNIGVATAISRNVAIMVNGRINRIIDSARLAADRELQQRLLGVGLHATLEPDTDAPAAGSEPKPAPQPSRPSGPIRIYISNPILPTRWSQPVPIARIEAAARALSTQVARLDETARRKREPATAQASGPPVVLVVGTLDTKGAELRFIRDIITGSGLRTRLVDVSTSGRHASCDVSAQEIALNHGRGGSAVFGPDRGAAVTAMADAFANWLRRQGNIAGVITAGGSGAASLVAPGMRTLPVGVPKLIISSVASGDVGPYVGPADITMMYSVTDVQGLNAISRAVLSNGANAIAGMVKARLDQREARERATAASLPSIGITMFGVTTPAVQRIAADLREDFECLVFHATGVGGRSMEKLVETGQLAGVIDLTTTEVCDLLMGGVFPATEDRFGAIIRTRAPYVGSVGALDMVNFGAPDTIPERYRGRKFHVHNPQVTLMRTTAEENERIGRWIGEKLNQMDGPVRFFLPEGGVSALDTRGQPFWDPDADAALFRTLERTVRQTGNRQLIRVPRNINDPEFASTIAAAFRTLFGRTGARRRLAR

SEQ ID NO: 13534 - protein, 334 aa, Xylella fastidiosa 9a5c
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKFTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 13535 - protein, 141 aa, Xylella fastidiosa 9a5c
MVLERTLSIIKPDAVAKNVIGDIYSRFEKAGLKVVAAKYKQLSRREAEGFYAVHRDRPFFNALVEFMISGPVMIQVLESENAVARHRELLGATNPKDAALGTIRADFAESIEANAAHGSDSVENAAIEVAYFFAATEIILR

SEQ ID NO: 13536 - protein, 215 aa, Xanthomonas axonopodis pv. citri
MSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 13537 - protein, 185 aa, Arabidopsis thaliana
  misc_feature (105)..(105): Xaa can be any naturally occurring amino acid
  misc_feature (110)..(110): Xaa can be any naturally occurring amino acid
  misc_feature (123)..(123): Xaa can be any naturally occurring amino acid
  misc_feature (153)..(153): Xaa can be any naturally occurring amino acid
  misc_feature (162)..(162): Xaa can be any naturally occurring amino acid
  unsure (1)..(185): unsure at all Xaa locations
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGXFVYRXEHGNTPGYYDGRXYWTMWEASIGSGCTDFRFQVLKEIGECKKXEVPGRFIRXIGSTTPVSQMISFMAKSPKLHGA

SEQ ID NO: 13538 - protein, 442 aa, Glycine max
EWFPLSDAEGDPDCPSKGYSSIERALNALRQGKFVIVVDDENGDIEGNLIMAASLTSPKDIAFMIKHGSGIVSVGMKEEDLQRLNLPLMSPETEDEDSSAPTFTITVDVKSGTSTGVSAADRAKTVLALSSPESKSEDFRKPGHVFPLKYRNGGVLRRAGHTEASLDLVALAGLPPISVLSALVDENDGSMQSLLNLRKLASEYTLPIVSITDLIRYRRKREKLVERTSVSRLPTKWGLFQAYCYSSKLDGTEHVAVVKGDMGDGQDVLVRVHSECLTGDIFGSARCDCGNQLDLAMRLIEEAGRGVVVYLRGHEGRGIGLGHKLKAYNLQDQGHDTVQANIELGLAVDAREYGIGAQILRDIGVRTMRLMTNNPAKFVGLKGYGLAVVGRVPVLTPITEENKRYLETKRTKMGHIYGSDLQGSLPGFNGSTVNNGDSLENT

SEQ ID NO: 13539 - protein, 539 aa, Gibberella zeae PH-1
MAPDYPVDDAIETAPPVDASYGHTHESDDEKPVLSNGGEGPTQRRLKGYHITWIGLCGGIGTGLFIGAGSAYATSGPAGLLLAYLVVGAVLWCVMQSISELATLLPTAGSFPHWATRFIDPSVGFSLAISYGYCYTISIAAECSASAVLVSYWTDITPAVVITISLVLILWINLMDVRFFGEAEVVSGAIKVLCFCGLVVVAIVITAGGGPKGDAIGFRYWSDPGAWVDYNGITGSSGHFLGFLSAFVNASFSFIGVETVVITAAEAINPHREIPKAANRVTYRIGFFYILGAFLIGLIVDPRNEGLVSGTGNAKSSPWVIAIQAAGIKVLPSIINACILISAWSAGNSYCWVGSRMILAMTTDKQLPQFFGRTTKKGVPYVAVITSWLFGPLAYLSLGSGGAAQAFSWLLNLSTVAGLIAWATLCFSYIRFHRALSVQGISRDSLPWKAPWQPYTAWFGFIGSVIITLVCGFPVFLKGNWDTASFIASYIGIPIFIIPIIGWKLAYGSKFARAKDIDVWSGRWEVEVPSGQLSEKDAA

SEQ ID NO: 13540 - protein, 327 aa, Arabidopsis thaliana
MVASGHEVVTLTFPIGSVHHLMPVLALGTAASPPPEPIVLKRTVLEAIKLGYRHFDTSPRYQTEEPLGEALAEAVSLGLIQSRSELFVTSKLWCADAHGGLVVPAIQRSLETLKLDYLDLYLIHWPVSSKPGKYKFPIEEDDFLPMDYETVWSEMEECQRLGVAKCIGVSNFSCKKLQHILSIAKIPPSVNQVEMSPVWQQRKLRELCKSKGIVVTAYSVLGSRGAFWGTHKIMESDVLKEIAEAKGKTVAQVSMRWAYEEGVSMVVKSFRKDRLEENLKIFDWSLTEEEKQRISTEISQSRIVDGEVYISEKGPIKSVTEMWDGEI

SEQ ID NO: 13541 - protein, 251 aa, Lactobacillus sakei subsp. sakei 23K
MTIEAAQIQRVLSPELRDLLTLSVQQVLPSTNAYLLQQPMRDQQWSVVIAQQQTQGRGQRDHQFASPIGGLYLSLLMPVRDSAQFNTFQQTAAAGVALAETIQALLHYEVQLKWVNDVYDQQQKLAGILTEGYLDVTGRLSGVVVGVGLNFASTIETEHIGNLRALVVAQQVTINQFSAQYLNRLYTLLQLPALELTRRYQRWTPLVGRKLQTIAGQPVQDISVSALKPDGTLILSNQQIVRIGQRVRFAD

SEQ ID NO: 13542 - protein, 207 aa, Bradyrhizobium sp. BTAi1
MSERLLVLVRHGQSEWNLKNLFTGWKDPDLTEQGVSEAKEAGRKLKAHGLTFDVAFTSELTRAQHTLKLILDELGQPGLPTSRNLALNERDYGDLSGLNKDDARAKWGEEQVHVWRRSYDVPPPGGESLKDTLARALPYYVQEILPGVLRGQRTLVAAHGNSLRALIMVLEKLTPEGILKRELATGVPIIYRLKADSTVESKLDLAG

SEQ ID NO: 13543 - protein, 438 aa, Bacillus cereus E33L
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPAVEIVDLGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAIFGSLFVIGSAIINDPLSCFLSIGIVFTGLPVYWYLNKKNKTEVS

SEQ ID NO: 13544 - protein, 342 aa, Zea mays
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 13545 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 13546 - protein, 453 aa, Dechloromonas aromatica RCB
MNSKEDLARLQQELEAKGVKYCIGAYVDIHGVPKAKVVPIHHLLHMAKGSERYTGYALDGLGQAPNDDELTSIPDFSRLIQLPWEPKIAWIPSDNHFQGKPYPLNTRVALQNQLAEAAKLGFGMNLGIECEIFLLRQNADGSLSVPDPEDKLAKACYDVRGFTNNFSWLDKVATAINDLGWDLYSFDHEDANGQFEFDFQYADALTTCDRLTFFRYMAKHYAREEGLLATMMPKPFADKTGNGAHFNMSLYDLQDGRNLFACDPKDDPNGIGLTKLGYHFVAGILKHGRALCAVFAPTVNSYKRLVRRGAMNYFSWAPVFNSYGSNNRTNSVRIPSGGGRCESRNADGAVNPYLVATLVLAAGLEGIREGLDPGKPNEDNLYAISEAERHARGIEFLPQTLQEAVAAFAADPLVEQTLGKELRDEFIRYKSEEWEAYHLTVSQWEIDRYSYMF

SEQ ID NO: 13547 - protein, 486 aa, Agrobacterium tumefaciens str. C58
MMQGLKDKELFRQTGLIGGAWKAAASGKVVDVIDPATQAVIGTVPDMGGAETRAAIEAANAAFGPWKKKTHAERAALLEKWFALMIENIDDLRLILTIEQGKPLDEAKGEIRYGASFVKWFAEEARRIGGGTIPSPTPDRRIVVLKEPVGVCGIITPWNFPNAMITRKVAPALATGCTVVIKPSEFTPYSALALGVLAERAGIPAGVINIVTGMPTEIGNEIMANETVRKISFTGSTRVGSLLMRGAADSVKRLSLELGGNAPFIVFDDADLDLAIEGAIVSKFRNGGQTCVCANRILVQSSVYDAFAKKLADRVDAMRVGPGTEAGVSIGPMINKPAIAKIRAHIDDAVAKGATIITRPRDLPEGPQYTAPVVLTGATTAMQLASEETFGPVAPLFRFETEEEALAIANGTPFGLAAYFYTESLKRAWRVGEALEFGMVGLNTGAISTEVAPFGGVKQSGLGREGAQVGIEEYLETKTFHIGGLA

SEQ ID NO: 13548 - protein, 651 aa, Pyrococcus horikoshii OT3
MTFLIKRETQVDQILRDIRAVVNQMVPKEAKITEIEFEGPELVIYVKNPEAIMKDGELIKDLAKVLKKRISVRPDPEVLLPPEEAEKLIFEIVPKEAEITNIAFDPSVGEVLIEAKKPGLVIGKNGETLRLITQKVKWAPKVVRTPPLQSQTIYSIRQILQTESKDRRKFLRQVGRNIYRKPEYKSRWIRITGLGGFREVGRSALLVQTDESFVLVDFGVNVAMLNDPYKAFPHFDAPEFQYVLREGLLDAIIITHAHLDHCGMLPYLFRYNLFDGPIYTTPPTRDLMVLLQKDFIEIQQSNGQDPLYRPRDIKEVIKHTITLDYGEVRDISPDIRLTLHNAGHILGSAIVHLHIGNGLHNIAITGDFKFIPTRLLEPANAKFPRLETLVMESTYGGANDIQMPREEAEKRLIEVIHNTIKRGGKVLIPAMAVGRAQEVMMVLEEYARIGGIEVPIYLDGMIWEATAIHTAYPEYLSRRLREQIFKEGYNPFLSEIFHPVANSRERQDIIDSNEPAIIIASSGMLVGGPSVEYFKQLAPDPKNSIIFVSYQAEGTLGRQVQSGIREIPMVGEEGRTEVIKVNMEVHTIDGFSGHADRRELMNYVAKVRPRPERIITVHGEPQKCLDLATSIHRKFGISTRAPNNLDTIRLR

SEQ ID NO: 13549 - protein, 90 aa, Medicago sativa subsp. x varia
MSSSIRIWTVAASVGVVEALKDQGLCRWNCALRSAQHHVKHHLRSLSQANKISSSNSYAMVSSRLKEQEAKQSEESLRTVMYLSCWGPNN

SEQ ID NO: 13550 - protein, 377 aa, Bacillus cereus ATCC 10987
MKAVTYQGPNQVQVKQVDDAKLEKKDDIIVKITSTAICGSDLHLYQGNMPLPQGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKRGDTVIVLGCGPVGLMTQKFAWMQGAKRVIAVDYLDYRINYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 13551 - protein, 336 aa, Gibberella zeae PH-1
MSRYTAAHANLQGPGDARPTALQIVKDEDLVGKLTDKVILVTGGNSGLGLETAKTLHATGATVYITARTSEKLEEAIKDIKAWPEAESSAPVYGIELQLDSLASVRAAAKKFLEKSEKLNILILNAGVMATPEGRTEDGFETQFGTNHLGHFLFFELLKPALIASSTPSFHSRVVSLSSKGHRYGGVRFDDFNFEKEPYIPWIAYAQSKTANIYFASELERRYGSQGLHGLSVHPGFIFTNLARHIDVSQIDVKGDTKNYVKNIEQGSATTVYAALSKDWEGRGGRYLADCDEEPPLKPGIDPASSAPGYASWIYNEEAEGRLWAESLRLVGLKKD

SEQ ID NO: 13552 - protein, 137 aa, Arabidopsis thaliana
  misc_feature (68)..(68): Xaa can be any naturally occurring amino acid
  misc_feature (90)..(90): Xaa can be any naturally occurring amino acid
  misc_feature (106)..(106): Xaa can be any naturally occurring amino acid
  misc_feature (112)..(112): Xaa can be any naturally occurring amino acid
  misc_feature (114)..(116): Xaa can be any naturally occurring amino acid
  misc_feature (119)..(119): Xaa can be any naturally occurring amino acid
  misc_feature (126)..(126): Xaa can be any naturally occurring amino acid
  misc_feature (131)..(132): Xaa can be any naturally occurring amino acid
  misc_feature (134)..(135): Xaa can be any naturally occurring amino acid
  unsure (1)..(137): unsure at all Xaa locations
MASSMLSSAAVVTSPAQATMVAPFTGLKSSASFPVTRKANNDITSITSNGGRVSCMKVWPPIGKKKFXTLSYLPDLTDVELAKEVDYLLXNKWIPCVEFELEHGFXYREHGXQXXXNTXGRVLWQXWEGSXXFXXTP

SEQ ID NO: 13553 - protein, 330 aa, Gibberella zeae PH-1
MPCHPTEPEFEVRDIPSLRGYVAIVTGETDYSGNSGIGYETTLQLALKGARVYIASRSNDRVNKAIAEMHKNSPDLDLHFLKLDLQDMQSIKDTTADFMSRENRLDILINNAGIMSSPWELTKDGHEIQWQTCFLSHHALTMSLMPLLVTAAQVSGRMDRVRIINVASDMALRMGPEAIHYDDPNLTNETGKLAPWRRYGHCKEASIIAAKAITDRYQSLGVTAYSLHPGLVKSNLQSHNPTMLGAMSRMMFKVGPSSTPLEGAMNSLFCATSHKVYEHAGRYYVPVQKLDDRANKWLDDAQAVNKLWDLATRQCREHGFIIDDIPGYYN

SEQ ID NO: 13554 - protein, 106 aa, Zea mays
  misc_feature (81)..(81): Xaa can be any naturally occurring amino acid
  misc_feature (90)..(91): Xaa can be any naturally occurring amino acid
  misc_feature (96)..(96): Xaa can be any naturally occurring amino acid
  misc_feature (99)..(100): Xaa can be any naturally occurring amino acid
  unsure (1)..(106): unsure at all Xaa locations
MQQSRARLFKEYKEVQREKVADPDIQLVCDDTNIFKWTALIKGPSETPYEGGVFQLAFAVPEPYPLQPPQVRFLTKIFHPXNVHFKTGEXXLDILXKNXXSPAWTL

SEQ ID NO: 13555 - protein, 309 aa, Synechococcus sp. WH 8102
MLAGLLLLTGAAGATALLIWLQRDRRYHSSDSVAAAYDAWTDDQLLERLWGDHVHLGHYGNPPGSVDFRQAKEAFVHELVRWSGLDQLPRGSRVLDVGCGIGGSARILARDYGLDVLGVSISPAQIRRATELTPAGLSCRFEVMDALNLQLPDRQFDAVWTVEAGPHMPDKQRFADELLRVLRPGGCLAAADWNRRAPKDGAMNSTERWVMRQLLNQWAHPEFASISGFRANLEASPHQRGLISTGDWTLATLPSWFDSIAEGLRRPWAVLGLGPKAVLQGLRETPTLLLMHWAFATGLMQFGVFRLSR

SEQ ID NO: 13556 - protein, 333 aa, Xanthomonas axonopodis pv. citri str. 306
MAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 13557 - protein, 243 aa, Nocardia farcinica IFM 10152
MADIAVVTGSTRGIGFETALALGSAGYTVIVTGRSRESATAAAGRLGDRGIDAQGYALDVTSFDSVQRLAGTLAETHGRVDALVNNAGIAAEWEAPGPSLYAHPHAVRKTMETNVFGVFHTVEAMLPLVRRSESGRIVNVSSFVGSLALQSRADPNDLVIPAYQASKAALNSLTITLSKVLADTGIKVFSIDPGFVQTDFSPINRAQAPLTAAQGAEPVVEAAMLDLDAPSGSFLGRDGVVPW

SEQ ID NO: 13558 - protein, 84 aa, Brachypodium sylvaticum
DEPYPYAVYRCHTTGPARAYVVDMDGEGSNKVTLATVCHTDTSLWNPDHVSFQLLGTKPGGAPVCHLMPYGHILWAKDVKRSPA

SEQ ID NO: 13559 - protein, 236 aa, Gossypium hirsutum
MLGVFSSAIVSPPDELVAAGCRTPSPKITADALVKRFLETNSSGVSMHIGDHVQFAYSHHKESPLQPRSFAVKDEIFCLFEGALDNLGSLKQQYGLAKSANEVILVIEAYKALRDRAPYPPNHVVGHLIGSFAFIVFDKSTSTLFVASDQFGKVPLYWGITADGYVAFADNAELLKGACGKSLASFPQGCFYSTAVGGLRSYENPKNKITAVPAEEEEIWGAKFKVEGPAVVAATE

SEQ ID NO: 13560 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPRSDLPERLVQNRSFNTFDLTKEDFEEIAKLDIGLRFNDPWDWDNIPIFV

SEQ ID NO: 13561 - protein, 381 aa, Picrophilus torridus DSM 9790
MRYYSYGGRSGRLIGKAGDLTIYARTYNYDDIEHENEKRTDFSFNFSYGPLTGGIPEPFRFDINTSGEKINYIKYYNYKIRNIKLKGINIKDAIPYIERINGNFAASYTICFLSSVMDALEIEIPYELKMYYIIEMELERIRNHLYVLARMCEPAGFNVPANMLMHIKERFSRIIDITFGHRYFFGVNQLKSKRLDIHKMINVYKNEINDIYLNLLNSRLFTDRLQDNGRILDDDMTGPAARAAGYKYDSRYDFDIFYYNDTGYEIKTDDSGDAMSRFNVRFNEILNSIDIIENAENKTGDSCYNILDGSGTGLTRVESPSGDVAFYVELSNGVIKDLKIHTALERNMKSFLKSSTGTIFTDFHFNFESFGLWAADEVNII

SEQ ID NO: 13562 - protein, 317 aa, Synechocystis sp. PCC 6803
MVYHVRPKHALFLAFYCYFSLLTMASATIASADLYEKIKNFYDDSSGLWEDVWGEHMHHGYYGPHGTYRIDRRQAQIDLIKELLAWAVPQNSAKPRKILDLGCGIGGSSLYLAQQHQAEVMGASLSPVQVERAGERARALGLGSTCQFQVANALDLPFASDSFDWVWSLESGEHMPNKAQFLQEAWRVLKPGGRLILATWCHRPIDPGNGPLTADERRHLQAIYDVYCLPYVVSLPDYEAIARECGFGEIKTADWSVAVAPFWDRVIESAFDPRVLWALGQAGPKIINAALCLRLMKWGYERGLVRFGLLTGIKPLV

SEQ ID NO: 13563 - protein, 785 aa, Neurospora crassa
MLTLFSSFDPSASSNLQHHNNNSQKRAFANGNGQGLPRFSICFMAAELLDSVPDPVLSDLDQKEAVAGLQGYQHPAVSANPDPVEAELEAKELSKYLLAKSFFDCKEFDRCASVFLPDSLLSGLLSTKATDATTPKGKAKASSAPPYEQALPSLSQKSLFLALYAKVISGEKKKNEESEMIMGPQDLGTIKNSHLVVVSRFLERWFAERKAEDSDLPPSQGFLEYLYGMVMVKEKNEDAALDYLLNSVHLFPWNWGAWLELTNLISGVEQLNKITPVLPQNIMSFIFYANTAVNLYQQGQDLAASVNDLLKLFPTSSFILTCRALLNYHSKDLYTAEQNFSNLLALHPHRLDSLDHYSNILYVLNMRPKLAFLAHLCSSIDKFRPESCVVIGNYYSLLSLHEKAVQYFRRALTLDRSCLSAWTLMGHEYVELKNTHAAIESYRRAVDVNRRDYRAWYGLGQTYEVLEMNSYALYYYKKAAGLRPWDGKMWQAVGSCLQKMGKDRDGIKALKRALLADSYYDSTLSSFGSAGPADRMAQMDPEVLLQIASMYDRLGEVEEARAYMELCVAQEDGGATDNADASAVCTSNPGESFVVHGDSPGSDGDAEGGYEGRGGAGQGEGTGVTVATSKARMWLARYAMRTEDYVTANRLATELCQDGVEVEEAKALIREKPPSLAFPNIEEYLPSAAMIRIGSNGGGGPKLRRVPRSQRYYENISTIPPLTDQGSGIYEDPSQESDDDDDDDDENGGNDRHDDWSGEDYLTDGYDDDDVDDDDDDNGGAPTNA

SEQ ID NO: 13564 - protein, 462 aa, Arabidopsis thaliana
MENITAQLKRGISRQFSTGSIRRTLSRQFTRQSSLDPRRTNMRFSFGRQSSLDPIRRSPDSSKSDDEPHMSVPENLDSTMQLLFMASKGDVRGIEELLDEGIDVNSIDLDGRTALHIAACEGHLGVVKALLSRRANIDARDRWGSTAAADAKYYGNLDVYNLLKARGAKVPKTRKTPMTVSNPREVPEYELNPLEGAYQVAKWNGTRVSVKILDKDSYSDPERINAFRHELTLLEKVRHPNVIQFVGAVTQNIPMMIVVEYNPKGDLSVYLQKKGRLSPSKALRFALDIARGMNYLHECKPDPIIHCDLKPKGGQLKISGFGMIRLSKISQDKAKVANHKAHIDLSNYYIAPEVYKDEIFDLRVDAHSFGVILYEITEGVPVFHPRPPEEVARMMCLEGKRPVFKTKSRSYPPDIKELIEKCWHPEAGIRPTFSEIIIRLDKIVANCSKQGWWKDTFKFPWK

SEQ ID NO: 13565 - protein, 513 aa, Arabidopsis thaliana
MDPGDPTSIIFSKIRTFELENASRVIDYFLLQDMEQRDLIRIAFGPDSLIQTFCQKAKVDLGFSSNGFSRPINIHGQSLSSSSPRNGFLEFSRNPSNPLSSSLTLNTLRDNKPNFNSSPFRESSSLFASSSGDEQQQQQFSNNFLFTNDEDPFANSHKRSFSANDACFESEEPWFGGGNGCHQFPQGGLVDGFGSSGVFGSPSEMDYMLEGMMRMKLAQQKSMVAAQFMAACGSPMLHRHGSGHFGEECGNYFSQGRHEREDSVSKQIYLTFPSESSFTDEDVSTYFRDFGLVDDVRIPYQQQRMYGFVTFAKAETVRTILARGNPHFICDSRVLVKPYKEKGKILQKRQQQQLHELLERGNYSPSSSPSGKDSRELYECRLGPRMFSKKTQEMLRRKTEQADLQHAIERSPSIGSPSHFPPRFNHSLLFQSGNNNEEIMEGDSDRSEKDLQQVATSNEERGYNNGFYKGQETSLENTLPDSLFGSPKKSGETYQTESDTEHNNKEASSNQLA

SEQ ID NO: 13566 - protein, 214 aa, Wolbachia endosymbiont of Drosophila ananassae
MVQATYASMSLPGISSVEDVLEDARSGKLFILVDDENRENEGDLIVLAEKIKPEHMAFMVRYGTGVVCLAMTKFHMKRLGLNFMEKKNIGENHTAFTTSIDARYGITTGVSAEDRTKTIHAAINKDGTQDDIITPGHVFPVIAHKGGVAQRAGHTEASVEMAKLVGFDHSAVICELVNDDGSMMRLPQLLKFAEQHKIKLTTIDKLISYVKNLN

SEQ ID NO: 13567 - protein, 188 aa, Triticum aestivum
MSSSMESSYLPATTESIAMAQEAKDASKSISILYRVIQDPSSSADALRTKELAITNLTNYLTEESRAEELRNLLTQLRPFFSLIPKAKTAKIVRGIIDAVSKILGTSDLQISLCKEMVEWTRAEKRTFLRQRVEARLAALVLENQEYTEALTLLTGLIKEVRRLDEQLLLVDIDLLESKSHVLGDPSF

SEQ ID NO: 13568 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVEHGMFLGMATTLIVAGKFGVTVKDRFG

SEQ ID NO: 13569 - protein, 511 aa, Zea mays
MEMVPWLLGFLGRYPELMVSLACFLLLFRRLNQRDGLPTNWPVVGALPAITVNAGRMHEWVTEFLRAAGLSYVMKGPWGSPVDVIMTADPANVAHVFTSNFGNYPKGQEFAALFDVLGDGIFNADGESWAFQRRKAHALLSDARFRAGVAASTARKLRDALVPLLDGIAASGAVVDLQDVFVRLTFDLTAMFVFGIDPGCLAPDFPYVPFAAAMDTVEEVLFYRHVAPVPWLMLQKYLRTGHSKKMWNARRVLDASIAEFISLRRERAAEAEAEADLLTSYLACHDEIGKSGAELERFLRDTTLNLMVAGRDTTSSALTWFFWLLTKHPDVEAKVLEELRAHPPLSGAGGHRTAAELKQLVYLHAALSESLRLYPPVPFEHKAAARTDTLPSGARVGPSRRVIVSFYSMGRMEAVWGKDCSEFRPERWLTAAGRFRHEPSYKFVAFNVGPRTCLGRDLAYSQMKAVVAAVLPRFRVEVDAGAVVRPKLSIILHMKDGLKVRVPKREEDGLC

SEQ ID NO: 13570 - protein, 445 aa, Lactobacillus delbrueckii
MSKVITEEEIRKDVEEKNVRFLRLAFTDINGTLKNLEVPVSQLDDVLGNQTRFDGSSIDGFVRLEESDMVLYPDLATWLVLAWTTVEEGTIGRLVCSVHNVDGTPFEGDPRNNLKKVIAEMEEMGFSDFEIGFEAEFFLFKEGKNGEETTKVSDHSSYFDMASEDEGAKCRREIVETLEKLGFRVEAAHHEVGDGQQEIDFRFDNALATADKLQTFKMVVKTIARKYHLHASFMAKPVEGLAGNGMHTNMSLLKDGKNAFYDKDGQYNLSTTALTFLNGILEHARAITCVANPTVNSYKRLIPGFEAPVYISWASRNRSPMVRIPNANEVGTRLEMRSTDPTANPYLLLSACLKAGLTGIKEGKLPMAPVTSNLFEMTDDERKELGIKPLPSTLHNAIKAFKEDEVVKSAFSEHIVDSFLELKETEWALYTQSVSEWEVKRYFNY

SEQ ID NO: 13571 - protein, 841 aa, Neurospora crassa
MAPQVGDLQFEPLAVDQEKAQTFERDRKVDTSKVPLRVRFAENPDSQRTPRCPTSRAASLFIGNILIVISVAVALFLVAAQFDSLSWNYWRSDISNPGTNVSTCATDTQYLLGVGKGDITGPVVEINLMGYADPKQLGTGLRQRLYSRAFIVGSLERPQDRFVYLVLDTQSGDTAVRFGIIKALKELGPEYAFYGHHNIALTGTHSHAGPGGWLNYLLPQITSKGFDRQGYQAIVDGAVLSIRKAHESLQPGYLSAGTTKVFGANINRSLFSYLANPEAERMKYFKSEEEDGSVEKDLTMLKFQRASDGKNIGVLTWFPVHGTSMLGNNTVVTGDNKGVAAWLFEKSVRGDSSAAEDFVAGFSQANMGDVSPNVLGAWCEDNSGSQCSFKNSTCSNGKSQACHGRGPAFKVHDDGASSCFEIGRRQFEPAKQLYDHLINNPSPVRGPWVKAFHTFHDMSNFTFIRPDGKPARTCPAALGYSFAAGTTDGPGAFDFTQHNGNENTTMPIWKVVRYFIKAPGDEQKACQHPKPILLDVGEILRPYDWSPNIVDVQAFRVGQFAIVVSPGEATTMAGRRWKEAVGQSFKRILDQDMEQTYGYTGGPSSNPIVVLGGPANTYTHYITTEEEYQIQRYEGASTLYGPDTLNAYINVTLSFLPYLSSESTSPPAHDEKSFPPDNTNRSLSFIPAVVRDAPPLFKGFGDVLVDVDSARGYHRGDAIRAVFVGANPRNNLRLEGTYAAVEKLFVDQVNPQKSEWRTVRSDEDWSLIYSWKRKNSVMGTSEVEIMWETGEETDEWWDKELGPGVYRLKYYGDSKSLFGGKVQEFEGVSGAFTLVRENWLG

SEQ ID NO: 13572 - protein, 161 aa, Brassica napus
MASSLVRSISRSLRTVTASRLMSNVPENTVYGGPKPQNPNQRVTLTQLRQKHQKGEAITVVTAYDYPSAVHVDTAGIDVCLVGDSASMVVHGHDTTLPISLDEMLVHCRAVARGAKRPLLVGDLPFGAYESSTIQAVDSAVRVLKEGGMDAIKLEGGSPSC

SEQ ID NO: 13573 - protein, 464 aa, Glycine max
MTEVLHFSSSSSPATSSSDGILQEPPPPSSVSVVVDGFSTVTDCDARRVTVTDRTHQELSLLAILVTLLRKSLIACNKSDEGQGAMEIGWPTNVRHVAHVTFDRFNGFLGLPREFEPEVSTRPPSASATVFGVSTESMQLSYDTRGNSVPTILLLMQRHLYALGGLQAEGIFRINADNSQEEYVRDQLNRGLVPEDVDIHCLAGQIKAWFRELPTGVLDSLSPEHVMQCQTEEDCAELASQLPHTEASLLDWAINLMADVAQEEHLNKMNARNIAMVFAPNMTHMADPLTALMYAVQVMNFLKNLILRTLRERKDCVVESSPGFCLEPSDENGDSSLPESCQQDDDVAAENEEAGETFVSEKTELECSPESLQSKYSTEGGCGSLIGSPENLVCEEDLYCEFPSKGNIGKSKSVQSSNSSSKKGSQKTRGMLQPVIHATVAADKKGISNLSRIDSRSERIEAWR

SEQ ID NO: 13574 - protein, 532 aa, Agaricus bisporus
MYPVDGIRSQIEWNTTLNVSDAPVPTETTKYHRKTAIIATIGPKINTVEKLTDVRLAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 13575 - protein, 233 aa, Bacteroides thetaiotaomicron VPI-5482
MNWENHLIKDLQWSNEIINREAKERVAREIAATAKTGDVIGAGSGSTVYLTLFELAKRIHEEHLYLEVIPASQEISMTCIQLGIPQTTLWDKRPDWTFDGADEVDPDRNLIKGRGGAMFKEKLLIRSSGKTFIIVDPSKLVNILGSKFPIPVEVFPHALSYVEKELRRLGASEISLRPAHGKDGPILTENGNFILDTRFHYIDASLEEQLKTITGVIESGLFINYDIEVVVTR

SEQ ID NO: 13576 - protein, 403 aa, Pseudomonas fluorescens Pf-5
MQVSKSNKLANVCYDIRGPVLKHAKRLEEEGHRILKLNIGNPAPFGFEAPDEILQDVIRNLPTAQGYSDSKGLFSARKAVMQYYQQKQVEGIGIEDIYLGNGVSELIVMAMQALLNNGDEVLVPAPDYPLWTAAVSLAGGNPVHYLCDEQANWWPDLADIKAKITPNTKALVIINPNNPTGAVYPREVLLGMLELARQHNLVVFSDEIYDKILYDDAVHICTASLAPDLLCLTFNGLSKSYRVAGFRSGWVAISGPKQHAQSYIEGIDMLANMRLCANVPSQHAIQTALGGYQSINDLVLPPGRLLEQRNRTWELLNDIPGVSCVKPMGALYAFPRIDPKICPIHNDEKFVLDLLLSEKLLVVQGTAFNWPWPDHFRVVTLPRVDDLEQAIGRIGSFLKSYRQ

SEQ ID NO: 13577 - protein, 501 aa, Brachypodium sylvaticum
EITDDRSSEQITEAISEKSDAMLISSNTSYSTTPDSMILVIKDQLKRAKKYIRFLPSRGNHGFIKDLRRRMRDIQQALGGATIDRQLPKKYFLFHCTTNVRGKIRAMELILRKIRQVHDNCVAAIDKLQTTLHSAENQLEAHKQQANYVAQIAVKALPKRLHCLALLLTNEYYSSSSSNKLFPYEDKLEDPKLQHYALFSDNVLAAAVVVNSTLVHAKKPADHVFHIVTDKLNYAAMRMWFLANPLGKAAVQVQNIEDFTWLNSSYSPVMKQLGSHFMIDYYFSTPQNRPDRNPKFRNPKYLSILNHLRFYLPEIFPRLNKVLFLDDDIVVQQDLSALWLIDLKGKVNGAVQTCGEVFHRFDRYLNFSNPLIAKNFDRRACGWAYGMNMFDLSEWRRQNITDVYHYWQEQNEHRLLWKLGTLPAGLVTFWNRTFPLDRSWHLLGLGYKQNVNPEDIERAAVIHYNGNLKPWLEVGLSKYRKYWTKYVNSDQAFIRGCNIHP

SEQ ID NO: 13578 - protein, 457 aa, Shigella flexneri 2a str. 301
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 13579 - protein, 83 aa, Triticum aestivum
MAAPAKASWMVAMSVGAVEALKDQAGLCRWNYALGSIHRAAKANVRGGVSQGTKHLPVSAPTVTEKAEEGLRTVMYLSCWGPN

SEQ ID NO: 13580 - protein, 638 aa, Magnaporthe grisea 70-15
MSDADKEIQPQVHRKQNPRTYKQANSDSSSGSDKDGVPRNGKPSTEPGLDAKHIDHADLEALNRNAEARIKNPLAGIPYDRLMADVEAFTQQKGLTEYTAVFKQGALIAQDPDSYDNLPGEHALAAEDKEALRLEGWDQTGINGANVYMQEEYKIGDDSTGSRLILGLVNAGPYLGSALLGCWLSDPVNNWIGRRGVIFVSAHFCLWPVIGSAFCHTWEQQLICRLLMGVGMGIKASTVPIYAAENSPASIRGALVMSWQMWTAFGIFLGTAFNVAVFSVDNRINWRLMLGAPFIPAVPLLLLIYLCPESPRWYMKKDRYADAWKSIQRLRFTKVQGARDIYYIHSQLVLENEVMGKSTYATRFVELFTIPRVRRATLAAFTVMLAQQMCGINIIAFYSTTVFEDAGFGRYEALLGSLGFGLVNWLFAFPAFWTIDTFGRRSLLLFTFPQMTWTLLAAGLCTLIDNDGPQAKLRLGLVALFVFLFGAFYSPGEGPVPFTYSAEVFPLSHREVGMGFAVATCLFWAAILGITFPFLLDRFKVVGVFGFYAGLNVLALIMIFLWVPETKQRTLEELDYVFGSPTAKFINYQCTKALPWWFKRWVLFDRNAKLEPFYKEDRHAEHVQTTTSGGAVDEKRAI

SEQ ID NO: 13581 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 13582 - protein, 473 aa, Prosthecochloris aestuarii DSM 271
MISDSFLFRSDGGFIRLPIWGHIPLNTPLKKILSHPTFLRLKGIRQLSFSQQVYPGATHTRFEHSIGVYHLMKLILQRIHTNPLAESLQNDRFFFDDHSCRLLLSAALLHDIGHYPHAHVLEEQAPVFRGKPVFTRHESLVDRFLFETSDHFPSIADTLHDEWKVDPHEVAALIRGESGNTYKKLISGTLDPDKMDYLMRDAHHCNIPYGNIDIERLIESFVPDPERCRFAITEKGIAPLESLLFAKYMMMRNVYWHHTSRTFSVMLRRFLQDNIDTCMITPHTLTELFYSNSDDRVLYDLEHLLPSEKNPAGSLLERIQQRKIYKRAIIRTPYLNGAKKPIDWMMAYATDHERRKEQEIALCTMIAKRHNIDLCGHEILIDPPSLKDIFDYDDLRELCVFPTKQEHLQSPGNHQKNYISFDEFGESVFRSDFILAFERYTKKFRIVCREDLTPLVRQHEEEIIGMLEAKGPT

SEQ ID NO: 13583 - protein, 175 aa, Ashbya gossypii ATCC 10895
MVPVFSQRLRNAWHRGTGARAAERYIKAPWEDTGRLGRAASNKNMSGKGGKAGSAAKASQSRSAKAGLTFPVGRVHRLLRKGNYAQRIGSGAPVYMTAVLEYLAAEILELAGNAARDNKKTRIIPRHLQLAIRNDDELNKLLGNVTIAQGGVLPNIHANLLPKKSAKATKASQEL

SEQ ID NO: 13584 - protein, 462 aa, Erwinia carotovora subsp. atroseptica SCRI1043
MRSIKRLPMPPTRGVLGHVDYLKRSDIHLQMLRWKAQYGCFFRLRLGLSSAVVIADTEWIRTIMKSRPDEFRRISSIESVFQEAGLNGVFSSEGERWELQRKLTEPMFQPAHLKYFYSSLRKVTSRLSERFTMLAETGEAIALVDEFKRYTVDITSLLAFGEDVNTLEQGDNPLSQSLRHLFPIINERCESPIPVWRYIRRARDKQFDASLNLIREYVDGFISRQRQRIQLNPQLLEAPENMLQVMLAEQQKDGTLKDDDIVANAITLLIAGEDTTANTLTWMSFLLCSAPSVEECVFQECKEAAEGVGAILPWPLPRMAWLTAVMYESMRLKPVAPLLYLEPTRDTVIDDFLIKKGTPLLLMLNASGFNDELFQQPYDFMPERWLERGKAAFSDLQPFGGGPRMCPGRSLALMEIKLGFHALCSGFHVEALQVASAVTESFAFTVTPSGFRVKLHKRELQQ

SEQ ID NO: 13585 - protein, 446 aa, Legionella pneumophila subsp. pneumophila str. Philadelphia 1
MTKNNINCPKNVNEDYGMFKRIALVCALFSGVCFAEGKQLLDKVVAIVNDNVITSSELNAQVELSKKQIIAQNMQMPDESVLRKQVLQHLIDVDLEMQMAKQNGITIENAEIDEAIEKIAASNHLNLSQMRDEITKQGISWQEYRQNIRKEMLISRVQQKAVGKDIIVTNEQVEQYLKTSGRIENSNLTYHLKNIVIPLSEEPTTKQLQRAKIEAENLLNKIKKGEDFSRLAIEESSGEFALEGGDLGERHLAELPEVFAKEVVHMKVGQVAGPIRAGNGFHLIKLVAVGGENQRHVITQTHVRHILLKPDASMVPSEAIKQVNNIYRQIQSGKDFALMAKQYSLDAASAVKGGDLGWVNPGELVPEFEKTMNSLPLHKVSKPVKTQYGWHLIEVIARRQKDDSEAFKKQQVRQFLQQRKFVEAVQNWQQHLRSQAYINIVDKDLA

SEQ ID NO: 13586 - protein, 271 aa, Burkholderia sp. 383
MTYLQESSRPAVTVPKLQAMRDAGEKIAMLTCYDASFSALLDRSGVDVLLIGDSLGNVLQGHTTTLPVSLDDIAYHTACVARAQPRALIMADLPFGTYGTPAEAFASSVKLMRAGAQMVKLEGGEWLAETIRFLVERAVPVCAHVGLTPQSVHAFGGFKVQGKTEAGAAQLLRDARAVEAAGAQVVLLEAVPTLIGSEVTHMLRVPTIGIGAGADCSGQVLVLHDMLGVFPGKRPRFVKDFMQGEPNIQAAVEAYVRAVKDGSFPGPEHSF

SEQ ID NO: 13587 - protein, 148 aa, Medicago truncatula
MDASTKTKKGAGGRKGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKNEKAATTTKSPSKATKSPKKA

SEQ ID NO: 13588 - protein, 800 aa, Lactococcus lactis subsp. lactis Il1403
MKLSKKQFKQDFEERLTSKFATDLTKAGYQEIYDALASVVKHYYANIWVADNQYKDETGKKQAYYFSIEFLPGKMLKSNLLNLGILNTVREGLNDFGIELDEVAKIEPDMAIGNGGLGRLASCFMDSLASTGLPGNGNGIRYRYGLFKQKIVDGYQVELPDSWLNNGNPWEVRRADKAVEVTFGGEVWLEDDGKGNLIPHYKDQERVLAVPYDTPMVGFENTTVNNMCLWRSEVPEELDPKFQNLDYMRQTSMLSAELYPDDSNYDGRLLRLKQEYFFVSAGLQRILHHYKGTQKKDIRKIGDYIAVHINDTHPALCVPEFMRLLVDEYGVGWNRAWDTTLKVMSYTNHTILSEALEKWPEEMIKQLLPRIYQIIVEIDRRRTAELLPKVGATLVHNTRIIKDGQIHMANLSIIGSHSTNGVAKLHSDLLKDVELHDFYEIYPERFNNKTNGIADRRWIQIANERLSGIIDETIGKSWRHDLDELKLLKNFNNDEKTLEQLQKAKFDDKLRLAAVIKEQKGITVNPDAIFDVQVKRLHAYKRQLLNALHILKLYFDLKDNPELDRIPRVFIFGAKAAPSYHYAKSIIKVINEIANMINNDQTIKDKLKVVFMENYNVSLAEVIIPAANVGEQISLASKEASGTSNMKFMLNGALTIGTLDGANIEIFEAAGDGNNFVFGLTKDEVYEYYRNGNYNARDIYEQNPVVNRILNALIDGTVPNIKSEGREIFDSLTVYNDEYFVLRDFNDYVRAQAELEKLYRDQKAWTQASLMNIANVGRFSSDRTVREYADDIWYIKAKKE

SEQ ID NO: 13589 - protein, 477 aa, Rhodococcus sp. RHA1
MTVDSSHEQLNEDGLAQGLNKRHIRMIAIGGAIGVGLFLGSGKGISYAGPALVGVYAITGVFIFIIMRALGELLMYRPVTGSFAEYAREFLGPVYGFITGWGYWITWTIIGMAELTAAGIFVRFWFPSMPQYLTALIALIALVTLNLAKVGFFGEAEFWFASIKVITIVALIAGGIFALVFNVGKAGQEGGIANLWDHGGIAPHGLLAVLLAFQIVVFSYQGVELIGMTAAETKNRATVLPKAINSIPWRIGIFYVGTLVVLLSLFPWDQFNADSSPFVKGFTQIGLPAAASIMNFVVLASALSSCSAGLFSNGRLLKKLAADGVAPKMFEKTNRGHVPAAAIIASGSLMLVSVAINAIVPEQAFSYISSVATLGAIWSWGVIVACHLVYRRRVERGEVPASTFRLPLATPLCWATLAFLAAVTVLLAFDEGQRIALYALPIWAAVLLTGYYLSARRTASPVAPSPATENDRPALHP

SEQ ID NO: 13590 - protein, 176 aa, Glycine max
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKKYYEAGARFAKWRAVLKIGENEPSEHSIHENAYGKNPVPPQRKGF

SEQ ID NO: 13591 - protein, 282 aa, Lactococcus lactis subsp. lactis Il1403
MVIQWFPGHMSKARRQVQENLKYVDFVIELVDARLPISSRNPMLGQIIGDKPRIIALNKADLADSNAVAQWIEFFDEQGFVTLAINSKEEYTAKRLTVAAKKLMADKVAHDKERGIAHTTLRTMIIGIPNAGKSTLMNRLAGKKVAVTGNRPGVTKGQQWIRTNKELELLDTPGILWPKFEDQLVGLKLALTGAIKDDLLPMDEVTIFGLNYFLKNYRTVTMKRYRMTEEDLELEIPDLIMELTARFGFRDDYDRFYNMFVKDVRDGKLGLFCLDEVGVDGL

SEQ ID NO: 13592 - protein, 446 aa, Staphylococcus aureus subsp. aureus Mu50
MPKRTFTKEDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 13593 - protein, 451 aa, Shewanella oneidensis MR-1
MNKLIAFLKERKITEVECVICDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYDEKGWEPVIAPEMEFYLTSRSDDHDLPLKPPIGRSGRPEAGRQSFSIDAANEYDPLFEDMYDWCEIQGLDIDTLIHEDGPAQMEINFSHGNPLSLADQVFVFKRTLREAALKHNVCATFMAKPVTDEPGSAMHIHQSVINKETGKNIFTNEDGTQSALFLSYIAGLQKYIPEFLPLMAPNANSFRRFLPGTSAPVNLEWGIENRTCGLRIPESSPQNRRIENRIPGADANCYLAFAAGLLCGYIGMVEGLKPSTPVQGKANESRSNNPHCLPLTLEEALVAMEESDACKEYLGESFTTGFVAVKQAELENFRRVVSSWEREFLLLSV

SEQ ID NO: 13594 - protein, 584 aa, Pseudomonas mesoacidophila
MLMKRLFAASLMLAFSSVSSVRAEEAVKPGAPWWKSAVFYQVYPRSFKDTNGDGIGDFKGLTEKLDYLKGLGIDAIWINPHYASPNTDNGYDISDYREVMKEYGTMEDFDRLMAELKKRGMRLMVDVVINHSSDQHEWFKSSRASKDNPYRDYYFWRDGKDGHEPNNYPSFFGGSAWEKDPVTGQYYLHYFGRQQPDLNWDTPKLREELYAMLRFWLDKGVSGMRFDTVATYSKTPGFPDLTPEQMKNFAEAYTQGPNLHRYLQEMHEKVFDHYDAVTAGEIFGAPLNQVPLFIDSRRKELDMAFTFDLIRYDRALDRWHTIPRTLADFRQTIDKVDAIAGEYGWNTFFLGNHDNPRAVSHFGDDRPQWREASAKALATVTLTQRGTPFIFQGDELGMTNYPFKTLQDFDDIEVKGFFQDYVETGKATAEELLTNVALTSRDNARTPFQWDDSANAGFTTGKPWLKVNPNYTEINAAREIGDPKSVYSFYRNLISIRHETPALSTGSYRDIDPSNADVYAYTRSQDGETYLVVVNFKAEPRSFTLPDGMHIAETLIESSSPAAPAAGAASLELQPWQSGIYKVK

SEQ ID NO: 13595 - protein, 292 aa, Solanum demissum
LNSSYRVPFESFRVPFVDLQEATNNFDEKFRIGVGIFGKVYRGVSRDGTKVALKRRNRESPQGIEEFQAEIEILSFCSHPHLVSLIGYCDERNEMILVYEYMENGNLSSHLYGSDLRLPTMSWEQRLEICIGAARGLHYLHNSAVIHRDVKSTNILLDENFVAKITDFGISKTMSELDQTHLSTTVKGSIGYIDPENFIRRQLTEKSDVYSFGVVLFEVLCARPAIVQSLPRETVCLAEWAVDSHNKGQLEQIIDPNLAAKIRPESLRKFGETAVKCLALSSEDRPSMGDVL

SEQ ID NO: 13596 - protein, 142 aa, Dehalococcoides sp. CBDB1
MERTLLLVKPDGVNRGLSGEILGRMEKLGLKLIGLRMLQMDAVLADKHYAPHRARPFFKDLVTYITSGPITAAVFEGENAVEKMRKAMGATDPAKSEKGTVRGDLGINIEQNTVHGSDSAENAKHEISLFFSESELVNYDRR

SEQ ID NO: 13597 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCSHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTLVQGTLGYLDPEYFNRGQLTEKSDVYSFGVVLFEVLCARPAIVQTPSRGMISLAEWVVESQKKGQLEQIIDPNIVAEIRPESLRIFGETAVKCLALSGEDRPSMGDVL

SEQ ID NO: 13598 - protein, 183 aa, Arabidopsis thaliana
  misc_feature (109)..(109): Xaa can be any naturally occurring amino acid
  misc_feature (112)..(112): Xaa can be any naturally occurring amino acid
  misc_feature (115)..(115): Xaa can be any naturally occurring amino acid
  misc_feature (121)..(122): Xaa can be any naturally occurring amino acid
  misc_feature (132)..(133): Xaa can be any naturally occurring amino acid
  misc_feature (135)..(135): Xaa can be any naturally occurring amino acid
  misc_feature (140)..(140): Xaa can be any naturally occurring amino acid
  misc_feature (149)..(149): Xaa can be any naturally occurring amino acid
  misc_feature (155)..(157): Xaa can be any naturally occurring amino acid
  misc_feature (159)..(161): Xaa can be any naturally occurring amino acid
  misc_feature (164)..(164): Xaa can be any naturally occurring amino acid
  misc_feature (166)..(166): Xaa can be any naturally occurring amino acid
  misc_feature (170)..(170): Xaa can be any naturally occurring amino acid
  misc_feature (175)..(176): Xaa can be any naturally occurring amino acid
  unsure (1)..(183): unsure at all Xaa locations
MASSMLSSTAVVTSPAQATMVAPFTGLKSSASFPVTRKANNDITSITSNGGRVSCMKVWPPIGKKKFETLSYLPDLSDVELAKGVDYLLRNKWIPCVEFELEHGFVYRXEHXNTXPGYYDXXYWAMWELPLXXCXGSGQXLKEFKIQEXVPGALXXXRXXXPVXQXISLXAKTPXXVNPFWEI

SEQ ID NO: 13599 - protein, 133 aa, Aspergillus oryzae
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKSGKGPSQEL

SEQ ID NO: 13600 - protein, 290 aa, Solanum sucrense
LNSSYRVPFESFRVPFVDLQEATNNFDEKFHIGLGGFGKVYRGVLRDGTKVALKRYTPESNQGLQEFQTEIEILSFCNHPHLVSLIGYCDERNEMILVYDYMENGNLRSHLYGSDLPSMSWEQRLEICIGAARGLHYLHTSAVIHRDVKPINILLDENFVAKITDFGLSKKRTELDQTHLSTFVQGTLGYLDPEYFNRGQLTEKSDVYSFGVVLFEVLCARPAIVQTPSRGMISLAEWVVESQKKGQLEQIIDPNIVAEIRPESLRIFGETAVECLALSGEDRPSMGDVL

SEQ ID NO: 13601 - protein, 146 aa, Triticum aestivum
  misc_feature (73)..(73): Xaa can be any naturally occurring amino acid
  misc_feature (83)..(83): Xaa can be any naturally occurring amino acid
  misc_feature (92)..(92): Xaa can be any naturally occurring amino acid
  misc_feature (105)..(105): Xaa can be any naturally occurring amino acid
  misc_feature (111)..(111): Xaa can be any naturally occurring amino acid
  misc_feature (128)..(128): Xaa can be any naturally occurring amino acid
  misc_feature (141)..(141): Xaa can be any naturally occurring amino acid
  misc_feature (144)..(144): Xaa can be any naturally occurring amino acid
  unsure (1)..(146): unsure at all Xaa locations
LGPDVDAMKAVADAYSKRSLKYFETALRDYKAQLEEDPIVHRHLSSLYDTLLEQNLCRLIEPYSRVEIAHIAXIIELPMNHVXKKLSQMILXDKKFAGTLDQGAXCLIIFXEDSKTEEIFPATLETIXNVCKVVDSLYMRXGKXMA

SEQ ID NO: 13602 - protein, 250 aa, Lactobacillus reuteri
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNSYLLFNGRKQLPIF

SEQ ID NO: 13603 - protein, 387 aa, Triticum aestivum
MTGAAPALLHHHGVSSRGTLPVYHGNCRFVPGSCFLSKSTILGPLTVSLVCGATPNNHRPRNPDISRQQKRGSSSRGKSKPFQERDDSENNDEFDSDTVSSKNGPPISLTSNTRPHATSAPGEREKEIVELFKRVQAQLRARGKGREDKKPEPAKSQGERGSVDSLLNLLRKHSVDQKRKSSDEKEQNFDQTWRSSDSGNKQSSRIFGTKNDAQEGQKPPPATFQRPPSSFRRRSPVPGVKFQLVTNPDAGAKPVVNGMTDAVLEAKTPLEEETAQDEPDSASPYEPDSVIAPEDASLDDFVVSDDESDVLDTDEPDEYLEPFDNADDVTDSIPSHDDSLEGSPSVEASDLSSLKVMELRELAKSRGLRGYSKMKKSDLVALLSDVS

SEQ ID NO: 13604 - protein, 335 aa, Candida albicans SC5314
MAIKIGINGFGRIGRLVLRVALGRKDIEVVAVNDPFIAPDYAAYMFKYDSTHGRYKGEVTASGDDLVIDGHKIKVFQERDPANIPWGKSGVDYVIESTGVFTKLEGAQKHIDAGAKKVIITAPSADAPMFVVGVNEDKYTPDLKIISNASCTTNCLAPLAKVVNDTFGIEEGLMTTVHSITATQKTVDGPSHKDWRGGRTASGNIIPSSTGAAKAVGKVIPELNGKLTGMSLRVPTTDVSVVDLTVRLKKAASYEEIAQAIKKASEGPLKGVLGYTEDAVVSTDFLGSSYSSIFDEKAGILLSPTFVKLISWYDNEYGYSTRVVDLLEHVAKASA

SEQ ID NO: 13605 - protein, 462 aa, Nostoc sp. PCC 7120
MHLPKGPQTPVFVQVLRWVFSPMSFLEDCAKRYGDIFSVKLAKDVPAIVFLSNPKDIQQILTNDNNQLDSPGDWNDLFEPLLGKRSVITLSGAEHQRQRQLLMPPFHGERMRGYSQVITDVTEKVISQHQIGQPFQVRSVTQAITLRVIMQAVFGLYEGSRAEKLQHLLSDLLEKSSSPFSVALLYFPSLRRDFGPIKFWGEQVQIQQQADELIYQEIQERRENPDPSRTDILSLLMDARDADGQPMTDVELRDELMTLLVAGHETTATALAWAMYWIHKLPPVKARLLEELDSLGDNPDSTTIFKLPYLNAVYSETLRIYPVAMLTFARRVIETMALGGYELPPGTPVLGSIYLTHHREDLYPEPKKFKPERFLERQFSPYEYLPFGGGTRRCLGLAFAQWEMKLALAKILTSYELELVNNSVEVRPKRRGLVTGPHRPIEMVIKSQRQITSRILETTTVS

SEQ ID NO: 13606 - protein, 322 aa, Synechocystis sp. PCC 6803
MEQPMKPTVIITGASSGVGLYGAKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 13607 - protein, 1169 aa, Aspergillus oryzae
MSSLKRPQRPLEQGEWDEGDDNRLSSSSSACHLRKRIRTSKSPASYEGTGVSDSESEGRIHHSITQALEYDEDELELRATQLIQEKYSFAGDEPNVPAEHGILERVECYNFMCHDHFYVELGPLINFIVGKNGSGKSAVLTAITLCLGGKASATNRGQSLKSFIKEGKEYVRLSLYWSATIVVRIKNQGDGAYMPDDYGKSIVIERHFTKAGTSGFKIKAENGRIVSTKKAELDAIIDFFTLQFDNPMNVLSQDMARQFLSSSSPAEKYKFFVKGVQLEQLDQDYRLIEESADQIEEKLRGREQDIMILKHRKVAANQKLDMSDQHESLRNRVRNVRSQMAWAQVEEQERVRSPDIMGLQAGMRSSLEIELAKVDEKIATAEAGLGSFDAAIRVAEEETEAAAECVRQGTTKLEQAQSEKVEITARWDEQMTERHDLQAQQRQIRDYLKAAEARINETQQKIEEENQRLVNLSGGSYTRKQEQLERAKVEAAHASTQYVEHQRNADRLYRDLEVAGKEVESLAVPLNRTKADVEQAEKLLWSLSKEGGPKNTGFHDKMPSLLRTIQQEEGFTEKPVGPIGRHVTLLKPEWSSILENSFGTTLNSFVVTSKRDMEILSRIMRNVNWYEMMGILIHQNTSLIISLIRLYGCFRASYIRLIYSNLQIDNELVRRQLIINHGIEQMLLIEKLEEASSVLFDGQKPRNVKRCYCIDQTDRRRGIHLSYNRAGEPSQAPVPAYSGSPRMKSDLASQIRVQRDVVADLRRKLSDQEERFRSARSRLEGCKQARVRHGKSTNELRVILQRKEDHVEELTDVLDKERVEDDHLDVLRATLQEAEEEKRINEGSLKDSMEAMEAMMKGLKAIKQQLASKDADIAASTEELHITQSEVLRAQDKRRKIINDKNIAVERLDDIRREKERINEKREEVSARVIDFSEKASLVSPRVPIPEGETAASLDKKLDRLNRDIQRYNQQLGASRDEIAAEAAKASAAYDRALKQVEEFRLLAGILIETLKHRKKRWVIFRSHISSRAKAQFTYLLSERSFRGRLLTDHESKLLDLQVEPDITKDSTGRGAKTLSGGEKSFSQVCLLLALWEAMGSPVRCLDEFDVYMDHINRKMAIDMLMLAARRSVGVQFILITPGSRAEISLAPDVRVKDAFPLDWQNLNEDKRD

SEQ ID NO: 13608 - protein, 379 aa, uncultured archaeon GZfos10C7
MLSKRLTRIEESATMKMGSIAKKLQAEGKSVLNFSLGEPDFKTPGHICEAAKRALDLGYTHYVSSAGVDELREAIAGKIREENEVDVSAENVIVTPGAKQAIYELMMSVLDDGDEVILLDPAWVTFESAVKLAGGNPKWVKRLEEEVNYESLESAVSENTKLIVINSPNNPAGYVLSEKEQKEIAEFAVDHDLLVLSDEIYEKIIYGRKHVSIASFDGMQARTVIINGFSKTYAMTGWRIGYAVAPAEILKGMLKIQQHSVSCAPSIAQSAALTALSSPQDCVNEMVEQFKRRRDVIVKRLNEIGLRCLNPEGAFYAFVNTSNHGNDVGFTERLLKEAYIVVTPGSAFGVAGKNYVRFSFAASIEDILEGMGRIEKLYG

SEQ ID NO: 13609 - protein, 153 aa, Medicago truncatula
MDASTKTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERSNTVSKEPKSPKPKAGKSPKKA

SEQ ID NO: 13610 - protein, 530 aa, Burkholderia thailandensis E264
MIDLATNTPSAAPRDAVPRILPVILAGGSGTRLWPLSREHHPKQLIDLIADESPLSATARRLTGISNAELADTLLLVCGEQHRFTSAAQVSARGLRARILLEPAARNTAPALTLAALEALAHHGDPVLAAMPADHAVSDTRAFQDTVAQAARYAQDGAIVTLGVLPRRAETGYGYIKVGAPLADSNGVEGGHAIDSFVEKPHQELAQQYLQSGDYWWNSGIFVVRASTWLAAIRALQPDMYAACEAAWRDGTDEGQFFKADAQRFAACPCDSIDYAVMERLTGARALGIPGVIVPLAAGWSDVGSWDAIWELLPKDEAGNVARGEVLFEGTEDSFARSEGRLVACVGLKDVVVVETPDAVLVANKHRVQDVKTVVARLKSGQREQVRDHRKVQRPWGYYDSIDRGERFQVKRIVVDPGKQLSLQMHYHRAEHWIVVRGTAKVTRGDETFLLSENESTYIAVGAVHRLENPGKIPLEIIEVQSGDYLGEDDIVRFDDRYGRASAQPAPDAAKPADAEPAPSAEPARALGGH

SEQ ID NO: 13611 - protein, 745 aa, Neurospora crassa
MSGTMSKRQQARNEKVLHELAQAPGNNVCADCSARNPTWASWSLGIFLCMRCATIHRKLGTHISKVKSLSMDSWSNEQVENMKKVGNIASNKTYNPDNKKPPIPVDADEVDSAMERFIRQKYMQRSLAGAKKHNTGSTSSDETPPPLPPKTGNRFGLRSASSIFPLGSKKKHDTGRSASPGPRSPASPRSNGGFGATVRFESDDADETEIKLSKLRDMGFKDEQRNAMVLKGVGGNLEKTIEALVRLGEGSEARTPLNLNKKQTPATSSQSLAPSTASQDAARGRPISPASTNPFDMLDHAPLPPQPLSTQSTGTLQNRNPYNMTTTNPFGVPQQTVPQQQQPQQQQAMSAFDQAFQNLSLAPPSQPLFPHHTGGLIATQQQNLPAGYQQPQMTGPAQQHYSSIALTSNQTFPLTSQTTGGGYNPFFNNQQQQQQQQQQPQTQYQSQQIQQPMTINTTGYAGSYANNPFAKSPTRLQSPTLTQIPEQSQQSFYAGAQAQAPAAMPLSMQQTGNNPFFNQAMGGIPQQQPQQVPQQQYGLAPQYQAQGQTQGQMQMQASQVPQMPQMPQAQQVGYAPQQIQPQQQQQQQQQQQQQQYQQQYQPQRPDKASILALYNYPQLAPQPPPAQQQNPAQVQGQQPFAQAGPANGAFSPQGQSQQQQQPQQQQQQQQQQVQQLQNQGAGSQMVGSKNPFMSAGGTAQGQQQNMAAPKAYNASRESVMALGMEWTNGRHSPDAFANLSARSGH

SEQ ID NO: 13612 - protein, 266 aa, Bacteroides fragilis
MTKKKLPLRFTGQHFTIDKVLIKDAIRQANISNQDTVLDIGAGKGFLTVHLLKIANNVVAIENDTALVEHLRKLFSDARNVQVVGCDFRNFAVPKFPFKVVSNIPYGITSDIFKILMFENLENFLGGSIVLQFEPTQKLFSRKLYNPYTVFYHTFFDLKLVYEVGPESFLPPPTVKSALLNIKRKHLFFDFKIKAKYLAFISCLLEKPDLSVKTALKSIFRKSQVRTISEKFGLNLNAQIVCLSPSQWLNCFLEMLEVVPEKFHPS

SEQ ID NO: 13613 - protein, 475 aa, Burkholderia sp. 383
MNIHPVILCGGSGTRLWPMSRGGYPKQYLKLTGDRTLVQQTAARLQHIPGAAAPIVLTNNEQRFLVAEQLRQVNITPSSIVLEPVGRNTAPAIAIAALLALHESLDALLLVLPSDHVILNEPAFIAAATEAAAIAADQYLVTFGITPTEAHTGFGYIRRGPAIADGKQVYKVDAFVEKPDAPTAERFVSDGNYSWNSGMFMLKASTYMEELRRHAPEIARQAELAFESAKRDNDFVRLDADVFAACPNVSIDYAVMEKTERAAVVAAADLGWNDIGSWSALADIADADEQGNALIGDIFTDAVTNSYIRAEHRMVAAIGLDDIVIVETADAVLVAHRDKAQDVKKIVEWLNASGRHESVTHRRVVRPWGSYEGIDQGDRFQVKRIIVNPGAQLSLQMHHHRAEHWIVVKGTAMVTNGDKEIMLTENQSTYIPLGATHRLTNPGKIPLELIEVQSGAYLGEDDIVRFEDTYGRAAS

SEQ ID NO: 13614 - protein, 401 aa, Rickettsia conorii str. Malish 7
MSIISTRLSSIKPSPTLAVVKKTLELKKAGVDIITLGAGEPDFDTPDNIKEGAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNVMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIEKTIDVIPA

SEQ ID NO: 13615 - protein, 323 aa, Vicia faba
MSAQGQPQVQAQVQGIDEAVLDDIIRRLTEVRLSRPGKQVQLSEAEIKQLCLASRDIFLQQPNLLELEAPIKICGDIHGQYSDLLRLFEYGGLPPKSNYLFLGDYVDRGKQSLETICLLLAYKIKYPENFFLLRGNHECASINRIYGFYDECKRRFNVRLWKAFTDSFNCLPVAALIDDKILCMHGGLSPDLTNLDQIRILPRPVAIPDTGLLCDLLWSDPGRDVKGWGMNDRGVSYTFGPDKVAEFLSMHDLDLICRAHQVVEDGYEFFADRQLVTIFSAPNYCGEFDNAGAMMSVDENLMCSFQILKPAEKKTKFVMSNKM

SEQ ID NO: 13616 - protein, 469 aa, Streptomyces coelicolor A3(2)
MFQNADDVKKFIADEDVKFVDVRFCDLPGVMQHFTLPATAFDPDAEQAFDGSSIRGFQAIHESDMSLRPDLSTARVDPFRRDKTLNINFFIHDPITGEQYSRDPRNVAKKAEAYLASTGIADTAFFGPEAEFYVFDSVRFATRENESFYHIDSEAGAWNTGALEDNRGYKVRYKGGYFPVPPVDHFADLRAEISLELERSGLQVERQHHEVGTAGQAEINYKFNTLLAAADDLQLFKYIVKNVAWKNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRVEFRAPDASGNPYLAFSALLLAGLDGIKNKIEPAEPIDKDLYELAPEEHANVAQVPTSLGAVLDRLEADHEFLLQGDVFTPDLIETWIDFKRANEIAPLQLRPHPHEFEMYFDV

SEQ ID NO: 13617 - protein, 87 aa, Zea mays
  misc_feature (6)..(6): Xaa can be any naturally occurring amino acid
  misc_feature (20)..(20): Xaa can be any naturally occurring amino acid
  misc_feature (25)..(25): Xaa can be any naturally occurring amino acid
  misc_feature (27)..(27): Xaa can be any naturally occurring amino acid
  misc_feature (33)..(33): Xaa can be any naturally occurring amino acid
  misc_feature (35)..(35): Xaa can be any naturally occurring amino acid
  misc_feature (40)..(42): Xaa can be any naturally occurring amino acid
  misc_feature (47)..(47): Xaa can be any naturally occurring amino acid
  misc_feature (54)..(54): Xaa can be any naturally occurring amino acid
  misc_feature (57)..(57): Xaa can be any naturally occurring amino acid
  misc_feature (64)..(66): Xaa can be any naturally occurring amino acid
  misc_feature (72)..(75): Xaa can be any naturally occurring amino acid
  unsure (1)..(87): unsure at all Xaa locations
MESDLXDLFEGAQKAADAGXLGGVXSXGPEVSXCXDGLKXXXKVPGXYDTLVAXSGXKKLRALXXXPGGDIXXXXTGPALRYGKAAL

SEQ ID NO: 13618 - protein, 1061 aa, Bacillus subtilis subsp. subtilis str. 168
MKETSPIPQPKTFGPLGNLPLIDKDKPTLSLIKLAEEQGPIFQIHTPAGTTIVVSGHELVKEVCDEERFDKSIEGALEKVRAFSGDGLFTSWTHEPNWRKAHNILMPTFSQRAMKDYHEKMVDIAVQLIQKWARLNPNEAVDVPGDMTRLTLDTIGLCGFNYRFNSYYRETPHPFINSMVRALDEAMHQMQRLDVQDKLMVRTKRQFRYDIQTMFSLVDSIIAERRANGDQDEKDLLARMLNVEDPETGEKLDDENIRFQIITFLIAGHETTSGLLSFATYFLLKHPDKLKKAYEEVDRVLTDAAPTYKQVLELTYIRMILNESLRLWPTAPAFSLYPKEDTVIGGKFPITTNDRISVLIPQLHRDRDAWGKDAEEFRPERFEHQDQVPHHAYKPFGNGQRACIGMQFALHEATLVLGMILKYFTLIDHENYELDIKQTLTLKPGDFHISVQSRHQEAIHADVQAAEKAAPDEQKEKTEAKGASVIGLNNRPLLVLYGSDTGTAEGVARELADTASLHGVRTKTAPLNDRIGKLPKEGAVVIVTSSYNGKPPSNAGQFVQWLQEIKPGELEGVHYAVFGCGDHNWASTYQYVPRFIDEQLAEKGATRFSARGEGDVSGDFEGQLDEWKKSMWADAIKAFGLELNENADKERSTLSLQFVRGLGESPLARSYEASHASIAENRELQSADSDRSTRHIEIALPPDVEYQEGDHLGVLPKNSQTNVSRILHRFGLKGTDQVTLSASGRSAGHLPLGRPVSLHDLLSYSVEVQEAATRAQIRELASFTVCPPHRRELEELSAEGVYQEQILKKRISMLDLLEKYEACDMPFERFLELLRPLKPRYYSISSSPRVNPRQASITVGVVRGPAWSGRGEYRGVASNDLAERQAGDDVVMFIRTPESRFQLPKDPETPIIMVGPGTGVAPFRGFLQARDVLKREGKTLGEAHLYFGCRNDRDFIYRDELERFEKDGIVTVHTAFSRKEGMPKTYVQHLMADQADTLISILDRGGRLYVCGDGSKMAPDVEAALQKAYQAVHGTGEQEAQNWLRHLQDTGMYAKDVWAGI

SEQ ID NO: 13619 - protein, 482 aa, Shewanella oneidensis MR-1
MLLNDPSLLRQQCYINGQWCDANSKETVAITNPATGAVIACVPVMGQAETQAAIAAAEAALPAWRALTAKERGAKLRRWFELLNENSDDLALLMTSEQGKPLTEAKGEVTYAASFIEWFAEEAKRIYGDTIPGHQGDKRIMVIKQPVGVTAAITPWNFPAAMITRKAAPALAAGCTMVVKPAPQTPFTALALAVLAERAGIPAGVFSVITGDAIAIGNEMCTNPIVRKLSFTGSTNVGIKLMAQCAPTLKKLSLELGGNAPFIVFDDANIDAAVEGAMIAKYRNAGQTCVCANRIYVQAGVYDEFAEKLSMAVAKLKVGEGIIAGVTTGPLINAAAVEKVQSHLEDAIKKGATVLAGGKVHELGGNFFEPTVLTNADKSMRVAREETFGPLAPLFKFNDVDDVIKQANDTEFGLAAYFYGRDISLVWKVAESLEYGMVGVNTGLISTEVAPFGGMKSSGLGREGSKYGIEEYLEIKYICMSV

SEQ ID NO: 13620 - protein, 291 aa, Dehalococcoides sp. CBDB1
MEKDVPLLVASAPSLMAQAKEMMEGYTLKARKGLGQHFLISQGVLNKILAAADLKPTDTVIEVGPGLGALTEELLKRAGQVIAVELDDKLIDALTEKFKGYPNFRLIHSDILKTSPEEILGQDVPYKLVANLPYYITSAVLRQFLEAKLKPESMVVMVQKEVAKNIVAKTGDMGLLTLSVRFYGNPSLVSVVPGGAFYPPPEVDSAIVKIVIPQTTIMEGVSEVDFFKLARAGFGTRRKTLLNALAQGLGISKPVILSLLNGAGIDPARRAETLSMEEWKKLCLEYAGNPC

SEQ ID NO: 13621 - protein, 350 aa, Erythrobacter sp. NAP1
MRLGAAATFHQTRYHKDAFFVTDTRYDVIAIGNAVVDVIASCEEGLIDELSLNRGGMTLIDEARADELYDAMPPARELSGGSAANTLAGLSTLGLQCAFIGQVADDQLGKVFRHDMRATGIDFDTPARDGEPATGRVLIFVTPDGERTMNTFLGAGQFLPAEALDEDLIASAGILYLEGYLWDPEEPRRAMRRAIEVAREAGRKVAFTASESFVIERHGDDFRAMIDDGLIDILFVNESELATLTGEDDFETGFNAVAPKVPVLVATRSAKGAVASAHGERAVTAAAPVAKVVDTTGAGDQFAAGFLSGYAKGEGLEVCLKRGAIAAAEVIAHYGPRPEADMKALMAERL

SEQ ID NO: 13622 - protein, 490 aa, Cryptococcus neoformans var. neoformans JEC21
MSGPQAGPSQPSSAAPQQQSQQPQAPQAQQDLKRRAEVDADAARRLKHPRPPLPPPHVLSALVSNSPAFNELMKIEQKLDWTLMRKKAEVNDALGRPTRVKRVLRVFISNTAHDQDWQKALDAGAGSVVGGDYSTGPRENPGQDAIMADGGVTKSNEPDLNTGKGIAGWILKVEGRLLDSGNVRLDKTKRKFTTFLKSAIIEFDNRDAPTFPEGNIVEWHATSHQGPPLDGFEILRRGDVNIPCRISLHIAHYPERYKVLEPLAGLIGLRESTRSEIMSGLWKLVKTTGAQDKEDGTIIKAVGGLQKLLPQGQETVPFHELPEIATRYLAHPDPVVIPYTIDVSKDYTFHNKCFDIPIEIEDPLKSKMASMIGSFEGPEGQEIVKLEDKVAELAFFAKELKQKKDFLESFAANPQAFINNWLAAQARDLDQMLGYQIGQAVVNGGSVREEDLRRSDLFTMPWVDEAITVHESARMEHDRRAQAASYGNMR

SEQ ID NO: 13623 - protein, 215 aa, Prunus cerasus
VLGFAFFFCFIMSTSTGSYVYFQFVQQWPTTTCILRKKCSQPRPLQIFTIHGLWPSNYSNPTRPSNCIGSQFNFTKVYPHMRTKLKRAWPDVESGNDTQFWEGEWNKHGTCSEERLNQMQYFERSYAMWRSFNISEILKNASIVPSATQKWSYSDIVAPIKAATKRTPLLRCKQDKKTQLLHLHEVVFCYEYNALKQIDCNRTSACGNQQTISFQ

SEQ ID NO: 13624 - protein, 275 aa, Erythrobacter sp. NAP1
MPDLPPIRETIAKHGLSASKALGQNFLLDEQLLDRIAALPGDLSGARVLEVGPGPGGLTRALLRAGARVTAIEMDRRCLPALEELSEAFPGQLTVIEGDAMKLDHGAIMDGEPFHVLSNLPYNVGTALFVKWLSGQDWPPQWLSLTLMFQREVAERIVAQPGGSAYGRLAVLAQWRAKAKLAMKVHRSAFTPPPKVMSAIVHVTPAEAPADVSSRTLERLTEAAFGQRRKMLRQSLKSVPGALDALQSVGIEETRRAETVSVAEFVALAKAVGSP

SEQ ID NO: 13625 - protein, 304 aa, Candida albicans SC5314
MSKLLTSFKSSKTQLRQQFCELTGTSNTTATKYLESVRYDLARAIDNYYNKHPNKAQVTKKPVKVKIDDRLIQIFDKYKDSEDPNKIDIEGTLTYLGDLGISPDQIESLSLALLLKSPKTGVFTRENFLHIWQYYQCFDIGAMSEFITRFNKDLVNNIGGFKDISTVSDDENKSVPLKFQDLYNFTFKFSLETESQKFLDLDTAIEYWKLLLPIITETYSKDNKLDEEFKNHVNERVEQWFKFLTDTEYMTKKSISYDSWSMFYLFFKEIVLIDPIKFKDYDEMAAWPSVVDEFLEYLHDFELL

SEQ ID NO: 13626 - protein, 464 aa, Triticum aestivum
  misc_feature (280)..(280): Xaa can be any naturally occurring amino acid
  misc_feature (341)..(341): Xaa can be any naturally occurring amino acid
  unsure (1)..(464): unsure at all Xaa locations
IRHEHQYTPGRPVSVSALQPSDTFPRRHNSSTPAEQAVMASECGFNTLDALIDATVPAAIRAPPMQFTGKFDAGFTESQMLEHMAHLASMNKTYKSFIGMGYYNTHIPAVILRNLMENPAWYTQYTPYQAEIAQGRLESLLNYQTMVADLTGLPMSNASLLDEATAAAEAMAMCLGIVKSKKKTFLIASNCHPQTIDICQTRATGFDINVVVSAAKDFDYSSGDVCGVLVQYPGTEGEVLDYAEFVKDAHAHGVKVVMATDLLALTTLRPPGEIGADIAXVGSAQRFGVPMGYGGPHAAFLATSQEYKRLMPGRIIGVSVDSSGKPVLRMAMQTREQAHPXETRPPANICTAHALLANMAAMYAVYHGPAGLKAIADRVHGLAGTFAHGLKKLGTVTVQELPYFDTVKITCADANANAEEARKSEMNLRVVDANTITVAFDETTTWRMLTAVQGFSGGKQWTHS

SEQ ID NO: 13627 - protein, 564 aa, Burkholderia thailandensis E264
MTPAGTRVARLAGPAAFVRPSSGAPGAGAPNPNQRRGAGRSRRRPRTKRRRAHAPARVPKRRRLGRAASALAALHPALSLSQTRRFMHRATKIVATIGPASSSPEVLLQMMHAGLDVVRLNFSHGSADDHRERAEMVREAARRVGREIAIMADLQGPKIRVGKFEAGKTTLTPGQPFILDATCELGNDERVGLDYKDLPRDLKPGDVLLLNDGLIVLKVDRVFGDEIHTTVKVGGDLSNNKGINRQGGGLSAPALTAKDMEDIRTAMSLGADLVAVSFPKNATDMEMARQLANIAGAPYGIKPKMIAKIERAEAIPALQEILDASDGIMVARGDLAVEVGNAAVPALQKRMIRMARESNKLVITATQMMESMIHAPVPTRAEVSDVANAVLDGTDAVMLSAETATGKYPAVTIEAMAAICVEAEKSEHVELDKDFLDRTFTRIDQSIAMGALFTAYHLGAKAIVALTESGATALWMSRHYTHVPIFALTPRVGSERAMALFRNVTPLHVDFDSDRDSALQQALELIVRRGYVAHGDMVVLTVGEPMGQAGGTNTLKIVRVGEHY

SEQ ID NO: 13628 - protein, 752 aa, uncultured archaeon GZfos10C7
MIYMERHNHREYSEEEKAGKNVVCLSMDLIGSTKFMLGLTTPQQDRFNRSLVKQIRPHIEKLGLTDSLVKFTGDGWLVLTDNKPNKIQVLCCLATIMANKFQEEMSEYTEISMDRIPPLRLAICTGRDVCVELPPGNQDWVGDSARRATRATGWCKENEIVINDSIREVAFRDFLITPVTEKDHIKPDKWEEDFRVHTLGKLKPEAAADSEAPGYFVTTLETIGKKEEANEYSLMVSEHLEAKASKLGIDEIERKKILRYWNQLMSSISDSSTARKILKSIQDAGLTPDIFTYNMLIKKTRDYDGAKAWVDTMREEGIWPNVVTYNTLIDKAPSYNEAKALVDTMREEAIKPDDFTYNTLIKKAPDYDEAIALVDTMREETIKPDIVTYTTLIKKAPDYDKVNALVAMMQEEGIRPNVFTYSELIDKAPDYNEAKSWVYKMREEVISPNVFTYTRLIKKAPDYDGAKACVETMREESIWPNVFTYSELIDKAPDYNEAKSWVYKMREEGIKPNIVTYTTLIKKAPDYAKVNALVAMMREEGILPNVVTYNTLIEKAPDYDEANVWMETMKEENVQPDIFTYNTLIKKAPDYDEAKALVGTMRRESIQPNVFTYNTLFSKDISMVLADDVLKWYLAQKYHPPQPIQAAIASYRKRHCLDQALRLALSYPHLQAARKLIREHATEALAYFRRISNLDPEHPNADYALGITFVELGRELEAIPHLQKALELATADRRKKDIEDRLLRIDRKLSNK

SEQ ID NO: 13629 - protein, 561 aa, Prosthecochloris aestuarii DSM 271
MFDLSFIHTVPFYEITALLVLAAITGSLSLLLRQPLIVSLIAVGVLAGPSALDIVQSHEYIELMAELGIALLLFLVGLKLDISLVRSLGLVALATGLGQVLFTSVTGFFIAQALGLDVRTSIYVAVALTFSSTIIIVKLLSDKKEVDSLHGRVALGFLIVQDLVVVIAMMTLSAFAVSSQSTGEYDGLLQVGSVIVYGGLMLLLVSIFVRFLANPIVNRFARSPELLVTFALGWAALLASAGDFFGFSKELGGLLAGVSLASTPFRESIVSRMSSLRDFLLLFFFISLGMNLDLSLLGSQVGPAIIFSLFVLIGNPLIVMIIMGVLGYRKRTSFLAGLTVAQISEFSLIFMAMGMDLGHVDPEAMGLVTLVGLLTIAISVYMITYSHTLYRFLEPLLGVFEKKIPSREIEANSEQLENARYDIILFGMGRYGSAVAHYLKQDGYRILAVDFNPDEIRQLNKRGYDAIYGDASDQEFLATLPLQGVQWVVSAVSQHELGLSREDPRMVLIDALKHTGFTGRIAVSTQRIQEKERLKAKGADIVFLPFYDAAELAAKRIKEIG

SEQ ID NO: 13630 - protein, 229 aa, Lactobacillus sakei subsp. sakei 23K
MAKLVFIRHGQSEWNLSNQFTGWVDVNLSEEGVRQAQNAGALLKKEGILFDQAYTSVLTRAIKTLHYALEGSDQLWIPETKSWRLNERHYGALQGQNKAEAAEKWGDEQVHIWRRSYDTLPPLLDASDEGSAANDRRYAHLDPKAIPGGENLKVTLERVIPFWEDEIAPKLIDGQNIIVAAHGNSLRALTKYIENISDEDIMDVEMATGEPVVYDLDENLNVVSKKKLN

SEQ ID NO: 13631 - protein, 291 aa, Streptomyces coelicolor A3(2)
MTQLSAAQTPQPKPADGNRALYGGKINRRITVRDITAAKERGEKWPMLTAYDAMTASVFDESGIPVMLVGDSAGNCHLGYETTVPVTLDEMTMLSAAVVRGTSRALIVGDLPFGSYQEGPVQALRSATRLVKEAGVGAVKLEGGERSHRQIELLVESGIPVMAHIGLTPQSVNSMGYRVQGRGEEAAQQLLRDAKAVQDAGAFAVVLELVPAELAAEVTRTLHIPTVGIGAGPDTDAQVLVWTDMLGLTGGRMPKFVKQYADLRKVMGDAAKAYAEDVVGGTFPADEHSVH

SEQ ID NO: 13632 - protein, 70 aa, Oryza sativa
MMVLTNYFLNCNDPGMKFMNVERSFAQQHYADLSDKPFFPGLVEYIISGPVVAMVWEGKGCVATGRRIIG

SEQ ID NO: 13633 - protein, 240 aa, Saccharomyces cerevisiae
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAV

SEQ ID NO: 13634 - protein, 157 aa, Nostoc punctiforme PCC 73102
MTKKLHEPLLVVEDSNEDFRMLQRLMRLMSVQNPIHRCTNGDEVLEFLYQQGSDAHSKGENLPNSKVALRPSVILLDLNLPGIDGRDILDRLKQDKSFKEIPIVVFTTSSNPKDIELCYQKGANGYLVKPMDAQELKKTIQAFVDYWLDANMPPVLD

SEQ ID NO: 13635 - protein, 427 aa, Pyrococcus horikoshii OT3
MSKKVEYWVKIPFGPIHPGLEEPEKFILTLDGERIVNVDIKLGYNLRGIQWIAFRRNYVQLMYLAERICGICSFSHNHTYVRAVEEMAGIEVPERAEYIRAIIGELERIHSHLLNLGVVGHDIGYDTVLHLTWLAREKVMDALEAITGNRVNYSMMTIGGVRRDIEEKHKRLLLDMIKYYREIMPQIEDVFLHDSTIEARLRNCAVVPRKLAIEMGAVGPTGRGSGIKDDARWSEKLGVYPDLGIKPVMPEDVTGEKARGDVYDRTAVRIGEIYQSLELIEHALDQMPEGKIKAFPKDNILVAKLKLLGDGEGIGRYEAPRGELIHYVKGKKGRDGPVRWKMREPTFPNLFTIAKGLEGNQLADVVVAIASIDPCLSCTDRVAVVKEGKKIILTEKDLLKLSIQKTREINPEVKGDPTPAGVGCIRG

SEQ ID NO: 13636 - protein, 455 aa, Prochlorococcus marinus str. MIT 9312
MYPLLAELSAHDLEVAETLIGVIRFLLIFLAARALAEVLVRLSLPTIVGELLAGVVIGASGFHLLIPPSAGTELNGGLVNVISSLASIPPEAVPDVYFESFPSLQAVATLGLYALLFLTGLESELEELVAVGAQAFTVAMAGVILPFAFGTLGLMFIFQVDLIPAVFAGASMTATSIGITASVFGELGYLKTREGQIVIGAAVLDDILGIVILAVVVALAAGGSLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPTSRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPSDGNKISDDVAADPVGLR

SEQ ID NO: 13637 - protein, 595 aa, Arabidopsis thaliana
MQNYSTACLSLCDSPPEADGECNGRGCCRVDVSAPLDSYTFETTSGRIKHMTSFHDFSPCTYAFLVEDDKFNFSCTEDLLNLRNVMRFPVLLDWSVGNQTCEQVGSISICGGNSTCLDSTPRNGYICRCNEGFDGNPYLSAGCQDVNECTTSSTIHRHNCSDPKTCRNKVGGFYCKCQSGYRLDTTTMSCKRKEFAWTTILLVTTIGFLVILLGVACIQQRMKHLKDTKLREQFFEQNGGGMLTQRLSGPSNVDVKIFTEDGMKKATNGYAESRILGQGGQGTVYKGILPDNSIVAIKKARLGDSSQVEQFINEVLVLPQINHRNVVKLLGCCLETEVPLLVYEFITNGTLFDHLHGSMIDSSLTWEHRLKIAIEVAGTLAYLHSSASIPIIHRDIKTANILLDVNLTAKVADFGASRLIPMDKEELETMVQGTLGYLDPEYYNTGLLNEKSDVYSFGVVLMELLSGQKALCFKRPQSSKHLVSYFATATKENRLDEIIGGEVMNEDNLKEIQEAARIAAECTTNGRGRPRMKEVAAKLEALRVEKTKHKWSDQYPEENEHLIGGHILSAQGETSSSIGYDSIKNVAILDIETGR

SEQ ID NO: 13638 - protein, 848 aa, Prochlorococcus marinus str. MIT 9312
MANPMNPNKPFDLRLPTPGCYLDPEKAGMDSDAVFQGMTAHLFYTLGKLATSASPHDLYMALSYAVKDRLMTRYLASQEAIRKKPQKTVAYLSAEFLIGPQLSNNLLNLGITQEAEVALKRFGIESLATILEVEEEPGLGNGGLGRLAACYMESLASLQVPAVGYGIRYEFGIFNQLIRDGWQVEVTDKWLKGGWPWELPQPDESCFVGFGGRTESYRDDKGNYRSRWIPSEHAIGVPHDVPVLGYRVNTCDRLRLWRADATESFDFYAFNIGDYYGAVEEKVASETLSKVLYPNDGTDEGRRLRLKQQHFFVSCSLQDMLRSLEKRSIPITEFSKNWTVQLNDTHPAIAVAELMRLLIDQYHIGWDKAWSITTSSVAYTNHTLLPEALEKWDLGLFSDLLPRHLEIIYEINWRFLQQLRLRYPGDDKILQKLSIIDEEGSKSVRMAHLATIGAHHINGVAALHSDLIKRQLLPEFAELWPEKFSNVTNGVTPRRWVALSNPSLSNLLEEEVGPDWITNMDLLKKLEEKKDNTNFLHKFEETKLNGKRKLASFIHSKTGILVDPASLFDVQVKRIHQYKRQHLNALQIIAQYLRIKNGTNKYEVPRTIIFGGKAAPGYFMAKLMIRFINGIADVVNSDPDMDGLLRVVFLPDYNVKLGEIVYPATDLSEQISTAGKEASGTGNMKFAMNGALTIGTLDGANVELRDLVKKENFFLFGKTESEIMDLKNNNYSPQTFINKCPELKEVIRLIEIGHFSNGDKELFKPLLNSLTGHDPFFVMADFEDYLNKQDEVSQCWNNKKSWNKMALLNTARSGYFSSDRSIREYCKSIWKVSPMPVEITCNVEELTN

SEQ ID NO: 13639 - protein, 540 aa, Kluyveromyces lactis NRRL Y-1140
MVDDIVRSSSPQRDSSVEDVYSDLYSTFSQMTTTTANDIEQRPYPFTWRTGIMFVSSTIGGMLFGYDTGVISGVLIAMNPKDLNFHSLEIWQKEIITSITCAGSFIGSIIAFPLADRCGRKHTLTVCCIIFAASSMLMAVSYTFEMLVTGRLVVGIAVGIAAQCIPIYLTEISPAKIRGTMLTLNSISITGGQFAAYVIAYFMIDNDHPQSTAAWRYLFALGSIPAIVFLLTLDFIPESPRWLLSKSRLVEAELALHKVYPAATVPEIRHKLRKLTSDLNKLRYHNDETDPLLFPVNKRRSVASTRTGRSSLGATYYNEQLGKKRHRWEGKSKRALIIGCVLMFFQQTSGFNAFMYYSATIFEQVGFTNPLVPAIIVAFTNFSFTLLAMKLIDTMGKRTLLLMTIWIMTVGLLLCSVGFELNNLALLVVSVIVYVGAYATGMGVVPWSSVEFLPLNRRAVGGSMISCTNWLTNSVLSLTYLTITDRIGNENTMLLFALFTIFNWLFVYIWYPEVKGLSLEEIGQVFENGVDVHFIYRNYH

SEQ ID NO: 13640 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTRVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 13641 - protein, 264 aa, Shigella flexneri 2a str. 301
MKPTTIASLQKYKQDKKRFATITAYDYSFAKLFADEGLNVMLVGDSLGMTVQGHDSTLPVTVADIAYHTAAVRRGAPNCLLLADLPFMAYATPEQAFENAATVMRAGANMVKIEGGEWLVETVKMLTERAVPVCGHLGLTPQSVNIFGGYKVQGRGNEASDRLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 13642 - protein, 346 aa, Glycine max
MRLGFASWRFILCTLVVFLILQDSVARKIATTSGNEVQLKEVSYDLQKLATEGLVLDSIIQLEGADIKRKNKHVHKDEARVKKGIGFDIEEEEDKNDHKKIVGKDVHGYKPSHEDHKHMDLELNVFFTPNDLKVGKIMPIYFSKKNSSTSPKFLTREEADQIPFSSKHLPSLLKFFSIPKHSPQAKAMKYTLKQCEFESMEGETKFCATSLESLFDFAHYLFGSNAQFKVLTTVHLTNSTALLQNYTISEVKVISVPNVIGCHPMPYPYAVFYCHSQHSDTNLYEVMVEGENGGRVQAAAICHMDTSKWDRDHVSFRVLKVQPGTSPVCHFFPPDNLVWVPLPLPP

SEQ ID NO: 13643 - protein, 391 aa, Triticum aestivum
  misc_feature (359)..(359): Xaa can be any naturally occurring amino acid
  misc_feature (378)..(378): Xaa can be any naturally occurring amino acid
  misc_feature (380)..(380): Xaa can be any naturally occurring amino acid
  unsure (1)..(391): unsure at all Xaa locations
MATGGNPNPNANPGQPRPQQQPPGSSPATPHNHMRPPTLAGSPFQGLFHTPPSHNPAFQIHMGAASSPQTPLMAAAAAAASAAASAKRPPQKPPSRPPAPTSNAAAAASMAAAYKAANSGSVDLTPAARRNKKRKLPEKQLPDRVAALLPESALYTQLLEFEARVDAALARKKVDIQEALKTPPSLQRTLRIYVFNTFANQAPRTIPPPKNGDPPTWSLKIIGRVLEDGAELDPASVVPKHNPVYPKFSSFFKRVTIALDSSLYPENPLIVWENARSAAPQEGFEVKRKGDKEFLANIRLEMNYNPEKFKLSQPLMEVLGVEVDTRARVIAALWQYIKAKKLQNPSDPSYFMCDPQLKXGIWGKDKMRFAMLVPKRYXKXPSPPTAHQTLG

SEQ ID NO: 13644 - protein, 544 aa, Fusobacterium nucleatum subsp. vincentii ATCC 49256
MHGKTYSIIAIQTLKTIGQQTVYEVKKADLFVKITLYSNLNFAKWVFFFIRAGSVYGGVNRVWLQRLWVYSYIEIDEAVQKLIDTASFQRLKRIKQLSSSYIFPSTNHTRYEHSIGVMHLACNFFEVLEKDFKKYGLIEERISFLRSHIKLAGLLHDVGHPPFSHLGEKFLDKNEIIACIKSEYSDLVDVDKIFYNNGKLMGKEHELLSCYCILRKFYKILKEEIDKNIDVAFICRCIIGNTYQEEENWDKNICIRIISSDSIDVDKLDYLTRDNHMTGEIAPKMDIKRLLACLTITENKELKYIAKAIPAVQTVVDSRDLLYLWVYQHHISIYTDYVIGRILKRCMTLYDRHRGQALEEMNREEYFSPKAITDYLITDDDVYSHLRKIYVLSLQGKTDEFNTITIKQIFERDFLKPLWKTIYEYKDFEKNLVDKKIIKSYDELEDILRNEKNIEDITNTLLKKLNLKEGEVFIITKYNKFYNSNKEAPITLLLNGKERKLSDLLPQKEFGKFHTMAFFVFVPRKYKKEAKEIVIEELQKISQA

SEQ ID NO: 13645 - protein, 153 aa, Triticum aestivum
MDASATGAVSKVKKYVVGRKLGGGPRKKAVARSVKAGLQFPVGRIVRFLKKGRYAQRVGMGAPVYLASVLEYLAAELLELAGNAAKDNKKSRIIPRHLLLAIRNDQELGKLLAGVTIAHGGVLPNINPVLLPKKTAEKEPKSPNKAAKSPKKA

SEQ ID NO: 13646 - protein, 656 aa, Ashbya gossypii ATCC 10895
MDRQHSSIQQQPRMSAVLQETISQLKHLIITHIQQLNYDSAEFFSELLYADCSCTNTGNNTGTIDESRERFDSLYYYALTLYLQGDYHSSVHVVKDALSSHLGCAYVYARCCLKLGTRYQDAIQALMALRDCWQNGVTNSTDLFMYPDKATVLSVMGQLSLKSHREKEAVSFLSQSLSTNSYQLEPLSILFEMRADLQTVKLFKPVKKSWKAKHLRTANIISKPQTPFKIPSRLSTSAVGAAPNPLLSTSSAIVSTSPSMMRRSKFLNSNSNASNATSNINNNNNVNNNGQQSTPPSKLLNIEHNKTTPDDKLSPSQMQLLSHNPLPHKPLDQLMYWMMKAYKSYYRYDSYRAIRLLNEQLPSHILQNMPWCLALLSRLHFEIQNHDMSLSYFNKLRRLQPTRLKDMDVYSTLLWHLHDKIRLADLCHELMAQDDKNCITWCCLGNLFSLNRDHDEAIKALKKATSLNPQFAYAYTLQGHEYSNNDAFDNAKMCYRKALAINPNHYNAHYGLGMSCIKLGQYDEALLHFEKARSINPVNVILNCCCGVALERLGRREKALDFYQLACELQPNSSLALFKKSQLLFNLGQYSNALQNFEKLEQLTPNEAPVHFLLGQLYQIVGRKKDAITQFTIAMNLDPNGIQLVKEALEKCHEQG

SEQ ID NO: 13647 - protein, 792 aa, Oryza sativa (japonica cultivar-group)
MHLRLLLLLVGVAAAAADADADADALLAAKAAMSDPTGALASWGGNGTRTNTTAAAAAHCAWAGVTCSSRGAVVGLDVSGLNLSGALPAELTGLRGLMRLSVGANAFSGPIPASLGRLQFLTYLNLSNNAFNGSFPAALARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENVIGKGGAGIVYKGAMPNGDHVAVKRLPAMGRGSSHDHGFSAEIQTLGRIRHRHIVRLLGFCSNNETNLLVYEYMPNGSLGELLHGKKGHRCI

SEQ ID NO: 13648 - protein, 923 aa, Vicia hirsuta
MELQALWITRLAVACVLCLCIFIRSGSSATGGFESIACCADSNYTDPKTNLNYTTDYKWFSDKSSCRQIPEILLSHRSNVNFRLFDIDEGKRCYSLPTIKDQVYLIRGTFPFDSVNSSFYVSIGATELGEVTSSRLEDLEIEGVFKATKDSVDFCLLKEDVNPFISQLELRPLPEEYLRDFSTDVLKLISRNNLCGIEDDIRFPVDQNDRIWKATSTPSYALPLSLNVSNVDLKGKVTPPLQVLQTALTHPERLEFVHDGLETDDYEYSVLLYFLELNNTLTAGQRVFDIYLNSEIKKENFDVLEGGSKYSYTALNITANGSLNMTLVKASGSKFGPLLNAYEILQARPWIDETSQPDVEVIQKMRKELLLQNQDNEALESWSGDPCMIFPWKGVACDGSNGSSVITKLDLSFNDLKGTIPSSVTEMTNLQILNLSHNHFDGYIPSFPSSSLLISVDLSYNDLTGQLPESIISLPHLKSLYFGCNQHMSDDDEAKLNSSLIITDYGRCKAKKNKFGQVFVIGAITSGSILITLAVGILCFCRYRHRTITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALIIENNASEYMKSIDSLGGSNRYSIVMDKRVLPSTTTMAESTITTQNVSHPQPR

SEQ ID NO: 13649 - protein, 1373 aa, Burkholderia mallei ATCC 23344
MSKHRQAPGPRGGLVMGNLAAYKRNPITMLLRLHQQYGDVARNRLGPFVTHALAHPDHIQYVLQENHRNYVRGRFYDNFKMFFGDGLLTTDGEFWRRHRRVVQPLFHKKQVDAHTAAVGDAALALAYRWSALPPGKALDVVEEMMHLSLRMLGLMVFNTDVSSHAEAAGPAVRFGIEAMMPQGNLNDFIPRWAPTRFNRRIAHARRAIDTIVAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGATISLRPVHGIRLIVKPRERQQSHLARVREHESARALRPLGDTATTAGAACPMTAAREPGASAAALAAVEAGALDAAHRGGAAAAAAGEPCPPRDPAEAAPLPLAAAPAPASPAVDADASARGVPAWRFTWRPVPVDPVPDEPSPALSGRRIALVNGRGGTAERVAAALARTCAKVSVFAPAASADHAEAARVFVNEAGPLDGIVDLGLEAPFALDDAGAWEAPMRRTVELLKACYGDWAAEDDTSRLFYVALTWMDGQMGYGETAGAQPLGGLWAGLAKTLPQELPNCNVRVLDIAPDETGRVDRLVVNELYRWGLFEVGYRGGVRYTLHAKRNELPPHAVDARTTLGAGDTVLFSGGARGIGLLCARSLAERHGCTVIVTGRETPPDGGEPWMALDEPGFKHYGLEQLRAATPEHPPKAIRAALQRLKRRRELRTALDEMAALGLPVHYRVCDVTDRAAVRALCDELGDSLRMVIHNAGVDRPVRLIQKRAEDFADTVRTKVLGFANLCDAVRARPRLVQFCNVGSLTGRWGGMTGETDYAAANEALARLGLWAARHAFSPACGVKTLVWPTWEGVGMITNFAVTQRYVSPMNVDEGVRHWLRELAAPGSGEVMFMGAVGRAPTPMQIKGFVPIRELPNIGELVTRRHHVGEPVRFRPFKRFESRYAIDPAVAPYAHAFRFNGRAVLPASLVLEHACAVGDWVMPPTGEPRELSEMTNVVLRLDALPDVPAGGAPVELASEAAGYMIGDVWCVDVRCSDARTQAELLSMTLVYRPQPEQIGAAFARAPDTTPEPAPLTSAPHAAWNGELLPAGDWSVPDDASAGIVRIGRVPSAAVLSLWALPFPLELRLPVNHVEHVLRVLLAEWGAARADAPAVWRIGGAKLARLPAASADGVVEYAAGRFAVLDARGYVLLRIDDARVDGEPAQAALPETGALADPLTA

SEQ ID NO: 13650 - protein, 923 aa, Melilotus alba
  misc_feature (64)..(64): Xaa can be any naturally occurring amino acid
  unsure (1)..(923): unsure at all Xaa locations
MELQIIWILRLVVACVLCLCIFIRSASSATKGFESIACCADSSYKDLKTTLNYTTDYIWFSDKXSCRQIPEILFSHRSNKNVRLFDIDEGKRCYDLPTIKDQVYLIRGTFPFDSLNSSFYVSIGATELGEVRSSRLDDFEIEGVFRATKDYIDFCLLKKDVNPFISQLELRPLPEEYLHGLATSVLKLISRNNLGGTEDDIRFPVDQNDRIWKATSTPSSALPLPSNVSNVDLKGSVTPPLQVLQTALTHPERLEFVHDGLETDDYEYSVFLYFLELNGTLKAGQRVFDIYLNNEIKKEKLDVLAGGSKNSYTVLNISANGSLNITLVKASGSEFGPLLNAYEILQARPWIEETNQIDLEVVQMMREKLLLHNQDNEALESWSGDPCMLFPWKGIACDDSNGSSIITKLDLSSNNLKGTIPSTVTEMTNLQILNLSHNHFDGYIPSFPPSSVLISVDLSYNDLTGQLPESIISLPHLKSLYFGCNQHMSDEDTAKLNSSLINTDYGRCKAKKPKFGQVFVIGAITSGSLLITLAVGILFFCRYRHKSISLEGFGGKTYPMATNIIFSLPSKDDFFIKSVSVKPFTLEYIEQATEQYKTLIGEGGFGSVYRGTLDDGQEVAVKVRSSTSTQGTREFDNELNLLSAIQHENLVPLLGYCNEYDQQILVYPFMSNGSLLDRLYGEAAKRKILDWPTRLSIALGAARGLAYLHTFPGRSVIHRDVKSSNILLDNSMCAKVADFGFSKYAPQEGDSYVSLEVRGTAGYLDPEYYKTQQLSEKSDVFSFGVVLLEIVSGREPLNIKRPRIEWSLVEWAKPYIRASKVDEIVDPGIKGGYHAEALWRVVEVALQCLEPYSTYRPCMVDIVRELEDALIIENNASEYMKSIDSLGGSNRYSIVMDKRALPSTTSTAESAITIQTLSHPQPR

SEQ ID NO: 13651 - protein, 400 aa, Prosthecochloris aestuarii DSM 271
MQELEQAVNRSVRVIPQGEGRVTIEKDLSSEEMILNMGPQHPSTHGVLRLECKTDGEVVTEAEPYLGYLHRCFEKHAEVVDYPGIVPFVDRMDYLAAMNSEFAYCIAVEKLLDVEIPRRVEFMRVIVSELNRIASHLVAIGTYAIDLGAFTPFLFCFRDREHIMSLLEWASGARMLYNYIWIGGASFDFPPGFKERTAEFVNYFRPKALELQRLLTENEIFVKRTKGIGMMPPDVAVNYGWSGPMLRGSGVEWDLRKHDPYSIYPELDFKVCVPDGKHSDIGDSLSRHLVRAYEMVESLSMIEQCLDKMPDANGFDPRSAIAKRIRPKAGEVYGRAENPRGELGFYIVSDGKSTKPVRCKARSSCFVNLSAMKELSMGQLIPDLVAIIGSIDIVLGEVDR

SEQ ID NO: 13652 - protein, 235 aa, Spinacia oleracea
MRSQIYRSATKAARSFLSSSKNASSRFLPEGRTVAATAAVSLRVKAPYLASFGGANASGTWMSTALAIPAAAYLLQDQEACAAEFERTFIAIKPDGVQRGLISEIVARFERKGFKLVAIKVVIPSKDFAQKHYHDLSERPFFNGLCDFLSSGPVVAMVWEGEGVIKYGRKLIGATDPQKSEPGTIRGDLAVVVGRNIIHGSDGPETAKDEIKLWFKPEELVNYTHNAEKWIYGDN

SEQ ID NO: 13653 - protein, 461 aa, Crocosphaera watsonii WH 8501
MKTIPTPKTPTLVQQLQWVLNPTGYLQTNHHRYPDLFKAKIIGLGNDIILISNPEIMQYILTHDRQEFTAPSSLNTLLKPLLGDYSVVMLDGDGHRQRRQLVMPSFHGERLKVYGDLTCRITREAMEKLPENQPFLAREVMQDISLKVIMEAVFGVTEGERYEELQYRLKELLDLFDSPITSGFLFFPSLQKDLGNWSPWGYFLRQRQALDKLIYAEISDRRANPDPERTDILSLLMFAKDEQGESMKDQELRDELITLLMAGHETTASAMAWALYWLHHIPEIKDKLIEELNTLSPDAEGMDIFRLPYLTAVCNETLRLSPSAMLTFTRLAQQTVEVGGYTFKPGDIVAGCLYLTHLREDIYANPKQFNPQRFLDHKYSAYEFIPFGGGSRRCMGEALAKFEMKLVIAIIISEYCLKLADTQPEKQQRRGLTLSPKRGVKMILEGKRQPQKARELELSTR

SEQ ID NO: 13654 - protein, 85 aa, Arabidopsis thaliana
  misc_feature (12)..(12): Xaa can be any naturally occurring amino acid
  misc_feature (27)..(27): Xaa can be any naturally occurring amino acid
  unsure (1)..(85): unsure at all Xaa locations
WLPPPLSYAAEXTWAGYDTMVAPFTGXKSYAEFPVTPKTNKDITSIASNGGRVSCLKAWPPIGKKKTETPIYLPDLSDPKTAKEA

SEQ ID NO: 13655 - protein, 489 aa, Bordetella parapertussis
MTQLTQPLSRAELLRDACYIDGKWVGAGNGPSIPVDNPSTGKTIISVPKLGRKEAEQAIDAAEAALPAWSARTGKERAAILLKWAQLTMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 13656 - protein, 144 aa, Chlamydophila pneumoniae CWL029
MEQTLSIIKPDSVSKAHIGEILSIFEQSGLRIAAMKMMHLSQTEAEGFYFVHRERPFFQELVDFMVSGPVVVLVLEGANAVSRNRELMGATNPAEAASGTIRAKFGESIGVNAVHGSDTLENAAVEIAYFFSKIEVVNASKPLV

SEQ ID NO: 13657 - protein, 252 aa, Bacteroides thetaiotaomicron VPI-5482
MKVRILGSGTSTGVPQIGCTCPVCTSADPKDNRLRASAIVETEDARILIDCGPDFRAQVLHLPFEKIDGVLITHEHYDHVGGLDDLRPFCRFGAVPIYAEEYVARALRLRMPYCFVDHRYPGVPDIPLQEIEVGHAFSIHHTEVVPLRVMHGRLPILGYRIGRLGYITDMLTMPEESYEQLEGIDVLIMNALRIAPHPTHQNLEEALKVAERIRAKETYFIHMSHDMGLHKKVEKELPENIHLTYDGMEIIF

SEQ ID NO: 13658 - protein, 506 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 13659 - protein, 430 aa, Shewanella oneidensis MR-1
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRSLFEQYPTEISCIIIEPVAGNMNCIPPIPGFLEGLRSLCDEFGALLIIDEVMTGFRVSKSGAQGHYGVTPDLTTLGKVIGGGMPVGAFGGRKDVMQFIAPTGPVYQAGTLSGNPIAMSAGLAQMEALCEEGLYEALSAKTKRIAEGFKAAADKHGIPMAINYVGGMFGFFFTEQEHITRFDQVTKCNIEHFRTFYHGMLDEGVYLAPSAYEAGFLSMAHGEEELRLTLEAADRVLARMKAAN

SEQ ID NO: 13660 - protein, 945 aa, Flavobacteria bacterium BBFL7
MNTDRFALRHIGPRKADLAPMLEKIGVESIDQLVYETIPENIRLQQDLQLDTAMSEYEFLSHIKKLGDKNKQFRSYIGLGYNAPITPAVIQRNILENPGWYTAYTPYQAEIAQGRLEALLNFQTMITDLTGMELANASLLDESTAAAEAMTLLFSVRERAQKKENVVKFFVDHDTLPQTKELLKTRATPLGIELVEGNPQDMDMSDGYYAILLQYPGASGNVVDYTAFAQKCHDNNIRIAVAADILSLVLLEAPGHWNADVVVGTTQRFGIPLGYGGPHAAYFATREEYKRQIPGRIIGVTKDTDGKRALRMALQTREQHIKRDKATSNICTAQVLLAVMAGMYGVYHGPRGLKFIANKLHAQTATLADAVEKLGIYQTNENFFDTLCFKVNAEAVKKEALALEINFYYPDADTVQVSLNETTSLTDLNDIVSAFAKAVNKDFSPITALLDSTHLGTGRQTEFMTYDVFNSYHSETELMRYIKKLERKDLALNHSMIALGSCTMKLNAAAEMLPLSNPQWGNIHPFVPVDQAQGYQEMLQKLELQLNEATGFAGTSLQPNSGAQGEFAGLMAIRAYHQSRGDHHRNICLIPSSAHGTNPASAVMAGMKVIVTKALENGNIDVDDLREKAEKHKDNLSALMVTYPSTHGVYESAIKEITGIIHENGGQVYMDGANMNAQVGLTNPGNIGADVCHLNLHKTFAIPHGGGGPGVGPICVAPQLVPFLPSNPIIKTGGDQAITPISAAPYGSASVCLISYGYICMLGAEGLKRSTEYAIINANYIKERLKGSYECLYTGEKGRAAHEMIIDCRPFKQHGIEVVDIAKRLMDYGFHAPTVSFPVNGTMMIEPTESESKEEMDRFCDAMISIRKEIADCSSDDPNNVLKNSPHTLEMITNDEWELPYTRKQAAYPLEYIADNKFWPTVRRADDAYGDRNLMCTCAPMEEYM

SEQ ID NO: 13661 - protein, 490 aa, Neurospora crassa
MSDDDFMQDSDQEYDFEYEDDEEEDTGDVDIENKYYNAKQTKTSDPEEALQEFLSIPPLEQEKGDWGFKALKQAIKLEFKLKRYQEATEHYEELLTYVKSAVTRNYSEKSIDNMLNYIEKGYDDPKAVQCIEKFYSLTLQCFQSTNNERLWLKTNIKLARLLLDRKDYHAVARKLRELHNACRKSDGTDDPSKGTYSLEIYALEIQMYSETRNNNQLKVLYQKALKVRSAVPHPKIQGVIRECGGKMHMSEENWKEAQSDFFEAFRNYDEAGDLRRIQVLKYLLLTTMLMKSDINPFDSQEMKPYRNDPRIFAMTELVDAYQRDDIYRYEDVLQKNTDLLADPFIAENIDEVTRNMRTKGVVKLIAPYTRMRISWLAERLRITEPEVMDILSFLIVDGRVKGRIDEHKGVLELESREDADHVQAITVLSEAVGNLFNAVFKSTDGFQPGQGDFMNSMADQSADIGSLDDTMRSMGSGKRGRRVGLTQRAY

SEQ ID NO: 13662 - protein, 290 aa, Solanum tuberosum
LNSSYRVPFESFRVPFVDLQEATNNFDEKFHIGLGGFGKVYRGVLRDGTKVALKRCKRESSQGIEEFRTEIEILSFCSHPHLVSLIGYCDETNEMILVYDYIENGNLRSHLYGPDLPTMSWEQRLEICIGAARGLHYLHTSAVIHRDVKSINILLDENFVAKITDFGISKKGTELDQTHLSTLVQGTIGYLDPEYFIRGQLTEKSDVYSFGVVLFEVLCARPAIVQSLPREMVNLAEWAVDSHNKGHLEQIIDPDLAAKIRPESLRKFGETAVKCLALSSEDRPSMGDVL

SEQ ID NO: 13663 - protein, 158 aa, Oryza sativa
VANLVGEGDEIAEGVLRLLGLWFLQLYSGSLDKRLGISAGICILIQHVPERNGDRYEAIYSFYFGDYGHISVQGPYLTYEESYLAVTGGSGVFEGAYGQVKLNQIVFPFKIFYSFYLKGIPDLPRELLCTPSPPSTNVEPTPDDKDYETHAWLNNFTN

SEQ ID NO: 13664 - protein, 156 aa, Triticum aestivum
MDASATGAGAKAKKGAAGRKAGGPRKKSVARSVKAGLQFPVGRIGRYLKNGRYAKRVGTGAPVYLAAVLEYLAAELLELAGNAAKGNKKFRIVPRHLLLAVRNDQELGRLLAGVTIAHGGVLPNINPVLLPKKTAEKEPKSPKKAAKSPKKADKKA

SEQ ID NO: 13665 - protein, 426 aa, Shigella flexneri 2a str. 301
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKHTLTCTYNDLASVRAAFEQYPQEIACIIVEPVAGNMNCVPPLPEFLPGLRALCDEFGALLIIDEVMTGFRVALAGAQDYFAVVPDLTCLGKIIGGGMPVGAFGGRRDVMDALAPTGPVYQAGTLSGNPIAMAAGFACLNEVAQPGIHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 13666 - protein, 860 aa, Oryza sativa (japonica cultivar-group)
MAMAAASAMRPLAPLFLFFFFSLAASASDNILANSSLADGQKLVSAGGVFELGFFTPPGSTTAARFLGIWYRDIDPPTVVWVANRDAPVSGTAGSLAVVVNGGGGGGGGRLVLGDGSGRVVWSSAPSNVTASDPVAARLLDSGNFVLAGGGGSGDVIWQSFDYPSDTLLPGMKFGWDLTTGLDRYLTTWRSAGDPSPGDYTFKIDPRGAPEGFIWYNGTSPVYRNGPWDGLQFSGEPEMEPNNTSFRFEFVANRTDVYYTFVVDGGGGGGVLSRFVLNQSSAQRYVWLPQAGGWSLYWSLPRDQCDQYAHCGAYGVCDVGAASMCGCPAGFAPASPRNWELRDSSAGCARRTRLNCTGDGFLPLRGVKLPDTTNATVDAAIAVDQCRARCLANCSCVAYAASDVRGGGSGCIMWSSPLVDIRKFSYGGEDLFMRLAASDLPTNGDDSSRKNTVLAVVLSLSGVVLLALAAFFVWDKLFRNKVANPVRFQSPQRFTSFDSSIPLNQVQDRKMEDETRHSNELNVTLFDFNTIAFSTDNFANLAKLGEGGFGPVYKGELDGGQTVAVKRLSKFSTQGLDEFKNEVMLIARLQHVNLVRLLGCCIHGEERMLVYEYMENKSLDNFIFDKARSAQLNWSKRFNIILGIARGLLYLHQDSRFKIIHRDLKAGNILLDGDMNPKISDFGVARIFGDDTDSHTRKVVGTYGYMSPEYAMDGVFSVKSDVFSFGVLVLELVSGRKNRGMYSSGEQTSLLSHAWRLWREGNALALLDEAVAGGGGGGGYSRSEVLRCVQVGLLCVQERPEDRPHMAAVFMMLGNLSAVVPQPRHPGFCSDRGGGGGSTDGEWSSTCTVNDVTVTIVEGR

SEQ ID NO: 13667 - protein, 122 aa, Oceanobacter sp. RED65
MKILVVDDFSTMRRIIKNLLRDLGFTNTQEADDGNTALPMLKSGDFDFLVTDWNMPGMTGIELLKHVREDERLKDLPVLMVTAEAKRDQIVAAAQAGVNGYVVKPFTAAVLKEKIEKIFERL

SEQ ID NO: 13668 - protein, 393 aa, Spinacia oleracea
MAVPTTRKDLMIVNMGPHHPSMHGVLRLIVTLDGEDVIDCEPIVGYLHRGMEKIAENRTIIQYLPYVTRWDYLATMFTEAITVNGPEQLGNIQVPKRASYIRVIMLELSRIASHLLWLGPFMADIGAQTPFFYILRERELIYDLFEAATGMRMMHNYFRIGGVAADLPYGWIDKCLDFCDYFLIGLTEYQKLITRNPIFLERVENVGIIGGEEAINWGLSGPMLRASGIQWDLRKVDHYECYDEFDWEVQWQKEGDSLARYLIRIGEMAESVKIIQQALEGIPGGPYENLEIRRFNRIKYPEWNDFEYRFISKKPSPAFELSKQELYVRVEAPKGELGIFLIGDQSVFPWRWKIRPPGFINLQILPQLVKKMKLADIMTILGSIDIIMGEVDR

SEQ ID NO: 13669 - protein, 446 aa, Mycobacterium leprae
MGSTDQATAPAGPAVSISAKLFEDACAVIPGGVNSPVRAFSAVGGTPLFITEARGCWLTDADGRRYVDLVCSWGPMILGHAHPAVVDAVATVAASGLSFGAPTPAETQLAAEIIGRMAPVERIRLVNSGTEATMSAVRLARGFTGRTKIIKFSGCYHGHVDALLADAGSGVATLSLPSSPGVTGAAAADTIVLPYNDIEAVRQTFARLGDQIAAVITEASPGNMGVVPPAPGYNAALRAITAEHGALLIIDEVMTGFRVSRSGWYGLDPVAADLFIFGKVMSGGMPAAAFGGRAEVMERLAPLGPVYQAGTLSGNPVAMAAGLATLRAAADAVYATLDRNADRLVAMLSEALTDAGVPHQIPRAGNMFSVFFSEAPVTDFASACNSQVWRYPAFFHALLDAGVYPPCSTFEAWFVSAALDDAAFGRIVDALPGAAAAAVAARHRES

SEQ ID NO: 13670 - protein, 387 aa, Bacillus cereus ATCC 14579
MEQFINPRVKDIQISGIRQFSNMIQNYDNLISLTIGQPDFPTPSLVKEAAKRAITENYTSYTHNAGLLELRKAACNFVKDNYDLHYSPENETIVTIGASEAIDVAFRTILEPGTEVILPAPIYPGYEPIIRLCGATPVFVDVRETGFRLTAEALKNAITEKTRCIVLPYPSNPTGVTLSTEELKDIVDVLKDKNIFVLSDEIYSELVYEQKHTSIAHFPEMREKTIVINGLSKSHSMTGWRVGLLFAPSYLAGHILKVHQYNVTCATSIAQYAAIEALTAAKDAPKMMRHQYKKRRDYVYNRLTQMGLTVEKPTGAFYLFPYVGHLTSSSFDFALDLVKEAGLAVVPGTAFSEYGEGYLRLSYAYSIETLKEGCDRLEAFLMKKAKS

SEQ ID NO: 13671 - protein, 783 aa, Neurospora crassa
MAHGDAAPEAHSEAAQQQAQDDSRSTSSSSTPPPVDNEESDFFLAANDSQSSLGVPNIENMQVADEECRVAPINRLPNELLIAIFVKLTTSSDILHVMLTCKSWARNAVEILWHRPACSSWERHTIICQTLSAPRPYFAYRHFIRRLNLSALAPELNDGSVESLEMCSRVERLTMTGCKRITDAGLLKLLRNNTGLLALDISGMEDITETSINAVAEKCSRLQGLNISNCTKISIASLVQLAQSCRFIKRLKLNECAQVTDEAVIAFAENCPNILEIDLHQCRLIGNDPVTALMSKGKALRELRLASCDLIDDSAFLSLPPNKTYEQLRILDLTSCSRLTDRAVEKIIDVAPRLRNLVLAKCRNITDAAVFAIARLGKNLHYVHLGHCGNITDEAVKRLVQCCNRIRYIDLGCCVHLTDDSVVRLATLPKLKRIGLVKCSNITDESVYALARANQRRPRRDADGNLVPGDCYNNMHHSSLERVHLSYCTNLTLRSVLRLLNACPRLTHLSVTGVQAFLREDLESFCREAPAEFTEHQRAVFCVFSGQGVTNLRRYLNSEHNLTEIARGARPIDEGVPNRVGPVFPGTAVNPMQVTPPGHHGAAAAFIDDGEPDAVDDDDGLEDGSEMVIDTQPMLHNHHAVMGGTAFPIQGVASTEQLLPPPPPAIQPQQHLVTNPFHFVPGQPFAIPPHGLQFYEAVRATESGAVSGTPTHVPLVGQATGLESTIAEGSHHSGVARNSPGTATSQNPDASQAVPPNPMGNIELAILTGNRNPDLGGSGGASV

SEQ ID NO: 13672 - protein, 288 aa, Bacillus clausii KSM-K16
MKTIQWYPGHMAKARREIKEKLKLIDVVIELVDARLPQSSRNPLIDELAQQKPRLMLLNKADLADPAETERWRAFFKRTGAEVLAINAQTGAGVKNIAPACKTLASALYQKWEQKGMKPRPLRAIILGIPNVGKSTLINRLVNKRQAKVGDRPGVTKQQQWIKVKQELELLDTPGILWPKFDDQEVGLRLAATGAIKDELLDYGDVAAYALRYLAAEYPDLLEARYGIERNSEEDDVVPLFEAIGKKRGCIVRGGLVDFDKTAELILRELRSGTIGKVTLEKAEHEAL

SEQ ID NO: 13673 - protein, 200 aa, Ashbya gossypii ATCC 10895
MSNAKAAKVYEEVVKGVVNKVRQDFETAGIDEQRCKDLRRIWQSKLSESRVARFTWDPEGVKALREGGRYGGENSLALGGLVLKEDALLEPKDHKEKATIELTVDDAGGELAEKLKQQAKQAKKSALLETDEINSDLDDTDDEYVNFGEEENGSDVNIMLCLYEKVLRVKNKWKCNLKDGVATINNKDYAFQKSQGESEW

SEQ ID NO: 13674 - protein, 276 aa, Antirrhinum hispanicum subsp. mollissimum
MAVLTARPLNPAAIQCACFVILWIGLLCVNVGINGSGDLGEKLGANQRDFDYFHLALQWPGTFCRRTRHCCPTNGCCRGSNAPAEFTIHGLWPDYNDGSWPSCCTGKKFEEKEISTLLGDLNKYWPSLSCGSPSNCHGGKGLFWEHEWEKHGTCSSSVTGAEYNYFVTALKVYFKYNVTEVLREAGYVASNSEKYPLGGIVTAIQNAFHATPELKCSGDAVEELYLCFYKNFEPRDCATKSNKKSCPRYVSLPEYSSLKMANDGNEVSESALDSDI

SEQ ID NO: 13675 - protein, 335 aa, Chlamydophila pneumoniae CWL029
MKVVINGFGRIGRLVLRQILKRNSSVEVLAINDLVPGDALTYLFKFDSTHGRFPEDVRCEADHLIVGKRKIQFLSERNVQNLPWKDLGVDLVIECTGLFTKKEDAEKHIQAGAKRVLISAPGKGDIPTFVMGVNHKTFNPEKDFVISNASCTTNCLAPIAKVLLDNFGITEGLMTTVHAATATQLVVDGPSKKDWRGGRGCLQNIIPASTGAAKAVTLCLPELKGKLTGMAFRVPIEDVSVVDLTVRLDKSTTYDDICKAMKQASETDLKGILDYTDEQVVSSDFIGSEYSSIFDALAGIALNDRFFKLVAWYDNETGYATRIVDLLEYVEKNSK

SEQ ID NO: 13676 - protein, 278 aa, Cladonia mitis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 13677 - protein, 215 aa, Xylella fastidiosa
MSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 13678 - protein, 621 aa, Oryza sativa
MATAAAASRAALSRPHAAAAAARASPAAGARVTLPRRRSVRSAVISSSASAAAVAASEPAAGRVTLGAGTDGALWPKPAVLVAEKLSEAGLAVLRGFADVECAYGMSPAELLAKVAQFDALIVRSGTKVTREVLEAGRGRLRVVGRAGVGIDNVDLQAATEAGCLVVNAPTANTVAAAEHGIALLASMARNVSQADAALKAGKWQRTKYVGVSLVGKTLAVMGFGKGAPGLQDSARGLGMHVIAHDPYAPADRARAIGAELVSFDEAIGRADFISLHMPLTPATSKVFNDESFAKMKNGVRIINVARGGVIDEDALVRALDSGKVAQAALDVFTEEPPAKDSKLVLHENVTVTPHLGASTVEAQEGVAIEIAEAVVGALRGELAATAVNAPMVPAEVMSELAPYVSLAEKLGKLAVQLVAGESGGIKGVKVVYTTARGPDDLDTRLLRAMVTKGIVEPVSSTFVNLVNADYTAKQRGLRITEERVSHESPAAEAPLESIQVRLSHVQSKFAGAISDGGDIVLEGRVKYGVPHLTVVGPYEVDVSLEGNLILCRQIDQPGMIGKVGNILGQTNVNISFMSVGRTFRGKQAIMAIGVDEEPDKETLEHIGHIPAIEEFVFLEL

SEQ ID NO: 13679 - protein, 490 aa, Kineococcus radiotolerans SRS30216
MSTTPGRSAAPGGGVHDALPPLTDGPHRRRLGVVALIATFGGLLFGYDTSVINGALEPMVRELGLTTLTEGVVTSSLLFGAAVGAISGGRLSDAWGRRRSILLMSLFFFGGALVCVFTPNFEVMVVGRVVLGLAVGAASTVVPVYLAEMAPYEIRGSLSGRNEMMIVVGQLAAFVVNAIVGNVWGEHAGVWRIMLAFVTLPAVALFVGMLRVPESPRWLIDHGHYDEALAVLRTLRSEERAEAEARQIAGLTHEDSKRVPMDWRSVLSHRWLRRILLIGTGLGVAQQLTGINSIMYYGQSILGEAGFSSSAALIANVAPGVIAVVGAFIALRIMDTFSRRRTFVLGYSLTTACHLLIGIGSVLLPVGNPLRPWVILFLVVAFVGSMQTFLNVATWVTLSEIFPQRMRAFGMGTSVFVLWITNALLGLWFPTLVSALGITGCFFGFAVVNLLALVFVKTQVPETRGRSLEQLEEAVTSGAIHDRAVRDGLA

SEQ ID NO: 13680 - protein, 104 aa, Triticum aestivum
SDEPPPWARDEGGASGQEGDAVQVPFYAYLLAFAVTAIAAIGSIFEYTNGRAVFGVVGTDSPLYAPILGFFAVTGIPTSGYLWYKAVQTANKDAEEQDRRDGFL

SEQ ID NO: 13681 - protein, 111 aa, Prunus dulcis
GIIVLALTATLNSSRPQPCVVGSELCQPTSILQDVVLYTGKALASIGLGGTRYALATMGANQFDKPKYQASFFNWYFFTLYSTTAVALTVIVYIEDNAGWRWGFGYVSLPT

SEQ ID NO: 13682 - protein, 336 aa, Vibrio cholerae O1 biovar eltor str. N16961
MQKMRTLGEFIVEKQHDFPHASGELSSLLASIRLAAKIVNREINKAGLADIIGASGNDNIQGEEQQKLDLYANEKFKAALEARDQVCGVASEEEDEAVAFSKELNKNAKYVVLMDPLDGSSNIDVNVSVGTIFSIYRRVSPVGTPPTQEDFLQPGNKQVAAGYVIYGSSTMLVYTTGNGVNGFTYDPSLGTFYLSHENMRIPENGKIYSINEGNYIRFPTGVKKYIKFCQENVPEEGRPYTSRYIGSLVADFHRNLLKGGIYLYPSTQSHPNGKLRLLYECNPMAFLIEQAGGLASDGARRIMDIKPTELHQRVPFFVGSKNMVHKVETFLETYPD

SEQ ID NO: 13683 - protein, 865 aa, Oryza sativa (japonica cultivar-group)
MASTAAIAALALVFFVLLCVRDGGGVDAADTLSQGQSLGANDMLVSANGTFKVGFFTPAGGDPGKVYLGVMYATSNVQTVMWVANRDAPVRTAAGAASATVTGSGELLVKEGDRVAWRTNASAAGRSKHTLTIRDDGNLVISGSDAAGTDVEWESFHHPTDTFVPGMEIALRQTNGDRTLYTSWRSDADPATGDFTLGLDASAQLYIWRSQGGKNSTYWRSGQWASGNFVGIPWRALYVYGFKLNGDPPPIAGDMSIAFTPFNSSLYRFVLRPNGVETCYMLLGSGDWELVWSQPTIPCHRYNLCGDNAECTADDNEPICTCFTGFEPKSPQEYNNGNWTQGCVRSVPLTCSSERNNTTAGGAGAGGGDGFTVIRGVKLPDFAVWGSLVGDANSCEKACLGNCSCGAYSYSTGSCLTWGQELVDIFQFQTGTEGAKYDLYVKVPSSLLDKSSGRWKTVVVVVVVVVVVVLLASGLLMWKCRRRIKEKLGIGRKKAQLPLLRPARDAKQDFSGPAQSEHEKSEEGKNCELPLFAFETLATATDNFSISNKLGEGGFGHVYKGRLPGGEEIAVKRLSRSSGQGLEEFKNEVILIAKLQHRNLVRLLGCCIQGEEKILVYEYMPNKSLDAFLFDPERRGLLDWRTRFQIIEGVARGLLYLHRDSRLRVVHRDLKASNILLDRDMNPKISDFGMARIFGGDQNQVNTNRVVGTLGYMSPEYAMEGLFSVRSDVYSFGILILEIITGQKNSSFHHMEGSLNIVGYAWQLWNGDRGQELIDPAIRGTCPAKEALRCVHMALLCVQDHAHDRPDIPYVVLTLGSDSSVLPTPRPPTFTLQCTSSSSGRDMYYRDKEESYSANDLTVTMLQGR

SEQ ID NO: 13684 - protein, 477 aa, Streptomyces peucetius ATCC 27952
MCPPSSPTTYPSSPCDPPPLRKGLVRMTTTLVPPGPRGHPVLGSIREIQRDNVSAFMEAFRHHGDIVNFRGPLRINLLAHPDYVQHVLRDQHKRYPRPRKVQGCLSTIVGDGLVAAEGTSWLRSRRLTQPAFHRDILRRFGDSFTASTAELLDGWERRARDGEPLDIKSEMMHLSLANLARALFRTEWTDEVSRIEPAVQEALGFTHRRMTSPVDPLKFPSAARTRFRGALETINSLLYPMVAERRRDGGGDDLVSLLIDAVDPESGGMFTDEQIRDEVSGFFVAGHETVSTALSWTWYLLSLNPESRRRLQAEVDEVLAGRVPTVDDLPKLTYTTMVLQESMRLYPPIFVYMRCAAEDDVIGGYHIPEGRWVVVCPYVTHRHPEFWDNPEGFEPERFTPENSANRHRMAYLPFGAGPRKCIGDSFAMLQMPLVVAMIAQRFRLDLVEGQQVFPEPAISLRPRDPLMMWLRPNEETP

SEQ ID NO: 13685 - protein, 477 aa, Oenococcus oeni PSU-1
MKKTKIVSTLGPASNDLKIISALINNGINVARFNFSHGDHDEHAARMALVHDAEKKTGKLIGFMLDTKGAEIRTTVQDTPNGKIEFKKGDRLRISMNEKIKGTKEKIAVTYKGLYDDVKVGGKVLFDDGIIEMTVISKDSEKKELLVQVDNDGVLGGRKGVNAPGVAINLPGITKKDKSDIEFGLEQGIDFIAASFVRKAQDVLDIRKLLKKHHQENHVMIFPKIESQEGIDNFESIIAVSDGLMVPRGDMGVEIPYEEVPVIQKMMIRYMNRLGKPVITATQMLDSMIENPRATRAEINDVENAVWDGTDATMLSGESANGSWPVEAVKTMSTSDEYAENHVHDDGNRIDLRNEPKSSDTEVLAQAAVDAAREAGAKAIVASTASGYTARLISKYRPDMPILAITYDEKVARSLTVNYAVYPVVKDAPETTDDLIELAKKTVHDEKLAKRDDTIVVTAGLPIKKPGTTNLIHVVKL

SEQ ID NO: 13686 - protein, 853 aa, Oryza sativa (japonica cultivar-group)
MAASPPPPPRPLLLLLPLLLVWGVVVAAAAATDTLRQGESLTGAATLVSSPSGVFEVGFFAPDPKLPSRLYLGIWYRSISPRTVVWVANRAAPATAPSPSLTLAANGELRVLDGSAADADAPLLWRSNASTQSAPRGGYKAVIQDTGSLEVRSDDGTLWDSFWHPSDTMLSGMRITVRTPGRGPSEPMRFTSWTSETDPSPGRYALGLDPANSGQAYIWRDGNVTIWRSGQWTGQNFVGIPWRPLYLYGFKPANDANLGAYYTYTASNTSLQRFVVMPNGTDICYMVKKSAQEWETVWMQPSNECEYYATCGANAKCTAMQDGKAKCTCLKGFQPKLLDQWNMGNWSQGCVRSPPLGCQVNQTGDGFLSIPNIKWPDFSYWPSTVQDENGCMNACLSNCSCGAYVYMTTIGCLLWGSDLIDMYQFQSGGYTLNLKLPASELRSHHAVWKIATIVSAVVLFVLLACLFLWWKRGRNIKDVMHKSWRSMHTSTRSQQNSGMLDISQSIPFEDDTEDGKSHELKVYSFDRIKAATCNFSDSNKLGAGGFGPVYMGKLPGGEEVAVKRLCRKSGQGLEEFKNEVILIAKLQHRNLVRLLGCCIQGEEKILVYEYMPNKSLDAFLFNPEKQGLLDWRKRFDIIEGIARGLLYLHRDSRLRVVHRDLKASNILLDKDMNPKISDFGMARMFGGDQNQFNTNRVVGTFGYMSPEYAMEGIFSVKSDIYSFGVLMLEIITGKRALSFHGQQDSLNIAGFAWRQWNEDKGEELIDPLIRASCSLRQVLRCIHIALLCVQDHAQERPDIPAVILMLSSDSSSLPMPRPPTLMLHGRSAETSKSSEKDQSHSIGTVSMTQLHGR

SEQ ID NO: 13687 - protein, 178 aa, Glycine max
  misc_feature (62)..(62): Xaa can be any naturally occurring amino acid
  misc_feature (75)..(75): Xaa can be any naturally occurring amino acid
  misc_feature (122)..(122): Xaa can be any naturally occurring amino acid
  misc_feature (125)..(125): Xaa can be any naturally occurring amino acid
  unsure (1)..(178): unsure at all Xaa locations
MASSMISSPAVTTVNRAGADMVAPFTDLKSMAGFPDQKTNNDITSIASNGGRVQCMQVWPPXGKKKFETLSYLPXLNNTQLAKEVEYLLRKGWIPCLKFKLKHGFIYQEHNKSPKYYNGHYXTMXKLPMFDCTDASQVLKELQEAKTAYPNNFIHIIKFHNIHQMQYISFITYEPPSF

SEQ ID NO: 13688 - protein, 81 aa, Glycine max
  misc_feature (10)..(10): Xaa can be any naturally occurring amino acid
  unsure (1)..(81): unsure at all Xaa locations
CPQEVYDTLXEALEHVSEYKGYILESGQGSARVLFRHVLILLSHPQQRCIQEYVDIPKSIAKKPPQVEPMATEDSAPISSQ

SEQ ID NO: 13689 - protein, 540 aa, Yarrowia lipolytica CLIB122
MSLDKNRQITTSESSSGSSADEGTHIMRGLTSTSTQDETTGSISEGNLEAEKISPFVFVLVALASISGFLFGYDTGYVSGALVVIKEDLGRALSNGDKELITASTSLGALLGGVIAGAMCDFFGRKWVITFANILFLVGAAIQCGAHAVWTMIGGRFVMGWGVGIASLCAPLYISELAPTRIRGRLVVLNVLAITGGQLVAYGIGAGMAHVHQGWRILVGLSMVPAFVQMVIFVFMPETPRYLVRKNKIAEAKKVLAKTYATDDDNLLDRKLHELMLHNAYKESGLSTMARARNTMKELYCVPSNLRALIIACGLQGIQQFCGFNSLMYFSATIFEVVGFDNATAVSIIVAGTNFVFTIVAFMVIDRIGRRRILLGTIWGMSLGLVVNAIAFHFLDKQKEKNPNHELDKEHISGWAYVVLVAQLVYVAFYATGIGNVPWQQSELFPISVRGVGTGMATATNWAGSLIVSSTFLTMLENITPTGTFSFYAGLCALGEVFVFFLYPETSGMDLEQIQQLLTGGFNIKESMRLSDEAKRGYKK

SEQ ID NO: 13690 - protein, 309 aa, Oryza sativa
MEGDISSLPTKRVAVVTGGNKGIGLEVCRQLAADGITVVLTARDETRGVEAAEKLRGMGLSCVIFHHLEVTDSSSVSRLADFLTTRFGKLEILVNNAAVSGMEHAQRVDTNEEQFVGMDKQQRLEWLNKQGRETYDAAKNGVQTNYYGTKLVIQTLLPLLLQSSGEGRIVNVSSDAGLLRWLVNNEDLRKELDDVDNLTEERLDEVLDSFLKDFEAGALEAHGWPTAPFVAYKMAKVAMNAYTRILARRHPELRVNCVHPGYVKTDMTINSGFLTPEEGGRNVVTVALLPDGGPTGAYFDEGREASFLE

SEQ ID NO: 13691 - protein, 583 aa, Arabidopsis thaliana
  misc_feature (37)..(37): Xaa can be any naturally occurring amino acid
  unsure (1)..(583): unsure at all Xaa locations
MVKRSKKSKSKRVTLKQKHKVLKKVKEHHKKKAKDAXKKLGLHRKPRVEKDPGIPNDWPFKEQELKALEVRRARALEEIEQKKEARKERAKKRKLGLVDDEDTKTEGETIEDLPKVVNVRDNSERAFYKELVKVIELSDVILEVLDARDPLGTRCTDMERMVMQAGPNKHLVLLLNKIDLVPREAAEKWLMYLREEFPAVAFKCSTQEQRSNLGWKSSKASKPSNMLQTSDCLGADTLIKLLKNYSRSHELKKSITVGIIGLPNVGKSSLINSLKRAHVVNVGATPGLTRSLQEVHLDKNVKLLDCPGVVMLKSSGNDASIALRNCKRIEKLDDPVSPVKEILKLCPKDMLVTLYKIPSFEAVDDFLYKVATVRGKLKKGGLVDIDAAARIVLHDWNEGKIPYYTMPPKRDQGGHAESKIVTELAKDFNIDEVYSGESSFIGSLKTVNEFNPVIIPSNGPLNFDETMIEDESKTQTEEEAEHESDDDESMGGEEEEEAGKTKEKSEAGRQNVKLYAAESMLNTKKQKAEKKKRKKAKKAGADEEDLMDGDYDFKVDYRKNKDGEDEEFQIDAKIPMAGLLPEE

SEQ ID NO: 13692 - protein, 230 aa, Xanthomonas axonopodis pv. citri str. 306
MTNLDSPITNPELLPMSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 13693 - protein, 512 aa, Saccharomyces cerevisiae
MTNMAEDKTSISKVHSEFSNSSNTTGSEEESRSHQESFDGESSSGESKSKSKLNLEYSADIEPLKFRMTKTNNTNDKLKYSNNGNATDSFMRLKEHLQRGNTLNSNLRVNEFYPFNSIDTEQFENYLREPKYIKMLKRRKNLKQFRRLFLAQELMAYEGETVTSTSKSSEPTSKAIWSTKFSRDGKFMATGSKDGKIRIWKVIGSPVERAELDSSAESNKEARAKSMRIKQQVSSLNNPKEKQFLDSATEKYEEKEKLLNLYAPVFHPTPLRLYKEHVQDVLDINWSKNNFILSASMDKTVKLWHPDRKNSLKTFIHPDFVTCVEFHPTDDRFFISGCLDHKCRLWSILDDEVSFEYDCQDLITSVTLSPEEGKYTIIGTFNGYVHILMTRGLTPVSSFHVADRQTQEQNAHVMVTETDSKIRHGPRVTGLQAFRSQLDNSFRLVVTSNDSRIRIFDLEQRKLLEVLKGFHSGSSQHKAQLSIWHGQPIVVNSSDDHWVYGWRLKSSDREND

SEQ ID NO: 13694 - protein, 168 aa, Oryza sativa
EGGAFSRVSEETRKDDREEVRNIIEEVKACDPFRIAVMVECALFQKLGNFNGPNKQRYRSLMFNLKDDHNTDFRRRVLLGQVQPERIADLTPTEMASDTRKLENKKIEEKALFECERGGAPKATTDQFKCGRCGQRKTTYYQLQTRSADEPMTTFVTCVNCNNHWKFC

SEQ ID NO: 13695 - protein, 478 aa, Mesorhizobium loti MAFF303099
MMPPAKKEVRPSSRGGRARTPAFVKNLRGVKNWKEVSEWLEWRGIEDIECITPDQAGVARGKMMPSKKFTSNTSLALPSAVFMTTISGGYPEDGNGFHYPEDDGDLKLMPDLSTLTVVPWEEDPTAAVICDLVHQDGRSVEFTPRNVLKRVLAAYDKLGLRPVVAPEIEFYLVRKNPDPDYPLTPPVGRSGRAIGGGAGYSIAGVNEFDELIDDIYHFSESQGLEIDTLIHEEGAGQLEINLRHGDPIELADQVFMFKRTIREAALKHEIYATFMAKPIQGQPGSAMHIHQSIIDKKTGKNIFSAEDGSETEAFFHFIGGMQKHVPNALVMFAPYVNSYRRLTQAASAPVNNKWGYDNRTTAFRVPRSDPAARRVENRIPSSDANPYLALAASLACGLIGITRKIKAEPPVLTTANADEIDLPRSLLEAVDLFEGDEELCALLGKSFAATYAAIKRAEFETFMEVISPWEREYLLLNV

SEQ ID NO: 13696 - protein, 468 aa, Dehalococcoides sp. CBDB1
MSIKIQFLGAAQNVTGSRYLLQTDHTRLLVDCGLYQERHLQNRNWQPFDVPPESLNAVLVSHAHIDHCGLLPKLVKDGYNGPVYLTAATAEIARISLADAGKIQEEDAAFKKTRHEREGRKTQYPEIPLYTAEDARAVFPLFKTVAYNRKITISPDITATFHNAGHVFGSASIELKITENNHQKVIAFSGDLGNWDRPILKNPDLINQADYIVIESTYGDRTHEDINEALLKLADIINQTVKLGGNVVIPSFALERTQDLLFFLNRLISESKIPRLKVFVDSPMAISITKIFKEHPELYDRETTGWVKNGSSPFEFEGLHFTNKAADSEAILAEKDSCIIIAGSGMCTGGRIKRHLASNISRPESTILFVGFQATGTLGRLITDGVKEVRILGQYYPVHARIEELRAFSAHADQPTLLRWLKGFKNRPEQVFVTHGEPKSNQMLINAITDTFGWETIAPAYQDECQLD

SEQ ID NO: 13697 - protein, 119 aa, Nicotiana benthamiana
MSSSDLVAASTPGNLDEQISQLMQCKPLSKPDVRALCEKAKEILMEESNVQPVKSPVTICGDIHGQFHDLAELFRIGGQCPDTNYLFMGDYVDRGYYSVETVTLLVALKVRYPQRLTIL

SEQ ID NO: 13698 - protein, 94 aa, Arabidopsis thaliana
  misc_feature (10)..(10): Xaa can be any naturally occurring amino acid
  misc_feature (14)..(15): Xaa can be any naturally occurring amino acid
  misc_feature (31)..(31): Xaa can be any naturally occurring amino acid
  misc_feature (37)..(37): Xaa can be any naturally occurring amino acid
  misc_feature (40)..(40): Xaa can be any naturally occurring amino acid
  misc_feature (75)..(75): Xaa can be any naturally occurring amino acid
  unsure (1)..(94): unsure at all Xaa locations
AKEEKQEVVXASPXXSSAAVVTSPAQATMVXPFTGLXSSXAFPVTRKTNKDITSIASNGGRVSCMKVWPPIGKKXKFETLSLSLTLGDGILREG

SEQ ID NO: 13699 - protein, 554 aa, Bdellovibrio bacteriovorus
  misc_feature (545)..(546): Xaa can be any naturally occurring amino acid
  misc_feature (549)..(549): Xaa can be any naturally occurring amino acid
  misc_feature (551)..(551): Xaa can be any naturally occurring amino acid
  unsure (1)..(554): unsure at all Xaa locations
MQHLPAMIHDLALILGTAGLVTLLFKKLNQPIVLGYLVAGFLVGPKISIFPTVIGVASINLWAEIGVIFLLFALGLEFSFKKLLRVGGSASFTALFEVSLMILFGFTTGRLLGWSTMDSLFLGGILSISSTSIIIRTVEELGMKNMKFVGMVFGVLVIEDLVAVLLMVLLTTVALTRDFSGTEMLGAVLKLSFFLSIWFVAGIFLLPSFLKRTQKLLSEETVLVVAVGLCLMMVVFASNVGFSSALGAFITGSILAETIEGERIHHLIAPIKNLFSAVFFISVGMLIDPQVISIYWKEVLLLSAVVVVGKTLSVTLGSVLSGQTFKSSLQSGMSLAQIGEFSFIIATLGLSLKVISEKIYPIAVAVSVLTAFTTPYMARSAEKTYAWLEKILPARFIQSIDSYSVLSFSMSGNREWREQVRAYVLKVLLNAVVVVAVFLTMARVFLPFLLERQMEEGPAKFLTLSATLVMSAPFLWALAFGRTKQFEALLVEQGKGSHNYVFLVSRIMLAVGLLGAMVGQFVPLMWAVAITLWMVVVVGYVLSQXXLFXHXRVT

SEQ ID NO: 13700 - protein, 618 aa, Zea mays
MKSTVFSTAVVSIGYALLGWDFAALSEANHHMEKEFELLNGPSIEGITLAASTFGAIVITIFSGALLDWLGRRVILVYSSLVLFSGGVLMLWSPNIYIVLLASWRIMIGAIFAPSIVYFALLVYYLPESPRWLASDGKISEARVSLQWLRGKKHDVSGEIAAIVEGVDIISDSTVGAARAQSFSGTSASHTWPRSTFYWQLSDPLVDLLGSVHENMSEGGSRRNSFFPVFNSFSFPEHEHMNEHRDGNSDQQTRETYYAGEANNGDGLRASLLSQAASVEVNDTNTSFTSEGSSSYLRRHGTSVLAQEFMASIHDYDIEEEEEEIHGFALPHQSAPRDMESTGRHPFRHQIVRLSETADMKFKWRVLLQPGIRHALCYGMLIQALQQVRLCVIVDYVFNSAWSSVYLRTGYHSTGISGLLRCAPEIFEQSGVASLFSDIGLSPHSTSILMSTLNALLILPCITAAMLLMDVCGRRVIVLATTPVLILSLSVMSMSTLVNMGPFESAVLFHFALTICFWSYVIGLGPIPNILCSEIFPTKARATCASFCSLSFWFGGLLSAYCFPVMLSTIGLGGACGIYALVCCAPLFLVYYRIPETKMLNLELIAELFKLSRQEHVQ

SEQ ID NO: 13701 - protein, 886 aa, Oryza sativa
RVRRDLRRPWQRHLQRRRRVVAQPEGEGPDAHGRRTVPRLRRAEQPRQGGEEPPAVARARGRHGSALRPARTVLEADLRRELHPRLRRGHRVLVGRLAGKPFEAPWPTGWKRSSSGNHPDAGWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPV

SEQ ID NO: 13702 - protein, 460 aa, Bradyrhizobium sp. BTAi1
MSTAEIHYLPQARAPLVPPMPPRAPDSMGAFRRVLLMGENAIATWSQRAYEDEIVRGRFFGSSSYILNTPDTIKHVLVDNWENYVRTDGAIRVLRPVLGEGLLIAEGRAWKHQRRTLAPAFTPRAVAGLIPHMIAVTDDTVTRLKQQCDAPVDLREIMQRMTLDIAGRTMFSFEMGRHGATLRDFVFEYGARLASPHLLDIVLPLSWPTPRDIARRRFRKRWTAFVTLLMAERRAAGKLDDAPPRDLFDLMGAARDPETGAAFTDAQLADEVATMILAGHETTATALFWALYLIALDPASQSKLAQEAGAASDLGDPDRLPFTRAVIDETLRLYPPAFLIARAASGPDRLADFPVKRGDVVLISPWLLHRHEKLWRAPNAFMPERFLPGAAPPERFAYLPFGAGARVCIGAHFALVEAVLALARLVGAFKIELIDRAPVMPIGVVTTQPDRSPLFRITPR

SEQ ID NO: 13703 - protein, 445 aa, Salinibacter ruber DSM 13855
MTTPDRTPVKVGLLTAASLVVANMVGTGIFTSVGFQVEYLDSPFALLMLWAVGGVISLCGALTYGELGAALPRSGGEYHLISELYHPSLGFIAGWISATLGFAGPTALAAIAFGDYTTAVFPSLSSTHLAAGIVLLCSAIHATSITWGSWFQNAFTALKVLLILVFVGAAVRADPTHSITVAPSGDGLNELLSPGFAVSLVFVSYAYAGWNAAIYIVGEIRDPQRNLPLSLVLGTALVTVLYVLLNFVFLYTVPAQEMAGEVEVGFLAGSVIFGDAGGEVMSLFIALLLISTVSALVYLGPRVTQAMGEDAPALRWLAVTNDRGIPVNSILFQLGLALLFIYTSTFDQVLVYAGFTLILSTMVTVAGVFVLRWRRPEIDRPYTTWGYPVTPLLFLAANAWILVYVFLDRPTESLIGLGIVAVGAALYFASQWGAPDEAPVSGPRP

SEQ ID NO: 13704 - protein, 527 aa, Kluyveromyces lactis NRRL Y-1140
MSTKSESVVVKVFEAAQAVLGQFLAFSIAQQISIVILLPFVYTIVWQLLYSMRKDRVPLVFYWIPWVGSAVSYGMRPYEFFEECREKYGDIFAFVLLGKVMTVYLGPKGHEFILNAKLADVSAEAAYTHLTTPVFGNGVIYDCPNHRLMDQKKFVKGALTTDAFRKYVPLIAEEVQKYFLTSKNFSIGEKDHGKINVMVTQPEMTIFTASRSLLGSEMREKLNTDFAYLYSDLDKGFTPLNFVFSHLPLDNYRKRDNAQRVISSTYLSLIKKRRDTNDIQDRDLIDSLMKNSTYKDGVKMTDQEIANLLIGVLMGGQHTSAATSAWVILHLAERPDIQEKLYEEQMKVLDNGTKELTFDLLQEMPLLNQTIKETLRLHHPLHSLFRKVMNDMPVPNSSYVVPKGHHVLVSPGYCHLQDKYFPNASEFNPNRWDNDAASSYASNEKVDYGFGSISKGVSSPYLPFGGGRHRCIGEHFAYMQLGTILSNYIRTLTWKFADPSATVPTPDFQSMVTLPLEPSEIEWTLRK

SEQ ID NO: 13705 - protein, 253 aa, Coptis japonica
MGRKFFVGGNWKCNGTSEEVKKIVTLLNEAEVPSEDVVEVVVSPPYVFLPFVKNLLRADFHVAAQNCWVKKGGAFTGEVSAEMLVNLGIPWVILGHSERRALLNESNEFVGDKTAYALSQGLKVIACVGETLEQREAGSTISVVAAQTKAIAEKVSDWTNIVVAYEPVWAIGTGKVASPAQAQEVHFELRKWIKENVGADVAGSVRIIYGGSVNGANSKELAGQPDIDGFLVGGASLKPEFVDIIKSATVKSS

SEQ ID NO: 13706 - protein, 144 aa, Corynebacterium diphtheriae
MRWLHYPTMTERTLILIKPDGVERGLIGEIIARIERKGLKISALDLRVADRETAEKHYAEHADKPFFGELVNFITSAPLIAGVVEGPRAIEAWRQLAGGTDPVAKATPGTIRGDFALEVSTNVVHGSDSPESAEREISIWFPNL

SEQ ID NO: 13707 - protein, 536 aa, Nocardioides sp. JS614
MTMPAATPADRPVVLIAEELSPATVEALGPDFEIRYCDGADRGELLAALPEADAILVRSATKVDAEALAAARRLKVIARAGVGLDNVDVRAATQAGVMVVNAPTSNIVSAAELAVALMLAAARHISPAHAALKNGEWKRARYTGTELYEKTVGIVGLGRIGVLVAQRLSAFGMKIVAYDPYVQAGRAAQMGVRLVDLDTLLAEADFMSVHLPKTPETVGLIGADQLAKVKPSLVLVNAARGGIVEEAALYAALKEGRVAAAGLDVFAQEPCTDSPLFELENVVATPHLGASTDEAQEKAGIAVAKSVRLALSGELVPDAVNVQGGVIAEDVRPGIPLTEKLGRVFTAVAGEVALSIDVEVRGEITDYDVKVLELAALKGIFTDIVEDQVSYVNAPLLAAERGTAVRLVADPESPDHRNLITIRGTLADGEQVSVSGTLIGINQKERLVEVNGFDVDLEPTEHLAFLTYEDRPGMVGTVGVIIGDAGINIAGMQVARDAKGGRALVALSVDTAIPAEVLAEMQHAIDAISVRAVDLV

SEQ ID NO: 13708 - protein, 126 aa, Geobacter metallireducens GS-15
MLERGERPWGTYTVLEENTSYKIKRIEVNPGQRLSLQMHHHRSEHWIVVSGTARVTCGDEEYVVNVNESTFIPIGRNHRLENPGKIPLVIIEVQSGEYLGEDDIVRFDDDYNRCEPGTETFSGETD

SEQ ID NO: 13709 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITASDGAMVARGDLGAELPIEEVPILQEEIINLCRSMGKAVIVAANMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 13710 - protein, 88 aa, Zea mays
MAAPAKASWMVVMSVGTVEALKDQAGLCRWNYTLRSIHRAAKANVRSGVSQGNKQLPASVSAVAERRPAEKAEEGLRTVMYLSCWGLN

SEQ ID NO: 13711 - protein, 664 aa, Polaromonas sp. JS666
MSALELTLLYLLAAVLGVVVCRSFKLPPMLGYLAVGVVIGPNALALAQNSDGVRHLGEFGVVFLMFVIGLEFNLTKLRSMRRHVFGLGLLQVTLTIVLATLGSLFLASLAPTLWKMGWQTALALSGAMAMSSTAIVVKLLAERLELDSEHGKRIMGVLLLQDLAVVPLLVLIPALGSSPDKLLVALAIATLKASVLVGLLLTGGRRVMRWWLTLVARRKSEELFVLNLLLVTLALAWLTERAGLSLALGAFIAGMLISETEYKHQVETDIRPFHDVLLGLFFISIGMLLDWREVAVHWRMVLLLTTVPVAFKLLLITGLARSLGATGGVALRTGLYLAQAGEFGFVLLSLAQANRLLPAALVNPILASMVLSMLATPFIIMYSNQIVMRLVSSEWLQQSLQMTTIARKSLNANKHVIICGYGRCGQNLGHMLEREGIQYMALDLDPDRVRQATAAGDSVVFGDAVRLQALVAAGLSRASAVVVTYLDTASALKVLANIRAHAPTVPVIVRTEDDHDLEKLQAAGATEVVPEAIEGSLMLASHALALVGVPMRRVIRVVQDQRDARYNLLRGYFRGADDDTVNELEQERLATVTLPLGTRSLCQPLGSLTLDAAGVRVVSLRRSNGKTLDADASTLLDDGDTLVLSGKPAALAVAEEMLLRGRPS

SEQ ID NO: 13712 - protein, 258 aa, Triticum aestivum
MGSAASPPRALDAATQEDLKRVSAHRAVDMVESGMTLGLGTGSTAAHALDRLGALLRTGALRAVAGVPTSLKTEAHAARVGIPMLALADAAEIHLSIDGADEVDPDLNLVKGRGGSLLREKMIEGAGARFVVIVDESKLVPRLGCTGAVPVEVVPFGSAYTLGLIRKVFDKLPGFHARLRTVKSKAGDRQEELFLTDNGNHIVEMFFEDGIHGNLRDISDSLLRITGVVEHGMFLGMATKVIVAKKDGTVAVLSKKVA

SEQ ID NO: 13713 - protein, 120 aa, Nicotiana benthamiana
MSSSDLVAASTPGNLDERISQLMQCKPLSEPDVRALCEKAKEILMEESNVQPVKSPVTICGDIHGQFHDLAELFRIGGQCPDTNYLFMGDYVDRGYYSVETVTLLVALKVRYPQRLTILR

SEQ ID NO: 13714 - protein, 393 aa, Bradyrhizobium sp. BTAi1
MGMKALVWHGKEDIRCDTVSDPEIEHDRDAIIKVTSCAICGSDLHLFHNYIPAMMPGDIMGHETMGEVVEVGSGVNGKLKKGDRIVVPFTIICGECEQCRRGNYSVCETTNRNKHLAEKVFGHTTAGLFGYTHLTGGYPGGQAEYLRVPFADATHIKVPDGMTDEQALFLSDIFPTGWQAAAQCDIEPDDTVAVWGCGPVGQMAIRSAILLGASRVIAIDRIPERLAMAEAGGAITINFDKESVVGRLNELTDNKGPEKCIDCVGFESHISMAQPDSVLDRAKQMFMLENDRPHALREIIYVCRPGGIVSIPGVYSGFSDMVPMGALMNKGLTIRTGQTHVNRWTDDLTQRIADGQIDPSFVITHTVPLAQGPEMYRAFRDKQDSCVKVVLKP

SEQ ID NO: 13715 - protein, 286 aa, Lactobacillus sakei subsp. sakei 23K
MQKLSALTAPMALSNGVTIPGLGYGTYQTPNEETKKAVLEALSVGYRHIDTAAVYGNEQGVGDALKESDIAREDIFVTSKLWNTERGYDATKAAFAKTIATLGVDYLDLYLIHWPANTKQFGAKAAELNAETWRAMEDLYNEGKIRAIGVSNFMPHHLDELMKTAVIKPMVDQIEVHPGWPQAEAVRYNQAHDILVEAWAPLGEASALSNETIAAIATKHGKTAAQVCLRWGIQQGVLPLPKSTHQERMAQNTDIFDFELTDAEMTQISALENLGGQCMVPDEVDF

SEQ ID NO: 13716 - protein, 845 aa, Oryza sativa
MEMESKYAALRRAAEEAAAVDAHAHNLVADGSAFPFLRCFSEADAADALALAPHTLSFKRSLRDIAALYNCEASLEKVEEFRRAEGLSSISSKCFKAANLSAILIDDGIDFDKMLELEAHKAFAPTVGRILRIEKLAETIINDESFSASSWTLDSFTEIFVTKLKSVANKIVGLKSIAAYRSGLEIDPNISKTDAEDGLRKELSGQRPLRITNKNLIDYLFTCSLEIAVSYHLPMQIHTGFGDKDLDLRKCNPLHLRAVLEDTRFSKCQIVLLHASYPFSKEASYLASVYSQVYLDFGLAIPKLSVQGMTSSIKELLELAPIKKVMFSTDGYAFPETYYLGARRARDVVYRVLSAACEDGDLSIQEAIEAVEDIFRRNALYLYKLNVANGSVGQITAIADNGIPLSEQDVLFVRVVWIDTSGQHRCRVVPAGRFYEIARKKGIGLTFASMGMTSFTDGPADGTNLTGVGEIRLMPDMSTLLRLPWSRREEMVMAEMHIRPGEAWEYCPRNTLRKVTKVLLDEFNVTMMAGFENEFFLRKKVVSGEKELWVPFDNTPYCSTTAFDGASSVLQEVYTSLKAAEIVVEQLHAEAGKGQFEIALKYVLCTLAADKLIYAREIIKSVARKHGLLATFLPKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 13717 - protein, 429 aa, Xanthomonas axonopodis pv. citri str. 306
MNHSRSHALFAQAQTLLPGGVNSPVRAFKSVGGEPFFVARADGPYLFDVDDNRYIDYVGSWGPMIAGHNHPAVREAVEQSIRNGLSFGAPCAAEVAMAQTITRLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDIVESYAQATACDITTFNRFFHAMLQQGVYLAPSAYEAGFMSSAHDEAVIDATLAAAREAFAEVAR

SEQ ID NO: 13718 - protein, 318 aa, Arabidopsis thaliana
MMTSMEGMVEKGVLDDIIRRLLEGKGGKQVQLSESEIRQLCFNARQIFLSQPNLLDLHAPIRICGDIHGQYQDLLRLFEYGGYPPSANYLFLGDYVDRGKQSLETICLLLAYKIRYPSKIYLLRGNHEDAKINRIYGFYDECKRRFNVRLWKVFTDCFNCLPVAALIDEKILCMHGGLSPDLDNLNQIREIQRPIEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPAPASSSHPLKKVPKMGKS

SEQ ID NO: 13719 - protein, 187 aa, Zea mays
  misc_feature (143)..(143): Xaa can be any naturally occurring amino acid
  misc_feature (164)..(164): Xaa can be any naturally occurring amino acid
  unsure (1)..(187): unsure at all Xaa locations
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSXEGMFLSYCMVFTMSLMPQPDXRVMALGVLSIPSLMTFALTVFYL

SEQ ID NO: 13720 - protein, 443 aa, Dehalococcoides sp. CBDB1
MTRAESVEYVLKTAKDHNVRFIRLWFTDILGSLKSFSIAYNELERALEDGMGFDGSSIEGYARIDESDMVALPDPDTFKIIPWSNGDYQVGRMFCDIKKPSGEQFEGDPRYVLKRNLKKAAEMGFTFYIGPELEYFYFKNDHSTEFLDEGGYFDLTPRDLATDLRRETIVALQDMGIIVEYAHHEVAPSQHEIDIRYTDALTMADNVMTYRLLVKEVAMRHGLHASFMPKPVGSVNGSGMHTHQSLFKGDRNAFFDAKDSYYLSTMAKQYIAGILKYAPEFTSVTNQWINSYKRLVPGFEAPVYLSWARRNRADLVRVPEYKPGHEKSTRIELRSADPGCNPYLAFSVMLAAGLKGIEEKLTPPAPIEENVYEMNEAERAKRGIGTLPGSLLEALKLTEGSSVVREALGDHVFDAFVANKKIEWSQYSIAVTDWELKRYLPVL

SEQ ID NO: 13721 - protein, 292 aa, Helicosporidium sp. ex Simulium jonesii
EVWHHTFYNELRVAPEEHPVLLTEAPLNPKANREKMTQIMFETFNVPAMYVAIQAVLSLYASGRTTGIVLDSGDGVSHTVPIYEGYALPHAIQRLDLAGRDLTDYMMKILTERGYSFTTTAEREIVRDIKEKLGYVALDYDTELSTSNSSSTLEKTYELPDGQVITVGSERFRCPEVLFQPSMIGVEGPGIHETTFNSIMKCDVDIRKDLYGNVVMSGGTTMFQGISDRMAKEITALAPSSMKIKVVTPPERKYSVWIGGSILSSLSTFQQMWIAKSEYDESGPSIVHRKCF

SEQ ID NO: 13722 - protein, 320 aa, Schizosaccharomyces pombe
MINSKSKKKESNALVLKSLLREPYNKVCADCKRNEQPRWASWNLGVFICIRCSGVHRSLGVHVSRVKSVDLDSWTDEQTENMTRWGNERANLYWEAKLAGGHVPSDSKIATFIKTKYEFKKWVLYPEIPSPETLKPEQNTRPVSEVNASLDLNTASRSSSAHSVKSTSSATVTNVTSKKEAISATTSLAQSSPNLASLSKQPSTVHAPSTRQRDLKSSILSLYASPRPQVSSSSITTNATYQNLPSPVSTSTTSSQPYGAFHQPATTGSSFVADKWKMPMFTSNVTSAQPSARASPVQSNSSRPRSSLDSKIINSHDVWK

SEQ ID NO: 13723 - protein, 589 aa, Arabidopsis thaliana
MGKSEKTSLGRSLVKHHNHMIQESKDKGKYYKNLQKKVLESVTEVSDIDAIIEQAEEAERLYTINHSSSTPLSINLDTNSSSSVIAAEEWREQQKIEEALHASSLQVPRRPPWTPEMSVEELDANEKQAFLNWRRMLVSLEENEKLVLTPFEKNLDIWRQLWRVLERSDLIVMVVDARDPLFYRCPDLEAYAQEIDEHKKIMLLVNKADLLPTDVREKWAEYFRLNNILFVFWSAIAATATLEGKVLKEQWRQPDNLQKTDDPDIMIYGRDELLSRLQFEAQEIVKVRNSRAASVSSQSWTGEYQRDQAVVGFVGYPNVGKSSTINALVGQKRTGVTSTPGKTKHFQTLIISDELMLCDCPGLVFPSFSSSRYEMIASGVLPIDRMTEHREAIQVVADKVPRRVIESVYNISLPKPKTYERQSRPPHAAELLKSYCASRGYVASSGLPDETKAARLILKDYIGGKLPHYAMPPGMPQADEPDIEDTQELEDILEGSESDDSAVGDETENEQVPGIDDVLDDLSSFDLANGLKSSKKVTAKKQTASHKQHKKPQRKKDRTWRVQNTEDGDGMPSVKVFQKPANTGPLTMR

SEQ ID NO: 13724 - protein, 525 aa, Salinibacter ruber DSM 13855
MTELTILLGLAAAGYGVSHWTQLPAIPFLLMGGLALNATGAVGDAGFVEDVLFLSVSILLFVAGTDLSLTRVGPFKKTAFVIGVAQFAGLAAAALGIAYGLDYALTDALYLGLALAASSTIVGVRLLQRRQQMFEPYGRTVLGALLLQDVIVVLLLPLLVRLPDGSAAVLGSLGGTIVLLVGVGVVMKGVVPLLLKRELDAETQLLAVLGVLFGFMGAAAWLDVPLFAAAFLAGVSLSGFPFSGIVHSEMQPLYDFFSALFFASLGVAAPQPAPVLFGHAALFAGAVLVLTPLIVAVVGAWAGLVAQSALESGLLLAQTSELSLVVGLQALVAGQIGGEVFSVIVLTTVFTMMLTPLLTSETVVWELVRWHPSRQSDVLSEVPSNHVLVVGGGRSARPLLRLLRESKYEAVVVDEDPTVVDRLRDQGVRCVRGDGSDRAVLLKAGGAQARIVVSLLRNPKAVESLLDYVGDTVPILVRVFEDHEAEWVEARGGTPIRFAHAASDAFMEWFRRAQSARSKQPPSGT

SEQ ID NO: 13725 - protein, 481 aa, Geobacter metallireducens GS-15
MQLIYEKSVPGRRGVRLPASDVPAAPELPAALRRKEPAALPEASELDVVRHFTGLSRRNFSVDTNFYPLGSCTMKYNAKVLEEAARLFAPYHPMVPLLPHGSSFSQGCLGLAYELGAALAEITGMDEVTTQPLAGAHGEMTGIMLIAAYHEAKGNKKKYVVVPDSSHGTNPASATMVGYEIITVPTAPYGDMDLDRFREVMTDEVAAVMMTCPNTLGLFNPHIQEICDIAHDHDALMYYDGANLNAILGKVRPGDVGFDVIHLNLHKTFGTPHGGGGPGSGPVGVKKQLVPFLPSPRIVKYDDGCYGVDAPAHGSIGRTSGFFGNFGVMAKAFAYITMVGREGLIQVSEQAVLNANYVMHRLKDVYDLPYDQTCMHECVFSAARQVKSGVHAIDIAKFLIDRGYHPPTVYFPLIVKEAIMIEPTETESKETLDAFIAVMREAAELAESDPAAFAEMPRTMPVTRLDETKAAREQNVCYFGC

SEQ ID NO: 13726 - protein, 448 aa, Geobacter metallireducens GS-15
MSTASYCPNTPEEVREMLAAMGAASIDDLFQPIPPGLRARSFDLPAGMSEFEMLRRFEHLAGKNAQHLAHFVGGGYYDHLIPAVVDHLSGRAEFYTAYTPYQPECSQGTLQALFEYQTAICRLTGMEVSNASLYDGGTALAEAAMMALRITGRNRLVIDGAVNPFHREVVRTYLANLDVELVEIGPKLGMEDDLRLRAAIDDATAAVLVQNPNFFGSVSDFRKLAADAHAAGALLVVSAYPVALGLIESPGAMGADVVVGDGQSLGNPLSFGGPSFGFIASRKEYIRNLPGRIIGETVDKKGQRGFVLTLQAREQHIKRHKATSNICSNQSLCALRGLIFLSSLGAQGFAELARLNYDKAEYAKKVLGSLSGVEVMNGGATFNEFTVCLPTIAEEVVTALLRKGVAAGVPLSPYYPEMERCMVVTVTEKRTREEIDTLARHLEGILCS

SEQ ID NO: 13727 - protein, 463 aa, Aspergillus oryzae
MTASSEASKCALEEAQRLLISAEKAFIEHNPKSKAQHKVASEVLPGGNTRSILHTDPFPICMERGEGIKLVDVDGHEYLDLVGEMTAGLFGHTNPIIRDTIISTVSKTGLNLGATTRTESLFAKAICQRITSIEQLRFCNSGTEANLHALSIARGATGRSKVIVFEGGYHGGVLTFAHGVAENNVDKEDWIIGKYNDVEGTRKLISENKGIAAAVLVEGMQGAGGCIPGTAEFLHTIQNETRANGMIFILDEVMTSRLAPGGLQSVIRNPYDGAPLKPDMTTLGKWIAGGMTIGAFGGRKDLLAAYDPRPSSGSSERKTQISHSGTFNNNTLAMNVGLAALERVFTPEACMELNNIGGWFHRGLEERCRGTKMTVTGIGAVCNIHFTSNVGNAGITSVDDLATESNGVEPILKDLFWYYAIRHGYWIARRGMLSLILGTSKGDLQGFLDVVEGFVREHREFLE

SEQ ID NO: 13728 - protein, 296 aa, Arabidopsis thaliana
MAEESPRYAIVTGGNRGIGFEICRQLANKGIRVILTSRDEKQGLEAVETLKKELEISDQSIVFHQLDVSDPVSVTSLAEFVKTHFGKLDILINNAGVGGVITDVDALRAGTGKEGFKWEETITETYELAEECIKINYYGPKRMCEAFIPLLQLSDSPRIINVSSFMGQVKNLVNEWAKGILSDAENLTEVRIDQVINQLLNDLKEDTAKTKYWAKVMSAYVVSKAGLNAYTRILAKKHPEIRVNSVCPGFVKTDMNFKTGILSVEEGASSPVRLALLPHQESPSGCFFDRKQVSEF

SEQ ID NO: 13729 - protein, 141 aa, Prosthecochloris aestuarii DSM 271
MERTLTILKPDCVRKQLIGAVIDKIERAGFRVVAMKKTKLTAQTAGEFYAVHSQRPFYGELVEFMSSGPCVPMILEKENAVADFRTLIGATDPAEAAEGTIRNLFADSKGENIIHGSDSAENAQIEAGFFFSTEEAVRVNN

SEQ ID NO: 13730 - protein, 587 aa, Cryptococcus neoformans var. neoformans JEC21
MLSADQRQRAPFAHKSSCANLTATQPSALRSPFPPQSHWPTPPSAEGHQLQLTSDRSKWAQYPSPRKISNETCQAGFSDHPYAFGGIGATYSLDTPTSRRHSLPSLFNPNTHRRAFTFPSMSLPNPATVRFISLCFLWYACSAISNNTGKVILNHFKYPVTLTIVQFFFVAFYCAISSQKMLGWTGRLRQPTKNILKGTLPLAAFQVGGHIFGSMAISRVPVSTVHTIKALSPLFTVMAYALLFGVSYSPATYLSLLPLTLGVMLACSFDISFSNIFGLVCALGSTIVFVSQNIFFKKIMPTTSTNEVNSSSKLDKINLLYFSSSMAFILMIPLWIYSDARRLIDLWINPAASESGTSVLFYFFLNGTVHFAQSIIAFALLASTSPVTYSIASLVKRIAVICLAIIWFKQPVHTVQALGIVLTGAGLWMYNNAKRDVDRGEIKMRHVEALREGVLPSTKMDQCILEGSGIELSYKSAHNSPKPTYPNNYIDLPSSTTTAVNKTTFQVPPILDHTSHIEAPYPSPPASISSSTPADITYLGISKGRQHWLSGEGERFRPPVLNSIRSSVMEEARETGVNEGMAAVVTT

SEQ ID NO: 13731 - protein, 836 aa, Fusarium oxysporum f. sp. melonis
MDSIGIHRQFPDDALPPEGHYSSREELRSAINAWAAPRGYAFVIKRSSKTANGRTHVIFNCDRGAGRIPSLSDRRQTTTRRTGCLFSVLAKESLCKTIWSLRHRPGPHFSQHNHEPSFSEVAHPTLRQLSRQEEITVNQLTNAGIAPKEIGSFLRITSNTLATQQDIYNCIAKGRRDLSKGQSNIHALADQLNEEGFWNRICLDESSRVTAVLFAHPKSLEYLKTYPEVLILDSTYKTNRFKMPLLDIVGVDACQRTFCIAFAFLSGEEEGDFTWALQALRSVYEDHNIGLPSVILTDRCLACMNAVSSCFPGSALFLCLWHINKAVQSYCRPAFTRGKDNPQGLGGESEEWKEFFNFWHEIVASTTEDIYNERLEKFKKRYIPDYINEVGYILETWLDLYKKSFVKAWVNTHLHFEQYATSRVEGIHSLIKLHLNHSQVDLFEAWRVIKLVLMNQLSQLEANQARQHISNPIRESRVLYSNIRGWISHEALRKVETQRERLLKEVPVCTGVFTRTLGLPCAHSLQPLLKQNQPLLLNHFHSHWHLRRPGSPRFLIEPRKQFDRLTASSTLPPTSTQREPSTFERIEKALQPKAPPKCSRCHQQGHMMTSKACPLRYKHLLQAPTQTSTIQAPTQDSTTTHIITHTTTRSITRSLSPSSSSGSSIVSEIVAYTTTHTTHTTTRVLSPPAARPGTVPAANAIVVPALRADDPRAIFQRYKEAREAWFTTLPRGAYKTNQQYRRAMGLPLRYSKAEYDWCLDYKQMGSHCKVGNGTRDWTKEEMMSYLDWDRAENDRVEQSVEIEMAEQPFSRRRGMQDIWDAAERDIMLQESIFQGR

SEQ ID NO: 13732 - protein, 82 aa, Arabidopsis thaliana
MASSRLSSADVVTSPAQATMVAPFTGLKSSAAFPVTRKTNRDITSIAGNGGRVTCMNVWPSVGQKKFETLSHVPDLSDGRIG

SEQ ID NO: 13733 - protein, 425 aa, Triticum aestivum
  misc_feature (367)..(367): Xaa can be any naturally occurring amino acid
  unsure (1)..(425): unsure at all Xaa locations
MGNSQASPSSASSASFVMASRAFSKQALDDLRAHFSSLAAQSGTRGRAISRPVFLDYFGVRGALGDRLFQLVAKESSVEDGVTFEGLIVSKATYERGTKDEADEFIFQLCDVMGDSILTRSDLEAVLASIHETIFADNKEAKEGSNKSTFEAFHNSAVFSKDAEGVSEKSMSLSDFRNWCIVMPSLRKFLGSLLMPPDSGRAGFQVPLLHYPENISSELLLLNKEYAWHIGGGFSQHDVQEWKLLYHSSLHGQSFNTFLGNVTNGDAQTVLVIKDTEGSVYGAYASQPWERHSDFYGDMKTFLFKLYPEPSIFRPTGANKSLQWCAVNFTSENIPNGIGFGGKPHHFGLFLSAGFDQGHSFTSSTCXHPPLSNTGRFRPEVIECWGIQVKGSNDEKPELVKGTVLERFKEDRNMLKLIGMASASD

SEQ ID NO: 13734 - protein, 316 aa, Yarrowia lipolytica CLIB122
MSFKLASGKSMPKVGFGLWKVPRDKTADTVYGAIKNGYRLFDGAFDYQNEREAGEGIRRAIKDGLVKREDIFITTKLWNTFHSKEHALQIAKEQNEWWGLDYIDLYLIHFPIPMQYIPISEKEWAGWTNATDSGPNPLAKIPTRETWEALEELVDTGIAKSIGVSNFTAQNIYDVQTYNKHPISALQIEHHPYLVQPQLTQLAKDNNIQVTAYSSFGPASFVEIGMDQKVPPLFENETITKIAKAHNKTPSQVLLRWATQRGIAVIPKSNNVERQTQNLESLDFDLTEAEIKEISNLNKNLRFNDPGVYANLPIFA

SEQ ID NO: 13735 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTIVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 13736 - protein, 171 aa, Brassica napus
  misc_feature (30)..(30): Xaa can be any naturally occurring amino acid
  unsure (1)..(171): unsure at all Xaa locations
MAASLPTTLCLSHGDESCKRSPTQGYALAXKRNLMGHSRNTVRRLVVTAATEGSRKSKEPQSSWANPDSDEPPPWARNEGPSSTSQENFEVPFYVYLLASAITAIAAIGSVFEYSSKNPVFGVLDSDSIFYTPVLGFFAFTGIPTSVFLWFKSVEAANKEAAEQDKRDGYR

SEQ ID NO: 13737 - protein, 115 aa, Triticum aestivum
  misc_feature (61)..(61): Xaa can be any naturally occurring amino acid
  misc_feature (101)..(101): Xaa can be any naturally occurring amino acid
  unsure (1)..(115): unsure at all Xaa locations
MLPYCGKYKDERIRNAAYIGTPGTGIRTADRSTWSIGKRFGCINVDNVEDNRRSLRELLLXTLGALQYLSGVILFEETLLQSTKGGKPFFDFLKAGNAPPXLRGVKGTIELAGTN

SEQ ID NO: 13738 - protein, 224 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNANLPGGVVDLPTLTEKDKEDILPWARTHPPSHRIASFIYLPKAPNFG

SEQ ID NO: 13739 - protein, 363 aa, Pseudomonas aeruginosa PAO1
MNSSPQANAAMRAAVWHGRHDIRVEDVPLPAEPPPGWVQIRVHWCGICGSDLHEYLAGPVFIPVEAPHPLTGLKDQCILGHEFSGEIVRLGNGVTGFAVGQAVAADACQHCGTCYYCRHGLYNICENLAFTGLMNNGAFAEYVNVPANLLYALPAGFPSEAGALIEPLAVGMHAVKKAGSLLGQNVVVVGAGTIGLSTIMCARAAGAAQVIALEMSSARKAKALEVGASQVLDPSRCDALGEIRALTGGLGADVSFECIGNKHTAKLAIDAIRKAGKCVLVGIFEEPSEFNFFELVSTEKQLLGALAYNGEFADVIAFIADGRLDIAPLVTGRIGLEEIVERGFEELVNNKEHNVKIIVSPGG

SEQ ID NO: 13740 - protein, 175 aa, Secale cereale
  misc_feature (168)..(168): Xaa can be any naturally occurring amino acid
  unsure (1)..(175): unsure at all Xaa locations
MAPAVMASSATTVAPFQGLKSTAGLPVGRRSGSAGLSSVSNGGRIRCMQVWPIEGIKKFETLSYLPPLSTEALLKQVDYLIRSKWVPCLEFSKVGFVFREHNNSPGYYDGRYWTMWKLPMFGCTDATQVLNEVEEVKKEYPDAYVRVIGFDNMRQVQCVSFIAFRPPXCEESGKA

SEQ ID NO: 13741 - protein, 483 aa, Chlorobium tepidum TLS
MHTPLEQQEIRYRKGDIIELTITDHAEKDKCFGKTTEGMGVMVSGILAPGDRVSAQIYKVKSRYLEARAIEVLEASPDRVEPVCPVFGSCGGCKWMHVSYEAQLRYKHKKVTDSLEHIGGFESPDVRPVLAAPDALHYRNKVEFSCSNMRYLLQSEIDSDQLAKPKTFALGFHAPGNFEKVLDLDTCYLAKECMNRVLNVLRDFAIERGLEPYAAKAHEGYLRNLMLRYSERHEQLMVNIVTSWYDKALMQALKERLEAAMPEQQMTLLNNVTTRKNTVATGEQEYVISGDGYVTERLGDLDFRISANSFFQTNTRQAETLYDQIIAVGGITPEDTVYDLYCGTGTITLYLARHCKQAIGIEVVESAVKDAEMNAELNGLSNTVFFQADLKNFHAMQEALEPYAKPRIIVTDPPRAGMHPKALDTMLKLQPERIVYVSCNPDNLARDGKEIAARGYRMTSAQPVDMFPQTNHIETVACFERAE

SEQ ID NO: 13742 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 13743 - protein, 370 aa, Prochlorococcus marinus str. MIT 9312
MYSQSTVIAGGLAHIPVVIGVFYFILKTFSKRASNFPQDTEPKKSQVKSVEQKSVPKPAPVAKGVTNNVVKKKKHADVPVNIYRPKTPYEGTVIENYSLLKEGAIGRVNHITFDLKDSDPFLNYVEGQSIGIMPAGEDANGKPHKLRLYSIASTRHGDDYKGNTVSLCVRQLQYEKDGETINGVCSTYLCDIKPGDKVKITGPVGKEMLLPDEEDANIVMLATGTGIAPMRAYLRRMFEATEKEKNKWNFKGKAWLFMGAPKSANLLYEEDLQRYLTDYPDNFTYTKAISREQQNTKGGRMYIQDRVLESANELFNMIEDEKTHIYLCGLKGMEPGIDEAMTKAAEEKGLNWSELRPQLKKAGRWHVETY

SEQ ID NO: 13744 - protein, 455 aa, Salinibacter ruber DSM 13855
MEIPSVERLTSARIPTVDGEFSLSLYENSKDDKDHLALACGDVADGEDVLVRVHSECFTGDVLGSLRCDCGEQLDASMRRIAKNGRGILLYLRQEGRGIGLLSKLRAYNLQDDGYDTVEANRILGHGADERDYAIAARILDDLGVSSARLLTNNPQKIESLAEHGVEITERISLEPHVNRHNAEYLRTKVNRMRHILDLGPANGHAQGNAHGTSLRDLKQRIDRYFAEKGRPFVTLTYAQSLDGSIASTSGTPLPISSEQALRFTHQLRALHDGILVGIGTVLADDPRLTVRHNDGTHPVPIVLDSSLRFPSDAQLLAGDGPDPLIVTSPNADPDRKERLEAHGGTVIELSCGPEGGICVKTLLRTLGERDFSSVMVEGGTSILTSFLRRQCAQRVIVTVAPMFVGGTAALSSLAPEDQDTHARSDFPRLDNIQQRWYGEDLVLEGDPVWPVASE

SEQ ID NO: 13745 - protein, 426 aa, Bdellovibrio bacteriovorus HD100
MHKVTSEELFQRALKVAPGGVHSPVRSFKGLDRAPVFFKKAEGAYLTSVEDKKYIDFCQSFGPLILGHLDAEVKEEVHRMVDTAWTFGATEIYSLELAEWITSTLPFMEKLRFVSSGTEAVMSALRVARAATGRTKILKFEGCYHGHVDNLLVKAGSGLAGTAASSSAGIPAEVAAHTVVAPLDDEAKLAEVFAAQGKDIAAVIIEPLPANYGLLVQRPEFLKKVAELCEKNGSLLIFDEVISGFRVGLGGMVEKTGIRPDLVTYGKIIGGGFPVGCYGGKAELMNMVAPSGDVYQAGTLSANPIGMRAGLTTLKKMQRVDGWNVLEQRTKKFTDAIKAGFVKKGVNLEISQVASLFWIHGPTASPIRSIDHIPANQGGNFKNLFLKALDKGVYLAPNAYEVGFVSLAHSDELLEQAAQIIVDAAE

SEQ ID NO: 13746 - protein, 289 aa, Salmonella typhimurium LT2
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQGIADAHQKTIAQVVLRWNVQRGVTVIPKSTRQERIEENFAIWDFSLTDNEMAQINALDLGYVGEAVKHFNPEFVRGCLGVKIHD

SEQ ID NO: 13747 - protein, 459 aa, Rhodobacter sphaeroides 2.4.1
MPGNMTFDELKEAVESGGIDTVLVACVDMQGRLMGKRFHAQYFIDGGHHETHCCDYLLAIDMEMTTVPGYKNSGWEKGYGDYVMKPDMATLRALPWMPGTALVLCDLLDHHHNDVPQSPRAILKRQIARAEAMGFKAMMATELEFFLFETSFDAVRNSMQASGQIRDLKPISAYNEDYHIFQTSKEEEVMRALRNGLYGAGIPVECSKGEADAGQEEINVKYSDALDTADNHAITKTAVKDIAHAAGKSVTFMAKYDHRRAGSSSHVHQSLWTLDGKPAFFDPEAPHGMSELMRQFLAGQLAHAEEITAFLAPYVNSYKRFCVGMFAPTKAVWSRDNRTAGFRVCGEGTKAIRVECRIGGADLNPYLACAALLAAGLDGIEKKMDLEAEMRGDMYSTAGVREIPKTLRAAAERLKGSTMLREAMGDEVVEHYHHAAEWEISEQDRVVTDFELARLFERA

SEQ ID NO: 13748 - protein, 483 aa, Clostridium thermocellum ATCC 27405
MITIKRIRIENFQSHKDTELSFSDGLNVIVGPSDQGKSAIIRAIKWVLYNEPRGTDFIRQGTNSARVTLELSNGYVITRERAPNKNRYTLKDPDGNVSVFEGFGNEVPLEIVKAHGIPKVALDMDVRASLNIGEQLEGPFLLSESGATRAKAIGRLTGLHIIDQAIKDCATDIRRENQTCDRIEREIEDIDKKLEEYKNIEELGRRLEESEKVIARMEALTAKVDMLEEKKNSLKDIETEYLAQTKILSRLDRLEECGVYLKSAEACFFKLNQILGIKKRYSEVLTGMEEMEKVLQKTSFVDEAVEILKKASDIFSKYEKLDRLRSEFSNVGRELNQTKNILDRTSNVKELDFMIKNISDKVLLGSEITQLREKLVCLEREISRVKKNISSYENINLVQEIVTSVDKKLEVLNKLEAAKKEYSAVCTSLNDGLEFMDKNKKEIQENLNIYIDILRKSGVCPLCKSSIGDEKLENIIRHYEEVH

SEQ ID NO: 13749 - protein, 1065 aa, Bacillus cereus ATCC 10987
MDKKVSAIPQPKTYGPLGNLPLIDKDKPTLSFIKIAEEYGPIFQIQTLSDTIIVISGHELVAEVCDETRFDKSIEGALAKVRAFAGDGLFTSETQEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGNQEENDLLSRMLHVQDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEDLDKVPHHAYKPFGNGQRACIGMQFALHEATLVMGMLLQHFEFIDYEDYQLDVKQTLTLKPGDFKIRIVPRNQNISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKESMWSDAMKAFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYHEQILKKRISMLDLLEKYEACEIRFERFLELLPALKPRYYSISSSPLIAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDERDGLISLHTAFSRLEGHPKTYVQHVIKEDRMNLISLLDNGAHLYICGDGSKMAPDVEDTLCQAYQEIHEVSEQEARNWLDRLQDEGRYGKDVWAGI

SEQ ID NO: 13750 - protein, 462 aa, Polaromonas sp. JS666
MSHFCPGYPKPREKRSSVWALFRSARNSWIDALYARSYSMQMGEVHLPGVDLYMVNDPALVRRMLSGQPDQFPKSPLLADALRPLLGDSILTTNGDQWQRQREMMNPAFAQAKLDVAFPVMRAAADDLVERLTEAAQRGSELNIEVELTHVTADIIYRTIFSEPLSGDDAHKVFDAFARFQALAPKLMLPSMYGVRWLVWPWNVWQSRRAASDIRRLLEKLIRSRHEAWLRGDDLGKNDILSALMTSRDRKTGEPFSFDELVDQVAVLFLAGHETSASALTWAVYLLSAVPEVQERVHQETCRVFGQRTPEQRDMKALVLTRNVFRETLRLFPPVGFMARESAQTCPMRDKMVPKGASVMISPWLIHRHRERWSDPDAFNPDRFDDDASRESIRQSYLPFGMGPRVCLGAAFALQEATLILASLIRAFRLETVTGHTPMPVGRLTIRSDNGVRLRIFKREDQ

SEQ ID NO: 13751 - protein, 347 aa, Aspergillus oryzae
MPRAEAGSTKAISNKIKSKGLQRLRWYCQMCEKQCRDENGFKCHTQSESHVRNALLVGEDPRKYIEEYSKEFLNNFLTQLRTSHQEKAIHANIFYQTIVADKTHIHLNATKWKSLTQFVAYLGREGLCRVEETEKGLFIAYIDRSPEAMRRREALMKKERQDRGDEEREQRQILEQVERARQNADKEEEIDPEARNLQRKEGEKVKLNIGFGSKANGDSKTESPKPQSPEEKDNAASSATPEPAAASASPDSAPTPAPAPAAAPAPAQDAPKPAVKLSMSLGDKKPKNVFAAAAKKNPLAGKKGPVMEAPKKMSEQERIMKQEMEAMEKKRMRGGFGMPNPKRPKLT

SEQ ID NO: 13752 - protein, 156 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 13753 - protein, 458 aa, Zea mays
MALTTASTVSSPSRIIRRFSSSQDSRPPSSLLHLAPRRGTGNSPRACSWHRLVVRRMGWAARALLGGLSDAGASESDEEEEHALRVGQREGEIDDAVELSATAVGPERWDVLGLGQAMVDFSGMVDDEFLDRLGIEKGTRKVINHEERGRVLRAMDGCSYKAAAGGSLSNSLVALARLGSSQSAGYPELNIVMGGSVGSDPLGSFYRAKLRRANVHFLSKPVKDGTTGTVIVLTTPDAQRTMLAYQGTSSTLSYDSDLASLVSKSNVLIVEGYLFELPHTIEAIKQACEDAHKNGAIIAVTASDVSCIKRCYNDFRDIVRNYADILFANANEARALCELPSTDSPMSATRYLSHSVPLVSVTDGMHGSYIGVKGEAIYIPPPQCVAVDTCGAGDAYASGILYGVLRGASDLKGIGLLASRVAAVVVGQQGTRLRVQDADRLAGSFEHHLDSLEFCSDV

SEQ ID NO: 13754 - protein, 331 aa, Photobacterium profundum SS9
MYQNAQHDLKKGSNFQMSSQMIQWFPGHMHKARKEIEEAIPKVDVIIEVLDARIPFSSENPMISSLRGEKPVVKVLNKRDLADPEMTEMWIAHLEKEQGVKAIAITTENIAEVNQIMELCRKLAPGREAMGKNIRTMIMGIPNVGKSTIINVIAGRAIAVTGNQPAVTRQQQRINLQNGIVLSDTPGILWPKVENPHSGFRLAATGAVKDTAMDYTDVAFFTIEYLAAAYPDLIKARYDLDDELPETDIELMEEIGRKRGCLRPGGRIDIHKASEILINELRNGTLGKITMERPEMITEELINVAIQAELKKEQQIKKKEERRKRYLKNKR

SEQ ID NO: 13755 - protein, 365 aa, Photobacterium leiognathi
MTLSSAQEIINDIRLGKMVILMDDENRENEGDLIIAADMITPEAINFMATYGRGLICLTLTKDRCQTLNLPLMVQNNHDKFSTAFTVSIEAAADVTTGISAYDRAKTVQAAIGPNASADDIVMPGHIFPLMAQDGGVLIRAGHTEAGCDVARLAGLEASSVIVEILNEDGTMARRPQLEVFAQKHGLKLGTIADLIEYRTQRESHIERLSESELCTEYGVFNLITYRDTIDNQLHYALCKGDINPDSETLVRVHVKDTLKDILHTGATQWSLQAAMQRIQADGGILVIISQIEPSAMILNQINHLDSEHQASLPLPITPQSRQIGLGSQILSELGLCKIRLLSSQSQQYRSLSGFDLEVVEYICN

SEQ ID NO: 13756 - protein, 278 aa, Cladonia arbuscula
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDDFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 13757 - protein, 464 aa, Lycopersicon pennellii
MARVTLFLLLLLVYGVVSEHFIVETLPGFHGKLPFTLETGYISVGEEEKVQLFYFFVQSERDPRNDPLMIWLTGGPGCSGLSSFVYEIGPLTFDYANSSGNFPKLELNSYSWTKVANIIFIDQPAGTGYSYANTSEAYNCNDTLSVTLTYDFLRKWLMDHPEYLNNPLYVGGDSYSGIFVALLTRKIYDGIEVGDRPRVNIKGYIQGNALTDRSIDFNGRVKYANHMGLISDKIYQSAKANCNGNYIDVDPNNILCLNDLQKVTRCLKNIRRAQILEPYCDLPYLMGILQETPTNGQSVFPIAGPWCREKNYIYSYVWANDKAVQKALNVREGTTLEWVRCNESMHYRGKERTESYVYDVPSVIDDHQHLTSKSCRALIYSGDHDMVVPHLSTEEWIETLKLPIADDWEPWFVDDQVAGYKVKYLQNDYEMTYATVKGAGHTAPEYKPEQCLPMVDRWFSGDPL

SEQ ID NO: 13758 - protein, 235 aa, Antirrhinum majus x Antirrhinum hispanicum
MSTNKQTHIFFLVVCLVLFPDYAFTGRPPVGFEYLKLWLQWPPSFCSLSRVACGRDPVPAEFTIHGLWPDNYSHELNYCKSNKQLSVQIEDIGEWLDKDWPDLMKQATVNPDKGFYEEQWRKHRICSSNIFTPKEYFTLGMKLKKARNLLQVFHQNEIYESQFSSISRINKAIKIITGRQSPIVKCSRHPQKGSLLTEVILCFDLKGDYFKNCTDPFGRACPKSTNVFFPKKVIV

SEQ ID NO: 13759 - protein, 529 aa, Triticum aestivum
  misc_feature (522)..(522): Xaa can be any naturally occurring amino acid
  unsure (1)..(529): unsure at all Xaa locations
MGTSVQVMPLSGAYGEGPLCYLLAVDGFRFLLDCGWTDHCDPALLQPLARVAPTIDAVLLSHPDMMHLGALPYAIKHLGLSAPVYATEPVFRLGLLTMYDYFLSRWQVADFDLFSLDDIDAAFQNVVRLKYSQNHLLNDKGEGIVIAPHVSGHLLGGTVWKITKDGEDVVYAVDFNHRKERHLNGTTLGSFVRPAVLITDAYNALNNQVYKRQQDQDFIDSMLKVLSSGGSVLLPVDTAGRVLELLLIMEQYWAQRHLDYPIYFLTNVSTSTVDFVKSFLEWMSDSISKSFEHTRDNAFLLRHVSLIINKEELEKLGDAPKVVLASMSSLEVGFSHDIFVEMANEAKNLVLFTEKGQFGTLARMLQVDPPPKAVKVTMSKRVPLVGDELKAYEEEQERIKKEEVLKASISKEKELKASHESNAKASDPMVVDASSSRKSSNAGSHVGGSVDILIDGFVSPVTSIAPMFPFFENTADWDDFGEVINPDDYMMKQDEMDSNMMLGAGDGMDGKLDESSTRLLLXSAPSKVI

SEQ ID NO: 13760 - protein, 424 aa, Xylella fastidiosa Ann-1
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVADKVVPLKSRSAAA

SEQ ID NO: 13761 - protein, 274 aa, Salinibacter ruber DSM 13855
MRGPSTRHDVRADQGPRRRCQNAIDGCPPQHISDTLPSLTRSSMDRDTAKQAAAEAAAQLVRDGMCVGLGSGSTTAYALEFLGRRIQAEDLDVQGVPTSFATERRARTHGIPLTSLDDTPSLDLALDGADEVDDAFRLIKGAGGAHAREKVVAHQADRFVVLVDPTKEVSRLGTQFPVPVEVLPMAATPVMNALDAAGATPTLRTADAKDGPVVTDQGLWIIDARFPDGIENPDALNRRLCDRPGVLDHGLFLDMATDVLVGRPDESVDHRSAS

SEQ ID NO: 13762 - protein, 278 aa, Cladonia arbuscula
  misc_feature (263)..(263): Xaa can be any naturally occurring amino acid
  unsure (1)..(278): unsure at all Xaa locations
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTXLNGDNHSCIFDAKAG

SEQ ID NO: 13763 - protein, 809 aa, Nocardioides sp. JS614
MRRAHRNAVGPFVVDADALPQSIEVVRTRAAGLGIDVVVADLTDGLPADVLEGGLCGVLVQYPGASGRVLDPRRVIEQAHEQDALAVVAADLLALTLLESPGELGADVVVGSSQRFGVPLFYGGPHAGFMSVAAGLERHLPGRLVGVSVDAEGRPAYRLALQTREQHIRRDKATSNICTAQVLLAVVASMYAVYHGPEGLRAIATRAHRYAAVLAAALGQGGFPVRHESYFDTLVVQATGRAAAVVAAARALGVQLRLVDADHVGISTSECTTRSTVASVLKAFGLATGPADGSVDLDAVDAATGDALPEALRRTTPYLTHEVFTSYHSETAMLRYLRRLSARDYALDRGMIPLGSCTMKLNATTEMEPISLPGFADLHPFAPAEDAQGYRQLVTELEGWLAEVTGYDSVSIQPNAGSQGELAGLLAIRGYHRANGDEARNVVLIPSSAHGTNAASAVLAGMRVVVVKSGPGGEVDLDDLRAQCAAHADDLAAIMVTYPSTHGAYEETITELCEIVHAHGGQVYVDGANLNALLGYAKPGEFGGDVSHLNLHKTFCIPHGGGGPGVGPVAVRAHLAPYLPSHGMHPDETKRTGIGPVSAAPYGSAGILPISWAYIRLMGAAGLTRATAAAVLSANYVAARLGEHYPVLYRGHGGLVAHECILDLRGLTKESGVTVDDVAKRLIDYGFHAPTMSFPVAGTLMVEPTESEDLGEIDRFIDAMIAIRGEIDRVGAGEWTPEDSPLRGAPHTSRALVGEWDRPYSRELAVFPTGLTGPNGVADKYWPPVARIDQAYGDRHLVCSCPPVEAFAE

SEQ ID NO: 13764 - protein, 261 aa, Vicia faba
MASTKDRENFVYIAKLAEQAERYEEMVDSMKNVANLDVELTIEERNLLSVGYKNVIGARRASWRILSSIEQKEESKGNDVNAKRIKEYRHKVETELSNICIDVMRVIDEHLIPSAAAGESTVFYYKMKGDYYRYLAEFKTGNEKKEAGDQSMKAYESATTAAEAELPPTHPIRLGLALNFSVFYYEILNSPERACHLAKQAFDEAISELDTLNEESYKDSTLIMQLLRDNLTLWTSDIPEDGEDSQKANGTAKFGGGDDAE

SEQ ID NO: 13765 - protein, 191 aa, Zea mays
APPTVAPPLLSRCSSPSTTTASSRAGASATTPAAAVPRLQTTTTTAAGLAPTVAPAPRPAAPTRRCSASSVQAAAAAKKQCGGVGARMKSKQAKLAAPAPTKDPQSVAAKVRREKIAEKLKVLQDLVPNGTKVDLVTMLEKAITYVKFLQLQVKVLAADEFWPAQGGKAPDLSQVKDALDAILSSSQQCPK

SEQ ID NO: 13766 - protein, 419 aa, Prochlorococcus marinus str. NATL2A
MSSRTYYDPLHQSITLNSSIPEEKMVMELIDSSPFQRLRRIKQLGPAYLTFHGAESSRFTHSLGVFHLARRAINHLLSIDSGLKEHKFIIYGAALLHDLGHGPLSHTSEEIFKIKHEYWTAKLINSCKEITTILNKYGKGNAKAISDLIQSGKAEKKSIISLISSQLDCDRLDYLMRDSYTTGARYGQLDIDRIISAMTISPDGDLAIHPKGLMAVEHYLVIRNLMYRSVYNHRLNEVCNWLLEQIIKTARKIGPQSLWADKSMSEWLWNHEKMSLESFLSNDDTVTGYHIHKWQDCSSNNLSNLCKRFIHRNLLKALNISSFTLETRLESLAKARKLSEKYYLEPDISCGLREQVVKSYHPYKHGLRLWDGDKLQALERVSPLVDRLIQPNQSSWLIYPKEIEIELKIEIENLKMKHN

SEQ ID NO: 13767 - protein, 284 aa, Aspergillus oryzae
MTTLAFIGCGNMGSAILDGLLEATRSEPQKSKIEYFIATTKSAASAEKLSEKYRSDPSRVLVASGSNVKVMEQSDIVLLACKPFLAQSILSEPGVAKALKGKFVISVMAGKTPAEIMEYIYGDSAQAMNRPVIVTAMPNVAARLRQSMTIIEENPALSKDRAEILTWIFEQIGTVKFVAPDLVNAGSMVSGAAMALLTLAVDGIMDGAVMEGFRRPDAMEVSAQVLEGLAGLLREGVHPAVLRESISSPRGCTIQGLYALEKNGVRGAYAEALVRGVKHLRGEN

SEQ ID NO: 13768 - protein, 629 aa, Ashbya gossypii ATCC 10895
MSSSVSASQAKVNELLEAIRQEFQSVSQEATSYRLQNQKDYDFKINQQLAEMQQIRNTVYELELTHRKMKDAYEEEIQRLKVELEQRDRQLSQYAQGTAVPLAAPAASVVTASPAPAVGTSGAAASNTLPSLSEGALAKSKSLSSPHHQVVGGGAMVPQSLGPTPMPPIGSHQHLPQPLAAVAPSGGQPVVPLGAQAQPEQAPVDSAVHGQASEHYLVPYDQRPVHAKPIPPFLVDLDSQLVPTHLKKQTSEYYVLYNPALPRDLDVDLHHSLDHSSVVCCVRFSNDGEYLATGCNKTTQVYKVSTGELLARLSDDSVAGVNNEASTGPANNGTADNGGENSATIQPASSSDLYIRSVCFSPDGKYLATGAEDKLIRIWDLTTKKILMTLQGHEQDIYSLDYFPAGDKLVSGSGDRTVRIWDLRTGQCSLTLSIEDGVTTVAVSPGDGKYIAAGSLDRTVRVWDSETGFLVERLDSENELSTGHKDSVYSVVFTRDGQGVISGSLDRSVKLWDLRGLNGQKSHATCEVTYTGHKDFVLSVATTQDDEYILSGSKDRGVLFWDTASGNPLLMLQGHRNSVISVAVVNGFPLGPDVGVFATGSGDCKARIWKYTKKSNPTATGAKLQELKE

SEQ ID NO: 13769 - protein, 372 aa, Prosthecochloris aestuarii DSM 271
MDEAVQHLYAIIMAGGQGSGLWPLSRRDMPRQFVDIFGIGTMIERTVQRLSGIVPPDHIYIVTSSRGQALVSTLLPGFPMSNVLAEPLGRKTAPCIALATAFVKKRDPDAVTLVVPSDHLVEDNATFEKTIREGVQLALQKKELVTIGIRPDRPETTYGYMQVDIPASQRSLSPGQTTTLHHVRAFAEKPDSRTAQEFVDSGDFFWNSGIFIWHIDVICRELEHWMPDLYRDLLYMYEAIGSSKEQEVIEDVYSWQHPVAIDCGVMEKSESVVMLEGQFGWMDLGNWDDMLSAQQVSSIPDASGRVQNLIEVDTVNTIVHKPSSKAVCLVGVTDLIVVETDDALLICRKGDSRGVRKAVDIMRRNDGMEGYL

SEQ ID NO: 13770 - protein, 207 aa, Wolbachia endosymbiont of Drosophila ananassae
MHSGSQHLFDIIILLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASHVGRLSIAVLLMQDFAVVPLIVLVPLLTGNSEHSLISSLAGSLVQAAIALVLIFITGRLLLRP

SEQ ID NO: 13771 - protein, 415 aa, Ralstonia metallidurans CH34
MGAADIIKQHLIDPEICIRCNTCEDTCPIDAITHDDRNYVVKADVCNACNACLSPCPTGAIDNWRTMLKGQAYTIEAQLTWDELPEEVPLPEAEIEAAAAAGQVIEEASRGSKSVAVQEVEASRHTSSRAPWSAAHPYVNLHGVREPVTATVAGNHRLTAEDASSDIHHIVLDFGNHFFPVLEGQAIGIVPPGTDASGKPHYIRMYSVASPRDGERPGYNNLALTVKRVDTDHDGNPVRGVASNFLCDLAKGDPVQVVGPFGSTFLMPNHREASVMMICTGTGSAPMRAMTERMRRNMDHFSGRRLLFFGARNRRELPYFGPLLKLPKDFLDIHFAFSRDPEVPRRYVQDAIREASAQVAALLADPHGHIYICGLKGMEEGVLDAFAEVCATSGQSWQDIEPRLRAEGRLHIETY

SEQ ID NO: 13772 - protein, 490 aa, Photorhabdus luminescens subsp. laumondii TTO1
MTNNVNTELLRQQAYINGQWVDADNQATFKVTNPANGEVIAHVSNMGAAETERAIAAAQQALPAWRTMTAKQRSQILQRWFQLMMANQPALAELLSREQGKSQTEAMGEIAYGASFIEWFAEEGKRTYGETIPSPLPGRRIVTIKQPIGVVAAITPWNFPNAMITRKVGPALAAGCTVILKPASETPLSALALAALAEQAGIPAGVFNVVTGIDAKAIGGAMTQSPIVRKLSFTGSTRVGKLLMAQSADTVKKLSLELGGNAPFIVFDDANIDAAVQGALIAKFRNSGQTCVCANRILVQETIYDTFAERLAQAVNQLQVGPASDAKSQQGPLINQAAVDKVEEHISDAISHGARILAGGKPHALGGLFFEPTVLADVNKSMLISQEETFGPIAPLFKFRDEAEAIHLANETEFGLAAYFYSRDIGRIYRVAEALESGMVGINEGLISNEAAPFGGIKQSGLGREGSRYGIEDYLEVKYLCFGGIEDTGV

SEQ ID NO: 13773 - protein, 951 aa, Pseudomonas putida KT2440
MTINLGTANEFIARHIGPRAADEQAMLTALGFDSLDAMTAAVIPDSIKGTSVLGSHDGQSEADALAALKAIAGKNQLFKSYIGQGYYNTHTPAPILRNLLENPAWYTAYTPYQPEISQGRLEALLNFQTLISDLTGLPIANASLLDEATAAAEAMTFCKRLSKNKSSHAFFASVHCHPQTLDVLRTRAEPLGIEVVVGDERELGDVSAFFGALLQYPASNGEVFDYREVVQRFHAANALVAVAADLLALTLLTPPGEFDADVAIGSAQRFGVPLGFGGPHAAYFATRDAFKRDMPGRLVGVSIDRFGKTALRLAMQTREQHIRREKATSNICTAQVLLANIASMFAVYHGPAGLKRIAERTHALTAILAAGLKALGVQVVGASAFDTLTLATGTATASLHDKARAQGINLRQIDAAHVGLSLDETSTQADVESLWQLLGGEQAQPDFTALAASTGSLLPAALLRQSAILEHPVFNRYHSETELMRYLRRLADKDLALDRSMIPLGSCTMKLNAASEMIPVTWAEFGNLHPFAPAEQSQGYLQMTTELEAMLCAATGYDAVSLQPNAGSQGEYAGLLAIRAYHRSRGEGHRDICLIPSSAHGTNPATAHMAGMRVVVTACDARGNVDVEDLRAKAIEHRERLAAIMITYPSTHGVFEEAIGEICAIIHDNGGQVYIDGANMNAMVGLCAPGKFGGDVSHLNLHKTFCIPHGGGGPGVGPIGVKSHLAPFLPGHAQLENTQGAVCAAPFGSASILPITWMYIRMMGGAGLKRASQMAILNANYIARRLEEHYPVLYTGGNGLVAHECILDLRPLKDTSGISVDDVAKRLIDFGFHAPTMSFPVAGTLMIEPTESESKEELDRFCNAMIQIREEIRAVEDGSLDKDDNPLKNAPHTAAELVGEWTHGYSREQAVYPLASLVEGKYWPPVGRVDNVFGDRNLVCACPSIESYQDA

SEQ ID NO: 13774 - protein, 693 aa, Aspergillus niger
MAQLDTLDLVVLAVLLVGSVAYFTKGTYWAVAKTRMPLPAPRMNGAAKAGKTRNIIEKMEETGKNCVIFYGSQTGTAEDYASRLAKEGSQRFGLKTMVADLEEYDYENLDQFPEDKVAFFVLATYGEGEPTDNAVEFYQFFTGDDVAFESASADEKPLSKLKYVAFGLGNNTYEHYNAMVRQVDAAFQKLGPQRIGSAGEGDDGAGTMEEDFLAWKEPMWAALSESMDLEEREAVYEPVFCVTENESLSPEDETVYLGEPTQSHLQGTPKGPYSAHNPFIAPIAESRELFTVKDRNCLHMEISIAGSNLSYQTGDHIAVWPTNAGAEVDRFLQVFGLEGKRDSVINIKGIDVTAKVPIPTPTTYDAAVRYYMEVCAPVSRQFVATLAAFAPMRKARQRLCVWVAQGLFPREGHQPMLQHAQALQSITSKPFSAVPFSLLIEGITKLQPRYYSISSSSLVQKDKISITAVVESVRLPGASHMVKGVTTNYLLALKQKQNGRSLSRPSRLDLLHHGPRNKYDGIHVPVHVRHSNFKLPSDPSRPIIMVGPGTGVAPFRGFIQERAALAAKGEKVGPTVLFFGCRKSDEDFLYKDEWKTYQDQLGDNLKIITAFSREGPQKVYVQHRLREHSELVSDLLKQKATFYVCGDAANMAREVNLVLGQIIAAQRGLPAEKGEEMVKHMRRRGRYQEDVWS

SEQ ID NO: 13775 - protein, 341 aa, Actinobacillus actinomycetemcomitans
MINLILCGGSGTRLWPLSRVKVPKQFIKLFNHHSLFQLTQSRNAQFSEKTIAVVNDTQFLLAYEQSDNVNQMKFILEPVGRNTAPAIALSCFGLEYNDIVLVTSSDQLIKNQDNYLNMVCKAEKLAEKGFLVTFGLKPKYPETGFGYIETLDEENVLTFREKPDFDTAKKYVESGRYFWNCGIFCFKAGVFLEELLKYSPDIYYKAKEAYEERVINDNIESISLGNMLEIPSDSIDYAVMEKSDKIKVICGDLGWSDIGSFDSLEKEFAKNQDSNNQIEHHISISSSNNFIWSKKKIVTIDVDDLIIVDTDDVLLVVKKGSSQKVKKVVEYLKEIEPNLVN

SEQ ID NO: 13776 - protein, 445 aa, Zea mays
  misc_feature (87)..(87): Xaa can be any naturally occurring amino acid
  unsure (1)..(445): unsure at all Xaa locations
AQRRAAPVEPKGLTHDEMLLLPTGPRERSAEELDRSRGFRSYGGGSGFGGPGGERRSGFDDEDRRGPGRSSDLDMPSRADEADDWGXHQKFTPAPTDSGRRDRFGGPSPLGRADDIDDWSRGKKPLPARYPSLGSGGGFRDSPAFRDSPAASDSDRWVRGATPLPHNGEGAGERPRIVLNPPKRDPLVASTPPAEVARNRPSPFGAARPREDVLAEKGVDWRKFENEIEHKTSRPTSSHSSRPNSAHSSRPGSPGSQVSAVGSEGAPRARPKVNPFGDAKPREVVLQEKGKDWRKIDIELEHRAINRPESDEERNLKEEINLLKVDLKEIERNMSNGSDQTSVDAKGLSEKISQLESQLEQLSRELDDKIRFGQRPRSGAGRVTALAPTSLGEEPHATVVDRPRSRGGMEPPPRQEERWGFQGSRERGSFGASRNSDRPMARQRW

SEQ ID NO: 13777 - protein, 152 aa, Zea mays
LQEIRDLLDQVNACDPYRVAVTVESALFERIGRSTGTHKVKYRSILFNLKADNNPDFRRRVLLGEVRPGSLVDMPADEMASDARKLENQQIKEKALFDCERASAPKASTDQFKCGRCGQRKTTYYQLQTRSADEPMTTFVTCVNCNNHWKFC

SEQ ID NO: 13778 - protein, 338 aa, Bradyrhizobium sp. BTAi1
MRGAVLYGPHDVRFEDRETPDIIEPTDAIIRIAATCVCGSDLWPYRGLQPLNGPTPMGHEYCGVVEEVGRAVRRIKPGQFVVGSFATSDNTCPHCNFGYQSSCVKREFISRAQAPFLRVPQADGTLVPTPGVPSPEQLASILTTSDVLGTGWFAADAANVKPGTTVAVVGDGAVGLLGILSARQMGAERIIAMSRHESRQKLALEFGATDIVTQRGDAGVAEIMDMTDGIGADSVLECVGTQQSMLQAIHAARPGGYVSYVGVPHGVELNGEELFFAHVHLHGGPAPVRKYLPKLIDLVMSGAITPGKVFDLTLPLEKVADAYRAMDERRAIKVLLQP

SEQ ID NO: 13779 - protein, 203 aa, Oryza sativa
MRHKLHTFFCSMFAEPLFFSLAQSRDSYSDMLEGGNFSNQETLYEVLSVRKDATYDEIRAAYKSAVLNTHPDKAQMALNPLVSSSERNEFLSVQKAWEILRYPKSRAEYDKQLQSSRQNLEIVATEIEIDDMIVESTADSVELLYPCRCGDYFSITSRELGQIGISVREDGEMELHTSDSVPSSVVLGCGSCSLKARLVTNKT

SEQ ID NO: 13780 - protein, 470 aa, Escherichia coli O157:H7 EDL933
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 13781 - protein, 372 aa, Thiomicrospira crunogena XCL-2
MQLNTIEELIEDYKQGKMIILMDDEDRENEGDLMMPASAVTADQINYMARYGRGLICLTLTKERCQQLHLPLMTRNNQDSLGTSFTVSIEAAEGVTTGISAADRAKTIQAAIQPEAQPADIVTPGHVFPIMAKPGGVLERAGHTEAGCDLARLAGLEPASVIVEIMNEDGTMARRDDLEIFAKEHGIKLGTVADLIEYRLKNEKTIERVSECHMPTEYGDFRLIGYEDVLEHRTHLALVHGPLKKDHPTMVRVHMLDTLCDLFDSQRDECGWSLRCAMKQIAQEESGVVVVLRKHEEGAELLDKIQQFQMKDRGISQPEIQTEDDAKTYGLGAQILSDLGLTQLKVIGSAWKMSALGGFGLEIVENIDKQKE

SEQ ID NO: 13782 - protein, 338 aa, Oceanobacillus iheyensis HTE831
METVTYAGPKNILFQNNRKPTITKGWAIIKTSYAGICGSDLSIFAGVHPRAEAPLVMGHEFSGTIEEGHPTLKKGTRVTVNPLLRCGECYPCQNGYSHVCENLKLVGIDCDGGMGEYVKVPIHSIVPLKDNISMKLGALIEPVAVAVHAIRQGNYMPGDSVVIFGAGTIGLCVALTLRSYGAKNLIIVEPNKLRLEKAKQLGFQTLDPLSENVTEKIVEGTDNIGADYVFDCAGHPSVVEAITEVVRVRGNIVIVAMYKQPPTLDMRQGMFKELNIQFVRVYTDKDFQIAIDLVDNHKEYEDIITHVLQPEEAQKGFDLLTTHTDAVKVMYEFNRGEL

SEQ ID NO: 13783 - protein, 531 aa, Coccidioides immitis RS
MLEELVTAVSPGQAVLIAFGLFATFLFILDLKIDWRIQKLGPQAPRVRTYLPLGADFIYRAMKAAGKQKDLEFWTKMTEVPKYTGPGRLSTFEVKFSCYSRSLFTIDPDNIKAVLTGQFADYGKGRRFHEEWRDFLGDSIFATDGELWSKSRQLIRPMFSRDRIVDTEIFEKHIHKLIPLLGGGANQDGSKVVDVGPLFFRFTLDAATDYLLGQSVDSLDNPKTTFAESFQYVLHRQSVIFRSGPLSPLLSRKLFHENLKKMDDFMQPFIEQVRALTPEELDHKLSKKDTFLHALARFTRDPTVLRDQLVAILLAGRDTTAATLSFCIFELSRHPAVVQRLRNEIETVCGNRKPTYSELKEMKYLNAVLNETMRLYPVVPFNVRHALVDTTLPRGGGSDGQSTIGVPADTRIVYSTMAMQRRRDLYPPPPVPGEKTLQPYFDPLLFHPERWLSGWQPKPWHFIPFNGGPRICLGQQFATIEMGYTVTRILQHYPEIIGVGAPKPGTDPKFKFDVTLSPGQRLDCVFVKKEE

SEQ ID NO: 13784 - protein, 331 aa, Arabidopsis thaliana
MSSLTVRRVSREDIQLVQNLIERCLQLYMNQKEVVDTLLEQAKIEPGFTELVWQKLEEENREFFKAYYLRLMVKHQIMEYNELLEQQINHMRQMHPTAGASVRNRNGSHVPPMNQQQLLYERKEPDQSSPNLSSPYLNGGSAINTNIPSYVDFSSHSRRVDPSPNSLSLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQDFMECLAHLSYNGKNLKLNHSGTRDTRDHERLRTISSGFSYENFRSN

SEQ ID NO: 13785 - protein, 404 aa, Vibrio cholerae O1 biovar eltor str. N16961
MQNIGMSSKLDNVCYDIRGPVLKHAKRMEEEGHKILKLNIGNPAPFGFDAPDEILVDVIRNLPTSQGYCDSKGIYSARKAVVQYYQKKGIRSLDVEDVYIGNGASELIVMAMQALLNNGDEMLVPAPDYPLWTAAVALSGGKAVHYICDEEADWYPDLDDIRSKITPKTRGIVLINPNNPTGAVYSRDFLLEIIEIARKHKLMIFADEIYDKVLYDGAVHTSIATLADDVLVVTFNGLSKAYRVCGFRGGWMFLTGPKQQAQGYIAGLDMLASMRLCANVPMQHAIQTALGGYQSINELILPGGRLLEQRDRAWELINQIPGISCVKPKGAMYLFPKIDTKMYPIKDDQKMVLDFLVQEKVLLVQGSGFNWPKPDHFRIVTLPHVEDLEIAISRFERFITTYSQ

SEQ ID NO: 13786 - protein, 142 aa, Ehrlichia chaffeensis str. Arkansas
MLEKTLSILKPDVIKRNITGQVNSYIENSGLKIIIQKMCLLTRCQAEEFYAIHKSQHFFVPLIDFMVSGPIIVQVLQGENAISLYREIMGATDPKKASPGTIRADFAENIDANCVHGSDSLDNAMREIRFFFSDYELLALNG

SEQ ID NO: 13787 - protein, 377 aa, Torenia fournieri
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDIKEKLAYIALDYEQEMETTKTSSAVEKNYGLPDGQVITIGAERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 13788 - protein, 226 aa, Deinococcus radiodurans
MDLEALKKEAALRSVALVQSGQRVGLGTGSTAKYAIEELGRKLAAGELSGIVGVSTSEASEKLAREVGIPTEPLDPRPLDIAIDGADEIAPNLDLVKGLGGALVREKMTEVQAKRLIIIADHTKLVTRLGEKAPLPIEIVPFGFLSTIERLREFLPGGRLRQPGAQPYVTDNGNYIFDAQLPAEFDARELERRIKGTLGVVDTGLFLGMAERAFVAAPDGVQELTR

SEQ ID NO: 13789 - protein, 348 aa, Arabidopsis thaliana
MASRCRSLSKPAFSAFRSAMNKPSIRPKSASSFIGVPPSPGFSRPIGQLGSLQSLLPLYSAVASARLTSCLGIDSQNSRSLAQARRDSSEIANMEKKREGVIEGMSRIVSDPYYFLHFMAFFSYLPIRSSAAPYTSHRLFDREIQAFLAFLMFSAIKMVREETWEAFVADSLLYAKIFLIAVSLIMDYRVAVWFSIIFSVIYLLAQQPAFSKLGTAKKLTPMQLEDLLSDGNTTKYWLIEFFACSSSKCVRSSRCFPELSITYSNNLLSFGTVDLGLFPNTAAKFGISLAGGMSQLPTYILFEKGVEVSRFPDFYVDAAPSLPITKVCFDPLAKKSNLQRLQGFNVIP

SEQ ID NO: 13790 - protein, 740 aa, Oryza sativa
MAGAVLVAIAASIGNLLQGWDNATIAGAVLYIKKEFNLQSEPLIEGLIVAMSLIGATIITTFSGAVADSFGRRPMLIASAVLYFVSGLVMLWAPNVYVLLLARLIDGFGIGLAVTLVPLYISETAPTDIRGLLNTLPQFSGSGGMFLSYCMVFGMSLMPQPDWRIMLGVLSIPSLIYFALTIFYLPESPRWLVSKGRMAEAKRVLQGLRGREDVSGEMALLVEGLGVGKDTKIEEYIIGPDDELADEGLAPDPEKIKLYGPEEGLSWVARPVHGQSALGSALGLISRHGSMVSQGKPLVDPVVTLFGSVHEKMPEIMGSMRSTLFPNFGSMFSVAEQQQAKGDWDAESQREGEDYGSDHGGDDIEDSLQSPLISRQATSVEGKEIAAPHGSIMGAVGRSSSLMQGGEAVSSMGIGGGWQLAWKWTEREGADGEKEGGFQRIYLHEEGVTGDRRGSILSLPGGDVPPGGEFVQAAALVSQPALYSKELMEQRLAGPAMVHPSQAVAKGPKWADLFEPGVKHALFVGIGIQILQQFAGINGVLYYTPQILEQAGVGVLLANIGLSSSSASILISGLTTLLMLPSIGIAMRLMDMSGRRFLLLATIPILIVALAILILVNILDVGTMVHASLSTVSVILYFCFFVMGFGPIPNILCAEIFPTTVRGICIAICALTFWIGDIIVTYTLPVMLNAIGLAGVFGIYAVVCILAFLFVFMKVPETKGMPLEVITEFFSVGAKQAKED

SEQ ID NO: 13791 - protein, 447 aa, Pseudomonas syringae pv. tomato str. DC3000
MTRNDPHSLAQLLMGIDEVECVTPDLNGVPRGKVMTAAGFLEGRRLQLARGVLLQCIMGGYPPARFYGSDDGDLALVSDPQQVHRLPWSEQPRALAICDAEQLNGERCLLSTRGQLKSVIARYAAQGLAPVVATELEFFVFAANPEPLQPFVPPLGLDGRRELGHSAFSISSNNGLRPFFAEVYACMAALGLPRDTVMHEMGVSQFEINLLHGDPLLLADQTFLFKHLLKEVALKHGLIVVCMAKPLAHTAGSSMHIHQSVVAAESGQNVFSDANGEATDTFRHFIGGQQACMADFTALFAPNVNSYQRLYHPYASPNNACWSHDNRAAGLRIPASAAAARRVENRLPGADANPYLAIAASLAAGLHGIEQRLEPTAPMQGEIQVPKELSLPCTLHAAVERLKSSQLAKELFGHEFIEGYVASKTLELTSFFDEITPWERRVLAAQV

SEQ ID NO: 13792 - protein, 376 aa, Saccharophagus degradans 2-40
MTDTFIKSRAAVAWAAGEPLSIEEVDVMMPKAGEVLVKIVATGVCHTDAFTLSGEDPEGIFPAILGHEGGGIVEALGEGVTSVAVGDHVIPLYTPECGECKFCLSGKTNLCQKIRATQGKGLMPDGTTRFYKDGQPIYHYMGTSTFSEYTVLPEISLAKVNQKAPLEEVCLLGCGVTTGMGAVMNTAKVKEGDTVAIFGLGGIGLSAVIGATMAKASRIIAIDINESKFELAKKLGATDCINPKLYDKPIQDVIVELTDGGVDFSFECIGNVNVMRSALECCHKGWGESIIIGVAGAGQEISTRPFQLVTGRVWRGTAFGGVKGRSELPGIVEQYLAGDFKLDDFITHTMGLEDINTAFDLMHHGKSIRSVIHFNK

SEQ ID NO: 13793 - protein, 470 aa, Polaromonas sp. JS666
MLIPVILCGGAGSRLWPVSRELHPKPFMRLADGQSLLQKAFQRGAHLPGVKEILTVTNRELFFKTEDEYRPVNPRGLLTSFLLEPFGRNTAAAVAAAALQVQRTHGDGAVLLVLPADHLIADQAAFADAVVQARALAEQGRVVTFGIRPEGPETGFGYIEAEGHDVKRFVEKPDLETARQYLASGRYWWNSGMFCFTAGAMLAELEQHCPRILAAARKCLEQSRTATGKGLQQTELDAESFAEVPDDSIDYAVMEKTRRISMVPCALGWSDIGSWTAVGELSEADGCGNRVQGHALMHDTTDCYIQSQDRLVGTVGVADLIIIDTPDALLVANRHSSQNVKQIYAQLKTLGHDAHKVHRTVHRPWGTYTVLEEGPQFKIKRIEVKPGAALSLQMHHHRSEHWIVVSGTASIVNGEQDILLLTNQSTYIPAGHKHRLINPGVIDLVMIEVQSGAYLGEDDIVRFEDDYGRV

SEQ ID NO: 13794 - protein, 229 aa, Nicotiana tabacum
MASNSATSLFLTLFLITQCLSVLTAAQDFDFFYFVQQWPGSYCDTKQSCCYPKTGKPASDFGIHGLWPNNNDGSYPSNCDSNSPYDQSQVSDLISRMQQNWPTLACPSDTGSAFWSHEWEKHGTCAENVFDQHGYFKKALDLKNQINLLEILQGAGINPDGGFYSLNNIKNAIRSAVGYTPGIECNVDESGNSQLYQVYICVDGSGSDLIECPVFPRGKCGSSIEFPTF

SEQ ID NO: 13795 - protein, 575 aa, Rickettsia sibirica 246
MNDHILINVIILLGTAVFIVAILKRLRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIEENRSQSTQIGRVSLAILLLQDLAVVPLLVIVPLLAGNNKASLVAALGIALLKAVTALLTIFIVGRVFLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALIGIKTLIITAFCILFGFNKGVAFYSGLLLSQGGEFGFILFSLGKDSGVLEESTADILLLVVTFTMALTPLLAALGQKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYETGLQIGGTVLKNIGISEQEINRIKVQFRLGNYIIAKKEDALSEAEDND

SEQ ID NO: 13796 - protein, 845 aa, Oryza sativa
  misc_feature (220)..(220): Xaa can be any naturally occurring amino acid
  unsure (1)..(845): unsure at all Xaa locations
MEMESKYAALRRAAEEAAAVDAHAHNLVADGSAFPFLRCFSEADAADALALAPHTLSFKRSLRDIAALYNCEASLEKVEEFRRAEGLSSISSKCFKAANLSAILIDDGIDFDKMLELEAHKAFAPTVGRILRIEKLAETIINDESFSASSWTLDSFTEIFVTKLKSVANKIVGLKSIAAYRSGLEIDPNISKTDAEDGLRKELSGQRPLRITNKNLIDDXFTCSLEIAVSYHLPMQIHTGFGDKDLDLRKCNPLHLRAVLEDTRFSKCRIVLLHASYPFSKEASYLASVYSQVYLDFGLAIPKLSVQGMTSSIKELLELAPIKKVMFSTDGYAFPETYYLGARRARDVVYRVLSAACEDGDLSIQEAIEAVEDIFRRNALYLYKLNVANGSVGQITAIADNGIPLSEQDVLFVRVVWIDTSGQHRCRVVPAGRFYEIARKKGIGLTFASMGMTSFTDGPADGTNLTGVGEIRLMPDMSTLLRLPWSRREEMVMAEMHIRPGEAWEYCPRNTLRKVTKVLLDEFNVTMMAGFENEFFLRKKVVSGEKELWVPFDNTPYCSTTAFDGASSVLQEVYTSLKAAEIVVEQLHAEAGKGQFEIALKYVLCTLAADKLIYAREIIKSVARKHGLLATFLPKPDLNDIGSGSHVHLSLWEFDQNVFMGSSEYNYYGMSRIGESFLAGVYLHLPSILAFTAPHPNSYNRIQPNTWSGAYQCWGKENREAPLRTACPPGIPLDLVSNFEIKSFDACANPHLGLAAIVAAGIDGLRRSLTLPEPTESNPAGYASNSKLKRMPKDLMESVEALAADKIMHELIGDKLVTAVIAVRKAEIDHYEKNPAAFADLIHRY

SEQ ID NO: 13797 - protein, 230 aa, Streptococcus pneumoniae R6
MVKLVFARHGESEWNKANLFTGWADVDLSEKGTQQAIDAGKLIKEAGIEFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 13798 - protein, 275 aa, Cladonia arbuscula
GAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 13799 - protein, 278 aa, Cladonia arbuscula
  misc_feature (1)..(2): Xaa can be any naturally occurring amino acid
  misc_feature (274)..(274): Xaa can be any naturally occurring amino acid
  unsure (1)..(278): unsure at all Xaa locations
XXHGAVKVVAVNDPFVEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFXAKAG

SEQ ID NO: 13800 - protein, 628 aa, Kluyveromyces lactis NRRL Y-1140
MVQEVDPEHQSLKADSSSAAQVHYVSIPINKDRRFGAGVGAGSSNDYPDYLDGSSEMPTQYQGIRRRTSILDQPIGSFRGVNSLGRFATSFQRANSFKAIEMNADRERSYIGADGDECYDPDTLGFSHHGRKLSFAITGPGTVSIKPSIADLYGAMSRRSSIQAGTPYGNFENPIDESDGLQSVFSHDSMGPHHLTEYSFDDSGNAVGPEADAIILKQVETKAGKVITVIAGQSTAPQTIFNSINVLIGIGLLALPLGLRYAGWVLGVPILFIFAFATFCSAQLISRCLDADPSISTYGDLAYAAFGPKGRALISFLFAMDLLACGVALIILFGDSLNALFPEYSVNFFKFVAFFAVTPPIFLPLSVLSNISLLGIISTIGTALLVVFCGLLKQYSPGSLLQPEATSMWPNSFKEFCLSLGLLSACWGGHAVFPNLKSDMRHPEKFTRCLKTTYSITIVTDIGIAVVGFLMFGNLVMNEVTRSVLLTPGYPPFVYGLISTLLSLIPLAKTPLNARPIVSIFDSMFNVVHIDETKPASKVFFAKATRIFNRIMVNVMFVIIAILFPEFDKIIAFLGAALCFMICFILPCLFYKRICYKTIKSWELIACNITILISAVLSTLGVYASFTS

SEQ ID NO: 13801 - protein, 58 aa, Triticum aestivum
HQVLCTAVSSAPREGNEVLVQHLLVGEKDARLLVDLEKSIASGADLSDLAVEHSLCAS

SEQ ID NO: 13802 - protein, 152 aa, Glycine max
MTTEQTFIAVKPDGVQRGLIGPIITRFENRGFKLAGIKMVTPSKEHLEKHYADLSDKPFFPGLIAYMGSGPVCAMVWEGCDAVKTGRSILGATNPLASAPGTIRGDYALDVGRNVCHGSDSVENGKKEIALWFKDGEVQSWKSAQHDWVYEK

SEQ ID NO: 13803 - protein, 384 aa, Haloarcula marismortui ATCC 43049
MFLYLYSIFGNCFHPITRPGGCDRRHENGFPQPTRNGSMRAAIYRGPGDITVEEVPRPEIESPTDAIVRVTHTAVCGSDLWFYRGQSDREEGSRVGHEPMGIVEEVGDDVRSVEPGDRVFAPFVVSCGRCEFCRKGLHTSCVNGDSWGGDNGGGQGEYVRATEADGTLVRVPDRHADDEDTLEAILPLTDVMGTGHHAAVSAGVSEGDTCIVVGDGAVGLCGVLAARRLGAERIIAMGHHEDRLELAESFGATETVAARGQDAVDAADDLTNGGANHVLECVGAASAMETAIDVCRPGGTVGYVGVPHGLDDSGLDMFSLFGDNIGLNGGIAPVRAYADELLADVLQGTLDPSPIFTKTVDLNGVPEGYQAMDEREAIKVLVKL

SEQ ID NO: 13804 - protein, 260 aa, Zea mays
MAATVLFTPAQCHRATATTSGRGAPSHCALVPGHRRPGRGSVRAVPPEQSSLPQAAAAAVYGTAGDVKAALYRALDGANRGIFGMTSAKRSEIHGLVELLESRNPTPEPTAKLQDKVDGCWKLIYSTISILGKKRTKLGLRDFISLGDFLQIIDVKQEKAVNVVEFSARALKILTGKLTIEASYRVTSQTRVDIKLESSTITPEQLMNIFQKNYDMLLDIFNPEGWLEITYPLISFLSLWSTSWMFGFYGLIFCLSILVP

SEQ ID NO: 13805 - protein, 314 aa, Methylobacterium dichloromethanicum
MTKKVVFLDRESLDATVREFNFPHEYKEYESTWTPEEIVERLQGAEIAMINKVPMRADTLKQLPDLKLIAVAATGTDVVDKAAAKAQGITVVNIRNYAFNTVPEHVVGLMFALRRAIVPYANSVRRGDWNKSKQFCYFDYPIYDIAGSTLGIIGYGALGKSIAKRAEALGMKVLAFDVFPQDGLVDLDTILTQSDVITLHVPLTPDTKNMIGAEQLKKMKRSAILINTARGGLVDEAALLQALKDGTIGGAGFDVVAQEPPKDGNILCDADLPNLIVTPHVAWASKEAMQILADQLVDNVEAFVAGKPQNVVEA

SEQ ID NO: 13806 - protein, 228 aa, Fusobacterium nucleatum subsp. vincentii ATCC 49256
MKLVLIRHGESAWNLENRFTGWKDVDLSPKGVEEAKAAGKSLKEMGLVFDVAYTSYLKRAIKTLNIVLEEMDELYIPVYKSWRLNERHYGALQGLNKAETAKKYGDEQVHIWRRSFDVAPPSIDKNSEYYPKSDRRYANLADSDIPLGESLKDTIARVLPYWHSDISKSLQEGKNVIVAAHGNSLRALIKYLLNISNEDILNLNLTTGKPLIFEMDKDLKVLKAPESF

SEQ ID NO: 13807 - protein, 447 aa, Oenococcus oeni PSU-1
MTKLTKEAIKKSVKDEGVDFLRVMFTDVFGMIKNVEIPVSELDTVLDDNLLFDGSSIDGFVRIEESDMYLYPDLDTFRILPDSMTGEHDGKVAMIVANVYTSDRLPFEGDPRNNLIRVLAEMRKDGFSDFNVGTEPEFFLFKLGEDGKPTMKLNDNGGYFDLAPLDLGEHVRREIVLTLEKMGFEVEAAHHEVAPGQHEVDFRYADAVTAADHIQLFKLIVKTVARKYGYYATFMPKPIAGINGNGMHTNMSLSKDGKNAFDDPTDKLGLSKVAYHFLGGLLDHAQNFVAITNPTVNSFKRLTPGFEAPVYIAWSASNRSPMVRVPASRGASTRLELRMVDPTANPYLAFAVVLNSGLDGVEKETTPEHSVDRNIFLMDANERKKAGIKDLPDTLLTAVDNLSKDEVVISAISKRIADTFVEAKKLEYQSYRASVSKWEIKQYLQTF

SEQ ID NO: 13808 - protein, 188 aa, Triticum aestivum
  misc_feature (44)..(44): Xaa can be any naturally occurring amino acid
  misc_feature (54)..(54): Xaa can be any naturally occurring amino acid
  unsure (1)..(188): unsure at all Xaa locations
MRRFHEKEAPMVLEELCNSDALNVKRLLEGPSVEAPVPEGGRYXVRLLKNRVLXESSFLVLRVTGVSRTRLVGVGTPIGKFTHGEVFPLSVLALDLLGAHARRRIWVKPHMDQSFLLAIFVLKYVLAHITDNANSGDGLVVMCIADDPLGFGVAPSGAQDYRKADIHEVVLLHQSDAAEFLCKEEDLI

SEQ ID NO: 13809 - protein, 335 aa, symbiont bacterium of Paederus fuscipes
MSISAPDFVGLLKQRLLDNISTQIDHVFNVPADIQKMLGGSEKNLSLEESAKIFDAGIVELMRKPEEDSSKEGGSSFISHVNNHYDHVFYDDNGMTGVLFGDTDYRNHGYWDRNTVSQDQACRQLQEILLDFIPVKTGKILDVACGMGASTRHLLKYYPAENIWAINISDKQIDTARRNAPGCHVQVMDATNMSFADEAFENILCIEAAFHFNTRRKFLEEALRILKPGGRVVLSDFIFSSPERLEQNNILPGPVNHLASIEEYAQLLNDVGFSDFTIQDVSDEVWGGQFLNGTSKLHKAFYDGKLDIVRMTEALWCYYYINASTEKSLFVSAQK

SEQ ID NO: 13810 - protein, 227 aa, Neisseria meningitidis Z2491
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEQYGDEQVRIWRRSYDTLPPLLDKDDEFSAHKDRRYAHLPADVIPDGENLQVTLERVLPFWEDQIAPAILSGKRVLVAAHGNSLRALAKHIEGISDEDIMGLEIPTGQPLVYKLDDNLKVIEKFYL

SEQ ID NO: 13811 - protein, 403 aa, Dehalococcoides sp. CBDB1
MPNARVEEVIADIKAGRFVIVVDDYDRENEGDLVMASEKVTPDAINFMAKNARGLICVSLIAERLEQLKIPMMVTENTSPYSTGFTVTVEARKKVTTGISAADRAATVQVLIDPAATREDIAMPGHMFPLRAREGGVLVRAGHTEASMDLARMSGLYPSGVLCEIMNDDGTMARLPQLEQKAAEWGIKIISIKDIISYRRRTEKMVKKVTEAELPTSHGQFKAVAYKSQFDADEHIALVMGDISGPEPVLVRVHSECITGDVFGSKRCDCGEQLDMALNQIAQAGRGVLLYMRQEGRGIGLHNKLCAYALQDKGLDTVEANLELGFAPDLREYGIGAQILVDLGLSQIRMLTNNPKKVVGLEGYGIKVVETVPIIVEPNSFNRHYLETKQRKMGHILNVDKVN

SEQ ID NO: 13812 - protein, 214 aa, Zea mays
  misc_feature (96)..(96): Xaa can be any naturally occurring amino acid
  misc_feature (118)..(118): Xaa can be any naturally occurring amino acid
  misc_feature (138)..(138): Xaa can be any naturally occurring amino acid
  unsure (1)..(214): unsure at all Xaa locations
MAYSMLSSAAVVTSPAQATMVAPFTGLKSSSAFPVTRKANNDITSIVSNGGRVSCMKVWPPVEKKKFETLSYLPDFTEVELGKEGDYLLPAQGIPXVKSKLSKDFVYREHGSTPRIQXGRYWKMGKSPLFGRPPLAQXVKEAQKGKKGNPKPFLQGSSGFKTTREGRGVIFFPQKKPKFPGGLKLLLKKKKLSLFFLPKKGGCFFFLRGIVEKK

SEQ ID NO: 13813 - protein, 278 aa, Cladonia mitis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 13814 - protein, 107 aa, Burkholderia mallei ATCC 23344
MQILSASALAEWLRDPARPAPIVLDVREPWEIATAKIDGSVSIPMQQIPARSEELDDEAAIVCVRHHGMRSAQVAMFLESRGFTKLYNLQGGIDAWSRDVDPAVPRY

SEQ ID NO: 13815 - protein, 268 aa, Thermoanaerobacter tengcongensis MB4
MKAKKKWGQNFIFDKNLLSKIVRASGVGEEDFVLEVGTGHGGLTEELAKKVKKVVSFEIDKELFEMSREKLKIYKNVVIINEDILEVDLLEIAQEHFDGNSFKVVANLPYYITSPIIMKMLDCKLVKEMTVLVQKEVAERICALPGTKDYGMLTVFVNFKAKPEILFNLPPKVFVPPPKVESSLLKLKVYDKPLVEVKDEKLFSEVVRAAFGQRRKVLSNSLKVLGFSKEVLHETLLKVGISPQARGETLSIDQFANLANALYLLIKE

SEQ ID NO: 13816 - protein, 276 aa, Photorhabdus luminescens subsp. laumondii TTO1
MKKKYNQIIETLKQKVERNETIIGASAGSGLSARCEEAGGADLIIVYNSGRFRMAGRGSLAGLMPYGNANEIVREMGNEILPIVKETPVLAGVCGTDPFCNLSLFLDELKAQGFAGIQNFPTVGLIDGKFRKNLEETGMGYALEVKLIRLAHEKGMMTTPYVFNEKEAEAMAQAGADIIVVHLGLTTGGDISANTSYDLKSCIPIINACASAAKTIRNDIITLCHGGPISEPEDVAYILAHCPNCHGFYGASSMERLPTEQAIKHTIQKFKEINRS

SEQ ID NO: 13817 - protein, 414 aa, Photorhabdus luminescens subsp. laumondii TTO1
MTRFVVVVGTADTKLDELVWLKCCLHLAGVNSIIIDVSTSIPEKNHQNKKIDIHSLQVAEYHPAGADPVFCGVRNKAITAMSVALTNFLNSSIDDIAGVIGIGGSGGTALITPAMQSLPIGLPKIMVSTMASGNVSAYVRDSDIAMLYTVTDLNGLNRISRSVLSNAANMMAGSVNYFTPLADIHKPALGLTMFGMTTPCINQLTTELNTQYDCLAFHATGNGGTSMEKLAKDGELVCVLDITLTEIADLLFGGVLGCPDTRLDVIAKKNIPWIGSAGALDMVNFGAKDTVPERYSNRLFIEHNSQVTLMRTTPEENYQLGIWIGNKLNKCDGPIRFIIPEGGFSALDCPEQPFYLPASTQAFCHGLKKTIKQTELRKVIKTPFHINSPQFCALVIQQFKEIIGLQGIPHEEKI

SEQ ID NO: 13818 - protein, 145 aa, Triticum aestivum
MAHMRVVHRDEEGHKVAEKVPVPETRRPDTARHVERKLEEQGLHRLERHPANAPRGVGIGAPPPKSGRGGKYTWEGPEGLVDSELDPAPAAIDRNDPNYEEEEEGGAQDEAVVGEVEVAKVAQARAGVARVEVAPPLLQEHDHQK

SEQ ID NO: 13819 - protein, 249 aa, Xylella fastidiosa Ann-1
MRPKIVAGNWKLHGSHAFAQALVAQVAAGLPLPGVSVIILPPLLYLSDLVQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLDLVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 13820 - protein, 309 aa, Kluyveromyces lactis NRRL Y-1140
MTSPSGEFPSLKLNTGASIPQLGFGTWPSSHADAYTAVITALKTGYRHIDAAAMYGNEAAVGKGIRDSGIPREEIFVTTKLWNTQQRDPASALDESLERLGLDYVDLFLIHWPVPLKPVGGPENLLKYPTPGIKPQIDTEDWSFIKTWELMQTLPKTGKTRAVGVSNFSIKNLEDLLNSSPDVLVPAVNQFEIHPQLPQTELINYCKSKGIVVEAYCPLGSSSSAMLSDPTIAEIADKYHVKPANVLINWGISRGYCVLPKSFTPARIASNKTPVHLSREDTERITKLSETLGVKRYVHPDFEPYPLFE

SEQ ID NO: 13821 - protein, 291 aa, Triticum aestivum
MALVREPMVMYDGGFDAEASAFDALGYSGHDALLGGVDAAALFGGYAYAHDEPTGAASAYVRNSASWASAGPSVLSFGHGARGHAAQQEVVEEEPDCDAWVDDMDVDQGHQHAAPASTIGFDPATGCFSLTQSSVGARRPFGLLFPGTSNGSPDAATPARGSSKRSYADQDAEPRTTKKPCGASRKTSKAKPAAPTTTSPKGDPQSLTAKNRREKISERLRTLQELVPNGTKVDMVTMLEKAFSYVKFLQLQVKVLATDEFWPAQGGTAPEISQVKEALDAILSSQRGQLN

SEQ ID NO: 13822 - protein, 435 aa, Xylella fastidiosa Ann-1
MNQIRQAPAASASNANESKQEIRNYTMNFGPQHPAAHGVLRLILEMDGETVVRADPHIGLLHRGTEKLAESKPFNQSIGYMDRLDYVSMMCNEHAYVRAIETLIGIQVPERAQYIRTMFDEITRILNHLMWLGSNALDLGAMAVMLYAFREREELMDVYEAISGARMHAAYYRPGGVYRDLPDTMPKYKQSRWHKGKALKRLNAAREGSMLDFLEHFTDTFPQRIDEYETLLTDNRIWKQRTVGVGVIEPDVAKAWGMTGVMLRGSGIAWDLRKKQPYAKYDAVDFDIPLGTCGDCYDRYLCRVAEMRESNRIIKQCVQWLKVNPGQVMVENFKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 13823 - protein, 656 aa, Vibrio cholerae O1 biovar eltor str. N16961
MKSCSRSSSVRLCVRCTGLSLWCCIGHATSVIKSVRNMQSVIGNGYKRSPTGKESRMTPLTSDFLSSSVVFLSAAVIAVPLAQRAGLGSVLGYLLAGIAIGPWGLGLIRDVQAIMHFAEFGVVLLLFLIGLELNPKKLWNLRGPILGLGGAQVVVTTAVLSSVAYLLGVSWQSALVIGMALALSSTAIALRVIEEHGLTRTEAGQSGFAVLLFQDIAVIPMLALLPILAGNSSGDWLNALWMTGGIAALLLGGHFLLNPLFRYIALSGVRELFTVAALLLVVGIALLMQKVGLSMALGTFLAGVILAESEFRHELEIAIDPFKGLLLGLFFISVGMAVDVGLLLVKPLQIMLAVLGLVIVKGLVLYLLARLSGTVAKARSKMAAILSQGGEFAFVIFTAASAEGLLTASQVSFLLVVVSLSMVTTPLLLSAQKYWFARQLNIEENPLTPDVENKEPRVIIVGFGRFGQIVGRLLYANKIKVTILESDASQVRLLRKYGYKVFYGDATNLELLRAAGVEQAEALVVCTDDPEQVITIVELCQQHFPNLKLLARARSRVEAYQLMSLGVQNYTRETFLSALDLGRKALVQLGMHPYQAKRAEEHFHRLDKTMLKELLPQHNEDKQLELRAKEARTELEEIFSREMDSDQLSRRYWEKE

SEQ ID NO: 13824 - protein, 264 aa, Fusobacterium nucleatum subsp. vincentii ATCC 49256
MEFKHKKKYGQNFLNNKDEILNRIIEVSNINENDEILEIGPGQGALTSLLVERVKKVTCVEIDKDLENTLRKKFSSKENYILIMGDILEVDLRKYINKSTKVVANIPYYITSPIINKIIENKDLIDEAYIMVQKEVGERICAKSGKERGILTLAVEYYGEAEYLFTIPREFFNPTPNVDSAFISIKFYKDDRYKNKISESLFFKYVKAAFSNKRKNIVNNLVTLGYSKNKIKEILNQIEVPENERAENISIDKFIELINIFESR

SEQ ID NO: 13825 - protein, 250 aa, Vibrio angustum S14
MQRHVFVCHLKLSTSPDSGYIFGETMNQTSLLAEFGSPTTRVENALNALRRGLGVMLLDDENRENEGDLIFSAEHITATQMALMIRECSGIVCLCLTEKHVKQLDLPAMVENNNSANKTAFTVSIEAKEGVTTGVSASDRVTTIKTAIALNAQPSDLARPGHVFPLCANRKGVLGRRGHTEGTIDLMKLAGLEPAGLLCELTNIDGTMAKADEVVYFAKRHNIPVLTIEDIVAYRLQQKKDKSQEFEMVL

SEQ ID NO: 13826 - protein, 259 aa, Carboxydothermus hydrogenoformans Z-2901
MKPAVGIIGVGQMGGAIARGLLKQQPSPIKKLYLSDKNQECLKPFLEQAEPVTNELLVKKADVVIVAVKPYLVESVIKEISPGLSGKILVSVAAGVSLKKIAEWGVPGECEVVRVMPNTPALIGQGFIAITPSKANALLAEIFDSLGEVVFLEEKYFDQITALAGSGPAYIYLVAEALIDGAVRLGLPRDVARSAVVQTLIGAGAMLKETQEHPGILRDAVVTPGGTTAAGLYQLEKQGIRGMFADCLESAYERAKNLT

SEQ ID NO: 13827 - protein, 277 aa, Ehrlichia chaffeensis str. Arkansas
MYNKHKLPSYILIIMNHISKINPKKELSQCFISSTHITDQIVNYAGNISDYSIIEIGPGLGTMTYSILNKNPKKLISIEKDRRLSTIHEKIVEEFQGKYEFILSDALNIDLRDIIEPPVKVIANLPYHIATTLLIKWMDYINFFTSFTLMFQKEVADRIVAQPNNKNYGTLSILIQLLSNVYKMEDFGPEIFSPQPKVMSSVINIIALPEPRFHVNYRKLSQVLKTTFSERRKMIRSTLKKLTNNADEMLESLNIDNNLRPENLSIEQFCQITNCIN

SEQ ID NO: 13828 - protein, 310 aa, Prochlorococcus marinus str. NATL2A
MQWILILIFSIFCLFTLTNQWVRKSRKYESVNSVASSYDSWTNDRLLENLWGEHIHLGFYEKPRIKKDFRKAKVDFVHELVRWSGLNQLPKGSRVLDVGCGIGGSSRILSDYYGFDVIGISISQEQVKRARELTANRDFCSFEVMNALDLKFEKGSFDGVWSVEAGPHILDKQTFADEMLRVLRPGGVLAVADWNQRDSTKHPLNFFEKLIMNQLLIQWTHPEFSSIEGFKNNLLNSPYCGSSVETSNWTKYTIQSWNESIYEGFRRPSSILKLGLRSLLKAFKEIPTILMMRWSFSRGLMKFGVFKSRG

SEQ ID NO: 13829 - protein, 261 aa, Oenococcus oeni PSU-1
MKYGFLGAGNLSSAIIMGLLKAGFRSEDIFVSSPHSAALLSKRLAINNVDEDRLLADCDLIVLAFLPEQLGSIVQQVGSEKFANKLIVSVLGSTSLKELTEFLPTAKIVRVLPNVNAEFNNSLTSVAFGQNLSNEDLKLTKNFLQAFGTIIELAERDFPAFSAIAGSGPAFVALFIKALQEAGIKQGIDSKESLQIALHTIKGSTENILQSGKTADQLVKKVASPGGSTADGVESLEENHFIETVNNAILATINHGRKKFR

SEQ ID NO: 13830 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALTVHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGARFSKIGKEFVPVYLHRDYLNLGERAVKVSKEDQNCASFVEVGQPIDYCQLRISDETNERVEDGIIGHIHIKGDNVTQGYYNNPESTEKALTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSTETSGQTPIHEIETELLSIFSDVLNGKKVHLADSYFDMGANSLQLSQIAERIEQKFGRELAVSDLFTYPSITDLAAYLSESRAEIKQDAAAKPSHVTPKDIAIIGLSLNVPGASTKSDFWNLLEKGEHSIREYPESRLKDAADYLKSIQSEFNESQFVKGGYLDEIDRFDYSFFGLAPKTAQFMDPNQRLFLQSAWHAIEDAGYAGGSMNGSRVGVYAGYSKVGYDYERLLSANYPEDLHQYIVGNLPSVLASRIAYFLNLKGPAVTVDTACSSSLAAVHMACKSLISGDCEMALAGGIRTSLLPICIGLDMESSDGYTKTFSKDSDGTGTGEGAAAVLLKPLQDAVRDGDHIYGVIKGRAMTQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAAFTSGDEPLRGGISSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLHRAAELFVQGAVIDWRALYSGETVQKTPLPLYPFERSRCWAEADQLRLNEGEKKGGAALNINQSKAHIESFLKTVISNASGIRAEELDLNAHFIGLGMDSIMLSQVKKAIADEFGVDIPMDRFFDTMNNLQSVIDYLAETVPSSFASAPPQENVPAQEIQVISEAQSESDRREGHQEHMLEKIIASQNQLIQDTLQAQLNSFNLLRNSGHHSDEKEYAKAQKKSIPSVKQGHPTVNAEKKAAQEAKPYVPFQPQNLNDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAVTGRKKVVAFSGSYHGTFDGVLGVAGTKGGAASANPLAPGIPQSFMDDLIILHYNNPDSLDVIRSLGDELAAVLVEPVQSRRPDLQPRPFLKELRAITQQSGTALIMDEIITGFRIGLGGAQEWFGIQADLVTYGKIIGGGQPLGVVAGKAEFMNAIDGGTWQYGDDSYPQDEAKRTFVGGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSAAHTADDIENIIQAVKDTVEDLRRGGFIPEGPDSPDGGGRKKSGTRELSPEQKQLVMASHYGNEASAALNQSIMLKVKGELQHTPLKQAVRHIVDRHEALRTVIHPDDEVQQVQERMNIDIPVIDFTGLPHEHREPEIQKWLTEDAKRPFHFHEQKPLFRIHVLTSAHNEHLIVLTFHHIIADGWSIAVFVQELESSYAAIVQGIPISPKEADVSFRQYLDWQQAQIDSGHYEEGVRYWRRHFSEPIQQPILPSTASVRYPNRYEGDRCTVRLGRPLSEALRSLSIQMKNSVFVTMLGAFHLFLHRLTKQSGLVIGIPAAGQSHMKQHALIGNCVNMIPVKNTSSSESTLSGYLGNMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFFDEEQHDLQALYADHQKRVSSIGSNTANFTEAYEAPVNETERQLARIWEELFGLERVGRSDRFLALGGNSLQATLMLSKVQKTFHQKVSIGQFFNHQTVKELARFIQNETKVIHLPMKTAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLIDMHHIISDGYSVNILTNELLALYHQKPLPDIEFEYKDFAEWQNQRLNDDAMKRQETYWLEQFQDEIPILDLPTDGSIAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLVEQPEMTLSSVPMLSETERHQLLTECNGTKTPYPHKETVYRWFEMQAEQSPDHEAVIFGNERYTYRQLNERANRLARTLRTKGVQADQFVAIICPHRIELIVGILAVLKAGGAYVPIDPEYPEDRIQYMLRDSRAEVVLTQRSLLDQLPYDGDVVLLDEENSYHEDHSNLESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKRVSEQLKGRLDIFNEYGPTEAVVGCMIYHFDAERDKREFVPIGTPAANTDIYVADASRNLVPFGVIGEIYISGPGVARGYWNRPDLTAEKFVENPYVPGAKMYKSGDLAKRLKDGNLAYIGRVDEQVKIRGHRIELGEIEAAMHNAEAVQKAAVTVKEEEDGLKQLCAYYVSDKPIAAAQLTEQLSSTLPDYMVPSYFVHLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGTIDPERLNAAFRKLIARHEALRTSFDLYEGEPAQRIHQNVDFTIERIQASEEEAEDRVLDFIKAFDLAKPPLMRAGLIEIAPARHVLVVDMHHIISDGVSVNILMKDLSRIYEGNEPDPLSIQYKDFAVWQQSDIQKRNIKSQEAYWLDQFHGDIPVLDMPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELTFDSLQLKPYPFHHPVAKFDLTLSIQADRDNYHGLFEYSKKLFKKSRIEVLSNDYLHILSAILEQPSILIEHIGLSGSNEEEENALDSIQLNF

SEQ ID NO: 13831 - protein, 266 aa, Prochlorococcus marinus str. NATL2A
MAKAIVSPLLERGEYNPQQVLGIVGRSSSIASALNDLPKEVKVVSSKDSLSKEVWKAPIKILAVKPQQLSKIKESVSSFQSNDQFPKPLLISVLAGITLKSLKKAFPRHTCVRAVPNTPSLVGQGLTGLAWPDDMTLDQKKVVRKIFEPISEIYELEEPKLDSFLALTSSGPAYIALVVEAMADGAVAAGLPRLLSNQLAHKTLSGTASLLREKSLHPAELKDMVASPAGTTISALRHLELAGLRSALIEAVVLAAQKSRQLAEEV

SEQ ID NO: 13832 - protein, 504 aa, Ashbya gossypii ATCC 10895
MPEIHLVFLVHGLWGNVTHMEYLGRAVSQLQERSPETLVVYAAKMNQGYRTYDGIDICGYRVAKEIQEQVATLNCPETGTVVTKFSIVGYSMGGLISRYAVGLLYSNQFFKKQDIKLINFTTFCSPHVGVLAPGKNLAVRVFNFVCSLILGNSGRQMFLKDRIKAANGMPLIVLMSVGDSIFYKALEQFQHRSLYANIVNDKRTAWWTSGISMNDPFFDVTVTNGVERFHYIHPYEPIVIDTSQPITITSIEELTDDEDPNLHEPGDQADPHEFYFINYWAAKLYRWLVVLINLVVIAPLWILWFIIASVVQTMNSTFRVTRFVHQYSHQLIQEYFDVSAPLTPCSTRLIASAEEKIYSTIASPVEYEHQLEQSLNDHTDTLIESVFDAIERKNTLTATVQGTPVGHPGSLTIYIDELATKNVEDIATDTEEQRELLRNCYLDMDWRQRRIISNLNGLSWKKFPIYIRGTPSTHACAIVRHKDPHFKEGESVVKHWSNEIFAFN

SEQ ID NO: 13833 - protein, 517 aa, Burkholderia xenovorans LB400
MTAPVTATSADTRSTQVKSLNVKLKVHPVILAGGSGTRLWPMSREQHPKQLIGLLGDDSLLQSTTRRLEGLEAGYPLTEQLIVVANEEQRFTTAEQLRTSGKPTRLILEPTGRDTAPALTVAALSVAAQDEDGIMVVMPADHAVTDIAGFHAAVATGVQHAAAGHIVTMGIVPTRAETGYGYIRIGAALGTTNDMQQAGTQAAGRIGAHKLDRFVEKPHLELAQRYIESQEYWWNSGIFIMRASTWLKAIRYFQPAIYEACDAAFAGGKADGDFFRLQRDAFSASPSNSIDYAVMEQLGTDQSAATGIVVPLQAGWSDVGSWDAIWDISDKDADQNVGRGRVMFEGAVSTFAHSEGRLIACVGTQDLVVVETADAILVADKSRVQDVKKIVGRIRSDGGLEAANHRKVHRPWGNYDSVDTGERFQVKRIVVKPGARLSLQMHHHRAEHWIVVRGTALVTRGEERFIVSENESAYIPLGVTHRLENPGKIPLEMIEVQSGSYLGEDDIVRFDDTYGRQ

SEQ ID NO: 13834 - protein, 504 aa, Magnaporthe grisea 70-15
MEKFPDLDVGITNHNANKLNGHANGIANGGSHSQPVGVRWTPASSTYSGSGRSGGHSRQKSISEAIRTIRSRHGSVSQNAHEIADALKAPLSPRLIFAFVCGYCLLLSWLASISPGLRTAVPALKHGIRYPSRDVIQTTMPLAAFQIFGHLLSSTATSKIPVSLVHTIKGLSPLFTVLAYRIVFNIRYPAATYLSLVPLTLGVMLACSGKHKFGGEILGIVYALVATLIFVTQNIFSKRLFNEAARAEAEGMGHKSRKLDKLNLLCYSSGMAFILTVPIWFWSEGIGIIGDFLRDGSVDLTTAPGTFDHGRLFIEFVFNGTFHFGQNIMAFVLLSMVSPVTYSVASLIKRVFVIVIALVWFRSPTTKIQAVGIALTFVGLYLYDRTKEGNRADKRATYLGDKGAKDSLLPLSTKSNGVNGGLVFESPASAGPDGFDGGINAPRPYVNGYALPVRTEGDNKKSDDQTPGRGGRQRGASTTSWLPPGTRQEDTWRVGDRSSGGPVR

SEQ ID NO: 13835 - protein, 338 aa, Zea mays
  misc_feature (102)..(102): Xaa can be any naturally occurring amino acid
  unsure (1)..(338): unsure at all Xaa locations
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTXGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 13836 - protein, 126 aa, Triticum aestivum
MQNHALTTLLMLPSIGVAMRLMDISGRRFLLLGTIPILIASLIVLVVSNVINLSTVPHAVLSTVSVIVYFCCFVMGFGPIPNILCAEIFPTRARGVCIAICALTFWICDIIVTYSLPVMLNAIGLA

SEQ ID NO: 13837 - protein, 314 aa, Oryza sativa
MWGLLRRRSPSGFSPSSTGEEVTAGVDGSGLVAVVTGASSGIGAETCRVLAMRGVHVVMGVRNSSAGARVRDEIARQVPAAKIEMLDLDLSSMSSVRRFAENFNALNLPLNILVNNAGIAFVPFKLSEEGIELHFSTNHLGHFLLTDLLLEKMKVTAIESGIEGRVVIVASNSYKHPYREGIRFDKINDESGYNKIFAYGQSKLANILHSNLLSSNLKEQDAKVTVNSLHPGAVVTNIMRHWYFVNGMLSTLGKFFVKGVEQGAATVCYVALHPQVAGVTGKYFVDCNVTELKSHALDMGLAKRLWDFSLNLIH

SEQ ID NO: 13838 - protein, 384 aa, Staphylococcus aureus subsp. aureus MRSA252
MKLSLNSNSKFLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPNIKHITDDDFEFCVDLLESTHLAIVPGSSFTEFGKGFVRISYAYEMDVLKEGMKRLAKYLNTK

SEQ ID NO: 13839 - protein, 235 aa, Triticum aestivum
VFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 13840 - protein, 344 aa, Helicobacter pylori J99
MILRRVTEALEAYKNGEMLIVMDDEDRENEGDLVLAGIFSTPEKINFMATHARGLICVSLTKDLANKFELPPMVSVNDSNHETAFTVSIDAKEAKTGISAFERHLTIELLCKDTTKPSDFVRPGHIFPLIAKDGGVLARTGHTEASVDLCKLAGLKPVSVICEIMKEDGSMARRGDKFLSDFAIKHNLKTLYVSDLISYRLENESLLKMFCQEEREFLKHQTQCYTFLDHQQKNHYAFKFKGAKTHDLAPLVRFHPIKEDFDFLTTGAFEAFFKALEYLKREGGYLIFMNTHSEQNNIVKDFGIGALVLKNLGVKDFRLLSSCEDRQYKALSGFGLKLVETISL

SEQ ID NO: 13841 - protein, 270 aa, Thermotoga maritima
MNVEKLKKMKGKEKIVMVTAYDAPSARIARDAGIDVILVGDSLGNNVLGYENTIPVTMEEMLIHVAAVKRGAPDAFIVADMPFLSYQTSVEKAVENAGKFLKVGANAVKIEGGEEFGELVQKLVESGIPVMGHIGLTPQFVNRFGGYRVQGKTEKNREYLLRSARELEKRGAFAIVLELVVEEVAKEITESVSIPTIGIGSGRFCDGQVLVWHDLLGLNPDFAPRFSKKYANLYEVILKALQEFRREVKKGLFPTEEHSFTDKSKGGVSS

SEQ ID NO: 13842 - protein, 157 aa, Triticum aestivum
  misc_feature (152)..(152): Xaa can be any naturally occurring amino acid
  unsure (1)..(157): unsure at all Xaa locations
MGKSGKKTKESHRQGRGRRGSQLGDDDLPSSAYDAPPRRQEDSDGDDSDEATAEGEHDGGAEEGDLQGQWQVGSMPSKFHLYQLSVQSPKGDISYLQKFFLMYVGGRVPLHLQEDFCGTALLSTEWLRTDTRRTAVGLDFDRESLEWCLENXLSKME

SEQ ID NO: 13843 - protein, 331 aa, Vibrio cholerae O1 biovar eltor str. N16961
MTIKVGINGFGRIGRFVFRAAQERNDIEIVGINDLIDVDYMAYMLKYDSTHGRFNGTVEVKDGNLIVNGKTVRVTAERNPADLKWGEIGVDVVAEATGLFLTDETARKHIEAGAKKVVLTGPSKDKTPMFVMGVNHKTYAGQDIVSNASCTTNCLAPIAKVLNDNFGIESGLMTTVHATTATQKTVDGPSAKDWRGGRGASQNIIPSSTGAAKAVGVVLPELNGKLTGMAFRVPTANVSVVDLTVNLQKAASYDDIKAAMKAASEGELAGILGYTEDAVVSTDFNGDTRTSIFDADAGIALTDKFVKVVSWYDNEIGYSNKVLDLIAHISK

SEQ ID NO: 13844 - protein, 1152 aa, Salinibacter ruber DSM 13855
MAGGPFSRSAVNVPTFNVPTFQRSTRMPDDFLDDPLWYKDAVIYELHVRSFYDSNNDGYGDFQGLREKLPYLESLGVNTLWLLPFLESPLRDDGYDTADYFKVLPIHGDLDDFRAFLDDAHARGMRVITELVLNHTSDQHPWFQEARDPDSDKHDWYVWSDTDERYDDVRVIFTDTEDSNWAWDPKAEKYYWHRFFSHQPDLNFDNPEVREKMKEVMFFWLDMGVDGLRLDAVPYLFEREGTSSENLPETIAYVKELRAAVEERYGPGKVLLAEANQWPEDTLPYFGEDAEGESTGVQMAFNFPVMPRLYMALRRENRRPVVEMLDLTSGIPDDAQWALFLRNHDELTLEMVTDEERDYMYHEYGADDRFRINVGIRRRLTPLLGGERRRIELMNALLLSLKGSPIIYYGDEIGMGDDPFLGDRNGVRTPMQWSPDKNGGFSRAPHHKLFMPPINRGKYSYEFVNVEDAEADPYSLLHFMRRLIALRQQHKNIFGRGSLELLPVENQSILAFLREYEGERILVVNNLSRFTQSVHIPAREDLQGLAPVELSGQSAFPPIEDDDYHLTVGPHHFYWFKLVPKEDVQRDDTRRSGLQPLEDKNGRTRPVLPVAEGLQNVLVPTMAQRRGPEQIEALLPEFINEQRWFGGKGEGIEGVEVEDAVRLQSDPVVYLSVLRVDLPEDTSFYTLPLMAAPEPEASDILDEHPNATLAWLEVEDTEERRLVYDATVNPRFWATLFRWWQRGGTGRSLKGLYTAEPSEAMGDAPPDDVRLLTGEQSNTSAIVNNDYFLKLYRRLEEGPNPEKELLEHLTDIDFTFSPRLHGTLNFRRRHRQYTLGVLQEALAVDADAWSYTLSCTTTFLDRVENSPFPHEQAKNTGPSADGPQWTADRFSDATVPVWLEELAPELISFARTLGVRTAEMHHALAQAGGDEMRPVEAPTDAGAELGTRIRTEMEETRALLDRQPDRVSGHVPSDPAWSAARDRLAPLDDVPGTHDRIRIHGDYHLGQLLRAEGDIYVLDFEGEPTRPLDERRRRKNALRDVAGMLRSLEYAVLASWQDHADVDPDYEPWIDALLYWTETTFLDAYADTTGDAAFLPAAPARYSFLWAFLLDKALYEVRYELNHRPDWAWLPLHGLHRLLAPRDATASDPLDA

SEQ ID NO: 13845 - protein, 319 aa, Oceanobacillus iheyensis HTE831
MVFRVLVPQKIAQEGIRLLEENGASIVVPPSHDEATLVEYVSDVDAIIARTEIYSEKVLENANRLKIIARHGIGVDNIDVKAATKYGIKVTNTPSANINAVAELVLTFMLASTRHLLPIDEAVRAGNFDIRNQLFGYELNGKTVGIIGFGNIGRLIAEKCRLGLGMNIVVFDPYVTAESVEPYVELTESLEDLLRISDVVTLHVPYVRATHHLIHKDSFQIMKKDAILINAARGGVVDEKALVEALMNGEIRGACVDVFEEEPPKQENPLFKLENVIVTPHLGAQTYEAFKKMAIDAANEIISVKNGNAPEHLIHPVTT

SEQ ID NO: 13846 - protein, 134 aa, Triticum aestivum
  misc_feature (37)..(37): Xaa can be any naturally occurring amino acid
  misc_feature (42)..(42): Xaa can be any naturally occurring amino acid
  misc_feature (53)..(53): Xaa can be any naturally occurring amino acid
  misc_feature (62)..(62): Xaa can be any naturally occurring amino acid
  unsure (1)..(134): unsure at all Xaa locations
LLLLPETMATEKLGIKVERNPPESRLSELGVRQWPKXGCDKXSKFPWTYSAKXETCYLLQGXKVKVYPGGHGEEGFVEIAAGDLVVFPKGMSCTWDVAEAVDKHYNVRVACTYTAARPAAVLPAAATSTRLRYL

SEQ ID NO: 13847 - protein, 536 aa, Gloeobacter violaceus PCC 7421
MAFMGTSSAVHPAILVILDGWGYREQTDGNAVAAAKTPIFDALKASYPFTLIHTSGKAVGLPRGQMGNSEVGHLNLGAGRMVPQELVRISDAVEEGTLLSNPELLRLCRTVRERGGKLHGVGLVSDGGVHSHIEHLFGLLDLAKREGFETLFIHGMSDGRDTPPTSGVAYFEKLEARIAETGFGTIATLGGRYFGMDRDRRWDRTEAMYRVMTETGPGTGKRASETLRESHAAGKTDEFVLPVRLAAGAVEPGDGVIYFNFRPDRARQLTRAFVQADFDGFVRPYLDPLAFLTFTQYDATLPVAVAFAPQSLDNLLGQVIAHHGLRQFRIAETEKYAHVTYFFNGGIETPLPGEERSMIQSPLVPTYDLKPEMAAREVTDHAVAAIETRQYSLIVINYANPDMVGHTGNFDATVKAVETVDACIGRLVEACVRAGGTMLLTADHGNAELMWDEQGNPWTAHTTNPVPFILIESEGLKIPGWGTDVQLRAGGSLGDIAPTILEILGLPQPAEMTGRSLLGESEIEIRTPRSPLRVGL

SEQ ID NO: 13848 - protein, 130 aa, Brassica napus
  misc_feature (115)..(115): Xaa can be any naturally occurring amino acid
  unsure (1)..(130): unsure at all Xaa locations
MALQTVKYWLTEHPNIVNFRWSPTQSYASTWFFLFAAVSSYVIAAVSLHILLAVTRRRRGLSLGPIPALHSLAMALISAVIFVGMLLSAAAEIRDTRWLWRWLWRRTRTTALQWXFLCFPVGTRASGRVF

SEQ ID NO: 13849 - protein, 473 aa, Synechococcus sp. WH 7803
MASTAQDVLRQIKDEGIELIDFKFTDLHGKWQHLTICSDLLEADSFEEGLAFDGSSIRGWKTIDASDMAMVPDPSTAWIDPFYSHKTLSMICSIQDPRTGTLYDRCPRALAQRALAYLSGSGLADKAFFGPEPEFFLFDDVRYNSSEGGSFYSVDTIEASWNSGRLEEGGNLGYKIQLKEGYFPVAPNDTAQDIRSEMLLMMAQLGIPIEKHHHELAGAGQHELGMKFAELIKAADNTMTYKYVVRNVAKKYGKTATFMPKPVFNDNGSGMHVHQSLWKAGQPLFFGEGTDANLSQTARWYIGGILKHAPSFLAFTNPTTNSYKRLVPGFEAPVNLVYSEGNRSAAVRIPLTGPNPKAKRLEFRSGDALANPYLAFSAMMMAGIDGIKNQIDPGAPTNEDLFELSAERLSAIDTVPASLNGALEALNADHHYLMEGGVFSKDFINNWIDLKYEEVQQLRQRPHPHEFTMYYDA

SEQ ID NO: 13850 - protein, 445 aa, Oryza sativa (japonica cultivar-group)
MAGAVLVAIAASIGNLLQGWDNATIAGAVLYIKKEFNLQSEPLIEGLIVAMSLIGATIITTFSGAVADSFGRRPMLIASAVLYFVSGLVMLWAPNVYVLLLARLIDGFGIGLAVTLVPLYISETAPTDIRGLLNTLPQFSGSGGMFLSYCMVFGMSLMPQPDWRIMLGVLSIPSLIYFALTIFYLPESPRWLVSKGRMAEAKRVLQGLRGREDVSGEMALLVEGLGVGKDTKIEEYIIGPDDELADEGLAPDPEKIKLYGPEEGLSWVARPVHGQSALGSALGLISRHGSMVSQGKPLVDPVVTLFGSVHEKMPEIMGSMRSTLFPNFGSMFSVAEQQQAKGDWDAESQREGEDYGSDHGGDDIEDSLQSPLISRQATSVEGKEIAAPHGSIMGAVGRSSSLMQGGEAVSSMGIGGGWQLAWKWTEREGADGEKEGFFSLQQSLS

SEQ ID NO: 13851 - protein, 134 aa, Lactobacillus delbrueckii subsp. lactis
HARGLLCTSIGREIAERLELPQMWQDNTDPFGTAFTVSVDYKTTTTGISAYDRATTIKALADPEAKPEAFFKPGHCFPLVAKDGGVLERNGHTEASVTLARLAGEAEVAYICEILKEDGHMARRPEMEEIAKEY

SEQ ID NO: 13852 - protein, 842 aa, Synechococcus sp. RS9917
MSSTPSQRLDLRLPTPGCYADPERAGLEADAVFDGMTEHLFFTLGKLAPTASRHDLYMALSYAVRDRLMTRYLASLEAIRAQPQRSVAYLSAEFLIGPQLNNNLLNLGMQQAAEEALKRFGIESLQQILEVEEEPGLGNGGLGRLAACYMESLASLQVPATGYGIRYEFGIFDQLIRDGWQVEVTDKWLKGGWPWELPQPDEACFVGFGGRTESYIDDKGNYRSRWIPAEHAIGVPHDVPVLGYRVNTCDRLRLWRADATESFDFYAFNIGDYYGAVEEKVGSETLSKVLYPNDGTDEGRRLRLKQQHFFVSCSLQDMLRSLDHRGLAVEDFPNYWTVQLNDTHPAIAVAELMRLLIDDRHLEWDKAWDITSRSVAYTNHTLLPEALEKWDLGLFADLLPRHLELIYEINRRFLQQVRLRYPGNDAIQRKLSIIDEEGGKAVRMAHLATIGAHHVNGVAALHSDLVKSQLLPEFAELWPEKFTNVTNGVTPRRWVALANPELATLLDEHIGEGWITDMEQLRRLEERQHDSGFLEHWGATKLSVKRKLSGYIHRHTGVLVDPASLFDVQVKRIHEYKRQHLNALQVITQYLRIKNGQADGMAPRTVIFGGKAAPGYYMAKLIIRFINGIAETVNADPDMDGRLRVVFLPDYNVKLGEQVYPASDLSEQISTAGKEASGTGNMKFAMNGALTIGTLDGANVEIRERVGGENFFLFGKTVEEIGALKHSGYRPWEVIQSLPELAEAIRLVEIGHFSNGDSDLFRPLLDNLTGSDPFFVMADFADYLRAQDAVSRAWHDRQHWNRMSLLNTARTGFFSSDRSIREYCESIWNVQPLNVEITCDVR

SEQ ID NO: 13853 - protein, 333 aa, Candida albicans SC5314
MSYPTIPWPTFADLKQMLHGFWASKPTYTESQYPDLQDKVVIVTGGNTGLGYETVKSLAGSTKARIYVFSRNKEKTLAAIKQIQLEIAEEYNVSNSDIRFIQVDLSDLTTIKPAVEEFLKQEQRIDIIIHNAGIMGPPVGSKSKQGYELQWGTNVVGPHLLQRLLDPLFIKTSETNPPGFSRIVWVSSTAHLFAPQGGVFWDNVNYENLKLSQTQVRTTLYAQSKAGNLIQARTWSRKHNYPNVISSSLCPGYLYTDLIRNLNSFEQCFVKRLIYPRRYGAYTELYAAFSPDVKDGAHTIGFGVPSHARTDLTSEAVGDKTWAYLDKETDAYL

SEQ ID NO: 13854 - protein, 143 aa, Vibrio angustum S14
MTIERTFSIVKPDAVKRNLIGAIYQRFENAGLNIVAAKMLHLDSAKAQGFYAEHEGKPFFDDLVAFMTSGPVMVQVLEGENAITRYRELMGKTNPEEAACGTIRSDFALSMRHNSVHGSDSPESAAREIAYFFAEDEICPRGE

SEQ ID NO: 13855 - protein, 608 aa, Candida albicans SC5314
MAPSSFDLEFNSDLQNKDNSPQPSSSNRLTALEFNSENENESKNDNNNSSLPSSSDTIEMQPLDKSEYTKIPDVLVDDDDLIKAGNDTSSDTSNPYLRPSVELNGRISYLQDLEDLPQGRHLGLFSTVILFVSRILGSGIFSITSGIYQDCGQSVALFFAAWVIAAIASFGGLYVFLEMGSLVPRSGGAKVFLEFIYPRPKLLATVAFSVYSVMFGFTISNVLVFGEYLIHALGLEPSDFKTRFTGLIFLYFAAILHGVSVSHGVRIQNVLGGLKLVLVVVIVVAGIYVTAFPQSITGIENQLEWDRVFEVRSSASVSTFASAIIKASFAFSGWNSVHTVANEIKDPVRTLKIAGPVSLTIMAVTYFIANLAYLIVIPSDELANGSTLAGSILFTKIFGQFLGKKLLTLAVSLSAGGNIFVVIYTISRVDQEVFREGYLPFSRFMSSNWPYGAPLRTLLLSVAITTTVIVLFPGGDIYSYMVSLEGYPQQLAIALIAIGIFIIRKRYPELHSPIKAGVVGTIAVFLISLYLLIGPFVSSKSPNPKGLENWPNYGVVAIICILACIGFWYIKFRLLPWLGGYELVSEEVQLSDGLPVKKWKKLHSYNTL

SEQ ID NO: 13856 - protein, 852 aa, Arabidopsis thaliana
MGNALVKKEPPPPVVLVPPLFDYPPLSARTRMLESSYNLLFGKLALRCLFEDYFEEANRFTGKFLLKPTDDPHKIRIFLNSLKVSGAVDGRVEGDFVGNAEFRWQRVLLMRSSAYYPKYGIGAFAVYPLISKITGKSSEEYRIMGLRYGSTNLSVGATVTPFSANNELPKHAWLVSKMGSLTVGVQYEPLHGSKDLAKYTDPRNWSCAAGYGVGSQSPLTPSFNIGIELARSSQFIASFYQHVVVQRRVQNPFEENQVVGITNYIDFGFELQSRVDDSKTPPNAPDSLLQVAASWQANKNFLLKGKVGAHSSTLSLAFKSWWKPSFAFNISATTNHRTGNVQCGFGLRVDNLREASYQRADPNFVMLTPNKEHLAEGIVWKMGKRPMYQADVDAENFKTTIPLSHDQKKKKKLNGDDDELFASPFFHSLPSLSSFFSPLLLQSLFFTILSNFSLPNPIQTLFPNPLELSLNDNNRDDDDDTLHFTPFSAVKPFFLLCTSVALSFSLFAASPAVESASAFVVSTPKKLQTDELATVRLFQENTPSVVYITNLAVRQDAFTLDVLEVPQGSGSGFVWDKQGHIVTNYHVIRGASDLRVTLADQTTFDAKVVGFDQDKDVAVLRIDAPKNKLRPIPVGVSADLLVGQKVFAIGNPFGLDHTLTTGVISGLRREISSAATGRPIQDVIQTDAAINPGNSGGPLLDSSGTLIGINTAIYSPSGASSGVGFSIPVDTVGGIVDQLVRFGKVTRPILGIKFAPDQSVEQLGVSGVLVLDAPPSGPAGKAGLQSTKRDGYGRLVLGDIITSVNGTKVSNGSDLYRILDQCKVGDEVTVEVLRGDHKEKISVTLEPKPDES

SEQ ID NO: 13857 - protein, 251 aa, Triticum aestivum
  misc_feature (44)..(44): Xaa can be any naturally occurring amino acid
  unsure (1)..(251): unsure at all Xaa locations
AHLGDTIEQVCTKKQAVTVPNSRDIVDPRVREGARFAKWRTVVXPCGPTALAVKKAAWGPARYAAIAQDNGLVPAAQPVHHSSDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWQGQPENIEAAQKALLVRAKANSFPQLGSYTGEGESDEAKKGMFQKGYTY

SEQ ID NO: 13858 - protein, 928 aa, Cryptococcus neoformans var. neoformans JEC21
MAELTKENLDKVTASPGSSSHGSRTPSLHQPEMSRRSSLSAGHPHSFKHVDTTQIGVPIVTPRKERPGHQRSLTGSYFPSQKGGIVDMPGEWPIGDEKTWREAKKAMEIDQDNPQDVANTIVRHVNTSLGRQVYNVDEVAAYQATALSVRDQLLDRWNQTAAYHTAKAPKRIYYLSIEWLVGRSLDNAVLNLGMRNVYEEANRKLGFNFEDLLNEERDAGLGNGGLGRLAACYIDSMATLNLPGWGYGLRYNYGIFKQLISNSGEQLEAPDPWLDRENPWEIARLDVTYPIRFYGRVDPIPNTDRAVWSGGMECLAVAYDTPIPGYGTKNCANIRLWSAKPVQGFDLNSFNAGNYEASVAASSEVENITRVLYPNDNMYAGKKLRVMQQYLWVSASLQDMLRRFTKLDLPWTELPDYVCIQMNDTHPTLAIPELLRILIDEEKLDYNTAWKITQKVFAYTNHTVLPEALERWQLDLFEELLPRHLQIIYRINFDFLGLVAKRWPGDMDRIRRMSIIEEGSPKYVRMAYLAIVTSFKINGVAELHSQLLQATIFRDFVEFKGRDAFTNVTNGITPRRWLLQCNPELAALITHTLGSDDWATNLKLLKNLLPMADNADFRKAFTNIKMDNKNRLASLIEAELGITLNIDSVFMTQIKRLHEYKRQTLNLFGVIYRYLRIKQASPEERKKITKHTAIFAGKAAPGYYVAKLVIRLINNVARVVNDDPDVGDILKVVFIPDYSVSIAEVLVPASDVSVQISTAGTEASGTSNMKLALNGALLLGTVDGANVEIAEDAGEDQSFLFGHLAEQVDEVRYANTYQPTPLEQRSPELAQTFKAIEAGTFGDGAIYAPLLKTVYEHDYYLVSNDFGSYLSAEKLMDECYDSDKTEWTRKSIITAFNMGDFSSDRSVQDYADGIWSVEPCEVPEDFSI

SEQ ID NO: 13859 - protein, 847 aa, Rosa hybrid cultivar
MEMPGRRSNYTLLSQVPDDHFAAATATSFYESEGKNNNNKAKGDSRGFDWETGGGEYRAAPANRIGNVYSSVGLQRQSSGSSFGESSLSGEYYAPTLSTTAANEIDGFGYVNDDGFKTGGGGGEFRGKGGGMDGGVGPPGGSSSGKSWAQQTEESYQLQLALALRLSSEATCADDPNFLDPVPDESSSRLSSSADAVSHRFWVNGCLSYFDKVPDGFYLIHGIDSYVWSMCTDVQESGRIPSIESLKSVDPGTGSSIEVVLIDRRSDPSLKELQNRVLSISYACITTTEIVDQLAKLVCSRMGGSASVGEAEFFSIWRESSDDLKDCLGSVVVPIGSLSIGLCRHRALLFKVLADTIDLPCRIAKGCKYCTRDDASSCLVRFGIDRELLVDLIGNPGCLCEPDSLLNGPSSISISSPLRFPRLRTVEPTIDFRSLAKQYFSDCQLLNLVFDEAPAGSAGDEDNKGFSMYPKQKFTDGNNLFLVSGLGDDTSMHVDDRNPQFLKSFNPSQNIVHQQTVLKDQIPLKRIPPIGHRDISRLDTSKDSRFGEGLQVVPSKPNKELTLDVDDLDIPWSDLVLKERIGAGSFGTVHRADWHGSDVAVKILMEQEFHAERFNEFLREVAIMKRLRHPNIVLFMGAVTKPPNLSIVTEYLSRGSLYRLLHKPGPILDERRRLYMAHDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLNPQVASIIEACWANEPWKRPSFASIMESLRPLIKAPTPQPSHADMPILT

SEQ ID NO: 13860 - protein, 237 aa, Actinophrys sol
LMYVNIQAVLSLYASGRTTGCVLDSGDGVSHTVPIYEGYALPHAIVRLDLAGRDLTDYFMKILTECGYSFTTTAEREIVRDVKEKLTFVALDFDEEMKKASESSELEKSYELPDGNVIVIGNERFRCPEVLFQPSFIGKEAAGIHDCTFQTIMKCDVDIRKDLYANIVLSGGTTMFPGIAERMTKEITALAPSTMKIKVVAPPERKYSVWIGGSILASLSTFQQMWISKAEYDESGP

SEQ ID NO: 13861 - protein, 154 aa, Triticum aestivum
  misc_feature (40)..(40): Xaa can be any naturally occurring amino acid
  misc_feature (87)..(87): Xaa can be any naturally occurring amino acid
  unsure (1)..(154): unsure at all Xaa locations
MAPTVMASSATSVAPFQGLKSTAGLPVSRRSNGASLGSVXSNGGRIRCMQVWPIEGIKKFETLSYLPPLSTEALLKQVDYLIRSKWXVPCLEFNKVGFIFREHNASPRVLRRLLGQCGNCLCSGWNRPTQGDRWGRVGTLDAVRPQSIRITIPR

SEQ ID NO: 13862 - protein, 295 aa, Anabaena sp.
DVPVNLYRPNAPFIGKVISNEPLVKEGGIGIVQHIKFDLTGGNLKYIEGQSIGIIPPGVDKNGKPEELRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 13863 - protein, 477 aa, marine gamma proteobacterium HTCC2207
MSIAASSSTKKLSILQITIVAALGGLLFGYDTGVIAGSQLYFTKYFNLSAAEQGWAVSSALYGCLVGALAGGYLTKRISRKYTLILAASLFAVSAWGSGMAATLNELAIYRIIGGLAVGMASLAAPMYIAEMAPPKYRGRMVSYYQLAVVIGFFVVFLATYFIGGGDTQNMTPEVLAQLHEHNVNQGWRIMLWSELLPALAFLGLLFTVPHSPRWLISQGRTEEAKTVLAQITSSEQEAASEFADIEASLTHSPAPNLAMLFGKGIGFALFLGVMLSIFQQVTGINAILYYGAEIFSNALGYGPEDALKQQLWLGAVNLIFTFVAIYKVDSWGRKPLFIAGSIGMCAGLTVLGLTIYTQQMGVVSLIAVLVFIASFAMSMGPVVWVMLSEMFPNNVRSVAMSIAVAAQWLFNALVANSFPLVNQSTLNQEGFNGALPYFIFASFCVVAMIFVWKLVPETKGKTLEEMEALWSAKDAG

SEQ ID NO: 13864 - protein, 260 aa, Actinophrys sol
APLNPKANRERMTQIMFETFNVPAMYVNIQAVLSLYASGRTTGCVLDSGDGVSHTIPIYEGYALPHAIVRLDLAGRDLTDYFMKILTERGYSFTTTAEREIVRDVKEKLTFVALDFDEEMKKASESSELEKSYELPDGNVIVIGNERFRCPEVLFQPSFIGKEAAGIHDCTFQTIMKCDVDIRKDLYANIVLSGGTTMFPGIAERMTKEITALAPSTMKIKVVAPPERKYSVWIGGSILASLSTFQQMWISKAEYDESGP

SEQ ID NO: 13865 - protein, 481 aa, Pseudomonas aeruginosa PAO1
MIPVILSGGSGSRLWPLSRKQYPKQFLALTGDDTLFQQTIKRLAFDGMQAPLLVCNKEHRFIVQEQLEAQNLASQAILLEPFGRNTAPAVAIAAMKLVAEGRDELLLILPADHVIEDQRAFQQALALATNAAEKGEMVLFGIPASRPETGYGYIRASADAQLPEGVSRVQSFVEKPDEARAREFVAAGGYYWNSGMFLFRASRYLEELKKHDADIYDTCLLALERSQHDGDLVNIDAATFECCPDNSIDYAVMEKTSRACVVPLSAGWNDVGSWSSIWDVHAKDANGNVTKGDVLVHDSHNCLVHGNGKLVSVIGLEDIVVVETKDAMMIAHKDRVQDVKHVVKDLDAQGRSETQNHCEVYRPWGSYDSVDMGGRFQVKHITVKPGARLSLQMHHHRAEHWIVVSGTAQVTCDDKTFLLTENQSTYIPIASVHRLANPGKIPLEIIEVQSGSYLGEDDIERLEDVYGRTAEPALQVVAGSR

SEQ ID NO: 13866 - protein, 290 aa, Actinosphaerium eichhornii
NWDDMEKIWHHTFYNELRVAPEEHPVLLTEAPLNPKANRERMTQIMFETFNVPAMYVNIQAVLSLYVSGRTTGCVLDSGDGVSHTVPIYEGYALPHAIVRLDLAGRDLTDYLMKILTERGYSFTTTAEREIVRDVKEKLTFVALDFDEEMKKATESSELEKSYELPDGNVIVIGNERFRCPEVLFQPSFIGKEASGIHDCTFQTIMKCDVDIRKDLYANIVLSGGTTMFPGIAERMTKEIVALAPSTMKIKVVAPPERKYSVWIGGSILASLSTFQQMWISKAEYDESGP

SEQ ID NO: 13867 - protein, 143 aa, Methylococcus capsulatus str. Bath
MAVERTLSIIKPDAVAKNVIGEIYSRFEKAGLRIVAAKMAQLSREQAEGFYAVHRERPFFNDLVSFMISGPVMIQVLEGENAIAKNRELMGATNPRDAAPGTIRADFAVSIDENAVHGSDGPETAAQEIAYFFESDELCPRTR

SEQ ID NO: 13868 - protein, 462 aa, Bacillus subtilis subsp. subtilis str. 168
MANKELKRGLGARHIQMIALGGTIGVGLFMGSASTISWTGPSVLLAYAICGIFIFFIMRAMGEMLYVEPSTGSFATFGHQYIHPMAGYITAWSNWFQWIIVGMSEIIAVGSYTKYWFPDLPAWIPGIVAMVILGAANLISVKSFGEFEFWFAMIKIVTIILMIIAGIGIIFFGFGNGGDAIGLSNLWSHGGFFAGGFSGFFFALSLVIAAYQGVELIGITAGEAKDPQNTLRNAIQSIIWRILIFYIGAIFVIVTVYPWDELNSLGSPFVSTFSKIGITAAAGIINFVVITAAMSGCNSGIFSAGRMLYTLGVNGQAPKFFKKISRNGVPLYGTIAVLIGLAVGVVLNYIAPPKIFVYVYSASVLPGMIPWFIILISHIGFRKAKGAALDKHPFKMPFAPFTNYLTIAFLLMVLVGMWFNDDTRISLIVGVIFLALVVISYYVFGIGKRTQANLTKSEQAAE

SEQ ID NO: 13869 - protein, 105 aa, Zea mays
MASGSGKAKASSWAAAMSVGTVEALKDQAGLCRWNYAFRQAAQQQKQRARRPAGASGSVGPGSAHAPPASAPSGCAAAARRRARQQQEEEELRTVMYLSNWGPNN

SEQ ID NO: 13870 - protein, 319 aa, Kineococcus radiotolerans SRS30216
MPQQDTTPWTPDAMGRQEGRTVLVTGANSGLGLQVATEFARRGADVLLACRNAERGRAAVAELTAAVRDSGVEPTVEVIPLDVADLASVRRAAGDVLHRRSGIDVLVNNAGVMAPPFGRTVDGFETQVGTNHLGHFAFTGLLLPALLTGGGARVVSVASVAHKFGRLNRQNYQSERSYQKWLAYGQSKLSNLLFAFELQRRAAAVGAGIVSTAAHPGLSDTNLWKNTPLAPGRVGAPLGTALSRAVGQPPAQGAWPLLRAATDPAVVGGEYFGPGGRKEWRGFPVQVQANAAAYDTADAAWLWARSVEWTGVDFRELHA

SEQ ID NO: 13871 - protein, 296 aa, Xylella fastidiosa 9a5c
MQDLKKKVILVTGASDGIGKFTAATLAKQGHKLIIHGRNRQKTEAALAEIKRQSGNPDVAMFLADFLPLAGVKAFADAIKEKYDHIDVLINNAGAQFTEQREVTSEGHEKTMAINVFAPMLLTKLLMPLLVKSESARVVTVASDAHRMAGKPDLDDIELKQGYHMAKAYSLSKLYVIWVMHHFIGETKKAGIHNVTFNLVHPASTRTNLGREAVKSWKWKIIFFLWQIMLVSMDKAASSTLYAATAPELEGVSGRYFGPKGEEQPSAKYHSPENEQKVWDYALNAIRPYLPAGAQS

SEQ ID NO: 13872 - protein, 481 aa, Vibrio cholerae O1 biovar eltor str. N16961
MSSTLRRTKIVATLGPSTESPEILEAIIRAGANVVRMNFSHGTAEDHKNRAQKVREIAAKLGRHVALLGDLQGPKIRVSTFKEGKIILNEGEHFILDAELAKGEGTQESVGIDYKKLPQDVCNDDILLLDDGRVQLQVMRVEGNKIHTKVLVGGPLSNNKGINKKGGGLSADALTEKDKNDIRLAAEIQVEYLAVSFPRNGEDMKFARRLAQESGLYARMVAKVERAETVSCDENIDDIVRASDVIMVARGDLGVEIGDPELIAVQKKLISRAKKLNRVVITATQMMESMISNPMPTRAEVMDVANAVLDGTDAVMLSGETAAGKYPVETVKAMAEVCIGAEKMIESNEQNYRIKSVFRTEEEAIAMSTIYAANHLEGVKAMVTLTESGRTALMTSRLNSVFPIFAMSANQATLNRCALLRGVIPFYFDTKQASGLEAAIAALDALKERNLLEEGDLVIITQGDIMGVEGSTNCMRILPVY

SEQ ID NO: 13873 - protein, 262 aa, Gloeobacter violaceus PCC 7421
MGMGLSIHSLRKLKERAQPIVALTATEYAMARILDQAGVDLLLVGDSLSMVALGHTSTLPVTVDELLHHCRAVRRGVERALLVADLPFGSYEQSPQQAFSTATRFLKEAGVQAVKLEGGYPRMTETVAFLTESGIPVLGHLGLTPQAVHQLGGYRVQGKTAQAAERLIDQALALEGAGAFALVLEHIPYDLAGEISGKLVIPTVGIGAGPHCNGQILVTHDLLGLTENPPPFVNPYADLRALISKAVGRYSADVRAHGSREE

SEQ ID NO: 13874 - protein, 522 aa, Candida tropicalis
MSIQDIVETYSTKWYVVVSVALIVYKVFDFFYARYLMYKLGAKPFLQSQTDGYLGFRVPFELMGKKSEGTLIDFTYQRTLELDNPDIPTFTFPIFSVSIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 13875 - protein, 554 aa, Coccidioides immitis RS
MGNEKDMEVGTTNVSAAAPPPYEKAEVGRDFVRSMVEKDLLDSRYSQTQRGLKSRHVQMMALGGTIGTGLFVGSGQALAIGGPAFLLGAYVFIGSLVLMVVTAVAEIGTYLPVHGGTMSYYGYRYVSRSLGFALGYLYWYSMGILVPNEIVAGALIIDYWESNVHIGVWITILLIVILALNVLPVQWYGESEFWFASLKVIMLLGLLILAFILFWGGGPSRQRLGFHYWKTPGAANEYILTGDKGRFIALLQCIVLSAFAFLFAPELIIQTAGEMQSPRYNIPRASRRYFYRLFFFYILGSIAIGVTCPSDNAALTNGGAGAGSSPFVVGIKNAGIPVLDSVVNAVILTSAWSSGNSYLYMSSRALYSLAVSGNAPSIFKACNRYGLPYTAMMASACFSGLSYLAVANGSSQVFNWFVSLTNTSGFISWTCCCIIYFRFRKATDVQGVERPYKSFLQPYGAYIGIVGFIFLVLINGFQVFFPQKWTVSGFFTAYIGLPAFLILYFGHRLVYRKDPWAWKPEDVDLVTGLEEILAAEQPPKVRTGPIKYISFLFE

SEQ ID NO: 13876 - protein, 483 aa, Rhodopseudomonas palustris CGA009
MLMPSDPGLLAERCLIGGKWCGEPVDAVFNPATGERIGAVPRFGTDEAEEAVRAAEIAFRQWSKLLAKQRATMLRAWFDQIIANRDDLALLLTREQGKPLAEALGEIDYAASFVEFYAEEARRIYGETIPSHRADARTMVIRQPVGVVAAITPWNFPAAMITRKVAPALAAGCTVVIKPAPETPLTALALGVLAQRAGFPPGVLNIITGDAPAIGKAWTEHPTVRAISFTGSTEVGKILMRQAASTVKKVALELGGNAPFIVFDDADLDAAVEGVIASKFRNMGQTCVCANRIYAQDGIYDAFVEKLTAKVATLQVGNGVDAGVTQGPLITTEAIAKVERHVSDAVAKGAKVVLGGKRHKLGRTFFEPTVLAGVTTAMLITREETFGPVAPVYRFTDEADVIAQANDSPFGLASYFYARDLGRVFRVAEALESGMVGVNSALLGADVVPFGGVKQSGLGREGSRHGIEEYVETKYILLGGLDR

SEQ ID NO: 13877 - protein, 229 aa, Methanothermobacter thermautotrophicus str. Delta H
MEIVIMIQEALKALRRGEIVLVFDADNRERETDMIVAAEKIKPEHIRIMRNDAGGLICVPVSWENSEKLGIPYMTDIMEEASGRYPVLGKLSPHDIPYDEKSAFSITVNHRKTFTGITDNDRALTIGELAGICRDDRHESFGDLFRSPGHVTLLRAADGHVLRRGGHTEMSIALMEMAGLTGVAVCCEMMDDRTGNSLSTEDAMKYAREHDLIFMSGAELIESYMEFRS

SEQ ID NO: 13878 - protein, 559 aa, Arabidopsis thaliana
MNFNSSYNLTFNDVFFSSSSSSDPLVSRRLFLLRDVQILELLIAIFVFVAIHALRQKKYQGLPVWPFLGMLPSLAFGLRGNIYEWLSDVLCLQNGTFQFRGPWFSSLNSTITCDPRNVEHLLKNRFSVFPKGSYFRDNLRDLLGDGIFNADDETWQRQRKTASIEFHSAKFRQLTTQSLFELVHKRLLPVLETSVKSSSPIDLQDVLLRLTFDNVCMIAFGVDPGCLGPDQPVIPFAKAFEDATEAAVVRFVMPTCVWKFMRYLDIGTEKKLKESIKGVDDFADEVIRTRKKELSLEGETTKRSDLLTVFMGLRDEKGESFSDKFLRDICVNFILAGRDTSSVALSWFFWLLEKNPEVEEKIMVEMCKILRQRDDHGNAEKSDYEPVFGPEEIKKMDYLQAALSEALRLYPSVPVDHKEVQEDDVFPDGTMLKKGDKVIYAIYAMGRMEAIWGKDCLEFRPERWLRDGRFMSESAYKFTAFNGGPRLCLGKDFAYYQMKSTAAAIVYRYKVKVVNGHKVEPKLALTMYMKHGLMVNLINRSVSEIDQYYAKSFDEGYIN

SEQ ID NO: 13879 - protein, 238 aa, Archaeoglobus fulgidus
MILDFEESLRAFRKGSPVLIYDFEDREGETDIAIPAIHVGKDEVAMMRIDGGGLICVAIHPVAAEKLGLPFMHDVLRIASEKLPEIRKVADADDIKYDSRSSFSLWVNHRDTFTGITDVDRALTIRRIGEVVDEVMMGKKVDFGREFRSPGHVALLRAADKLTYERVGQTELSVALAEMAGIAPAVAICEMLDAETGKALTKEKAMEYAEEKGIPFIDGRTIVEHYRKFREVEVSLFV

SEQ ID NO: 13880 - protein, 931 aa, Candida albicans SC5314
MFGFSLLTPGDNDHSFKAALLEFDNEFKLIADPSWNGVDVNAAMFMEEHLKETNAILLSHSTAEFISGFILLCIKFPILMSSIPVYSTLPVNQLGRVSTVEYYRAMGFLGPVDSAILELDEVDNWFDKVNLLKYQQSLNLFDNKVVVTPYNAGHSLGGTFWLITKRIDRVIYAPAWNHSKDSFLNSASFISPSTGNPHLSLLRPTAFITATDMGSVMSHRKRTEKFLQLVDATLANGGAAVLPTSLSGRFLELFHLIDEHLKGAPIPVYFLSYSGTKILTYASNLLDWMSKSFTKEWEELSSVPFNPSKVDLLLDPSELLKLSGPKIVFCSGIDLRSGDISAEAFQYLCNDEHTTIILTEKTTMNFASSLSSVLYTEWDSLAKKRGGGESEDGIAVPIDKNISLKNWTKEVELTGTELTEFQEKVAQKRKEKLLAKVRDQKNQNILSADTVDSEDSSDDDDEGDNEAEKQKGNTSSNLLIKQYQNINVADSNVAPNEVNPLATHEAFITDHIKQSLEKNLPIDLKITHKLRPRQATFPYFATAHKQKFDDYGEVIKIEDYQRHDEVSHSKIIMEGKRKFDEKRTANNRRNKNQNKQQANKLTPQEQVNRKLLQKYLDTLSNPKKRVGLNYGTKKKSETQKLKVRCGLSFVDLSGQVDLRSLGIIVQALKPYNLILLPDYTPSQNLTRVQEFFANQQNEQLQEQTKKNLAQSSRYLSLVSIRDGLSSAMSPYSSGNMNVMVVHDNESVKIGAESESGSIGINNFEVNLDDSIVKDLKWQKIGDDYKVAKLYGELELQNQFPAAKKTRTLQDYINSNTHFSLRKLDGTTAVKRQETIANQVQDPKIRALITNGPKLAIGNIRLPDLKKKLQNLNMTAEFKSEGTLVVNDILAVRKIAYGLVESDESGDIVIDGNVGPLYYKVKECIREMLAYV

SEQ ID NO: 13881 - protein, 643 aa, Streptococcus pyogenes M49 591
SISSLGINGEGVGLNYHCGLFKQVFKHNEQEAEPNYWIEDDSWLVPTDISYDVPFKNFTLKSRLDRIDVLGYRRDTKNYLNLFDIEGVDYGLIKDGISFDKTQIAKNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDENSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQNLWMTKVVHNIAKAGFFSSDRTIEQYNEDIWHSR

SEQ ID NO: 13882 - protein, 479 aa, Methylobacillus flagellatus KT
MQIQAVILSGGSGTRLWPLSRENYPKQLLTLLDNDSLLQSTLRRVDPLIGTECSPILVCNEEYRFVIAEQLRMMGRRGSILLEPVGKNTAPALTLAALEAASHGQDPILLVMPADHAIINVQDFQDTVRTGAEHAAAGKIVTFGIVPDRAETGYGYIKSGAVLEGFGSAFSIEQFVEKPDEATAQQYVVSGNYFWNSGLFMMRATVWLNAIAKTRPDILSSCKQAWDGQQRDGDFVRVDKLKFQQVPSDSIDYAVMEHVARGADNLPAGIVIPLNAGWSDVGAWDSFGKILPQDNAGNSHLGDVLFNDCSNTLAVSSGRLLACVGLQNIAVIETADAVLVIDKSKTQDVKKIVEQLKVQKRPEAKTHRKVHRPWGWYDSIDMGARFQVKRIVVNPGATLSLQMHHHRAEHWIVVTGTAKVTRGDEEFLVSENQSTYIPLGVTHMLANPGKLPLEMIEVQSGAYLGEDDIVRFNDQYGRS

SEQ ID NO: 13883 - protein, 449 aa, Oryza sativa
MALRMSIAAMSVLAVAAVLVVAGTAAAAAASCPATPPDAGATLQVSHAFGPCSPLGAESAAPSWAGFLADQAARDASRLLYLDSLAVKGRAYAPIASGRQLLQTPTYVVRARLGTPAQQLLLAVDTSNDAAWIPCSGCAGCPTSSPFNPAASASYRPVPCGSPQCVLAPNPSCSPNAKSCGFSLSYADSSLQAALSQDTLAVAGDVVKAYTFGCLQRATGTAAPPQGLLGLGRGPLSFLSQTKDMYGATFSYCLPSFKSLNFSGTLRLGRNGQPRRIKTTPLLANPHRSSLYYVNMTGIRVGKKVVSIPASALAFDPATGAGTVLDSGTMFTRLVAPVYLALRDEVRRRVGAGAAAVSSLGGFDTCYNTTVAWPPVTLLFDGMQVTLPEENVVIHTTYGTTSCLAMAAAPDGVNTVLNVIASMQQQNHRVLFDVPNGRGGFARESCTAA

SEQ ID NO: 13884 - protein, 467 aa, Myxococcus xanthus DK 1622
MVRSTCASGSSPLQDPFMSQVRLPPGPQGHFIAGNLVEFSEDPLGFLTRCAREYGDVVRLGKRNFLLNHPDLIERVLVNGDGNFVKLAGVGQGKRHKGGFPEAMMNSEGEDWLRKRRLVQPAFHRKHVAACGDTVVALTETMLQTWRPGDARDVHADVSALALDIVSRFLFHTPIDDEARHVADAVDAVMRHTDSPLRPPIWVPTPTNLRLRRALGRLNTLLATLVRRYREQPESRTDLLALLLSAPVPLSENQLRDELATMIMSGHETTADALVWAWYLLAQHPEAEARLVAELETVLGGRLPGAEDLPRLRYTEAVVKEAMRLYSPAWITSREALRDCELGGFHVPAGTMLAVSQWVTHRDARYFDAPESFRPDRWLSEDAQRMHRYVYFPFGGGPRFCIGSALAMMETVLITACVARRFRLELAPGCVVRPRPALALQPLGVWLIPRHRSHTTQEGEVRHAAGA

SEQ ID NO: 13885 - protein, 387 aa, Haloarcula marismortui ATCC 43049
MSMNAVVYKGPKEVAVEEVDEPEIEHPNDVLIDITTSCICGSDLHMYEGRTAAEPGIVFGHENMGIVTEVGEAVSSLEEGDRVVAPFNVACGFCENCEAGYTGFCTNVNPGFAGGAYGYVAMGPYKGGQAEKLRIPYADFNALKLPDGDEHEDAFSLLADIFPTGWHGTELANLEPGDSVAIYGAGPVGLMAAYSAKIKGAAEIYSVDRVPSRLELAEEHCDATPINFEDGNPVEQIKAQHGGGVDKGVDAVGYQAIDPDKEADDAYDPARENPAVVINNLIRTVKPTGELGIPGLYVPEDPGAPDDMAAQGRLGIDFGLLFEKGQALGTGQCNVKSYNRELRDLIVEGRADPSWVVSHRVGLEEAPEMYEAFDNREEGVTKVLLEP

SEQ ID NO: 13886 - protein, 326 aa, Aspergillus oryzae
MSEKEEVDLDSIINRLLEVRGSRPGKHVRLQDSEIQYLCHKAREVFISQPILLELEAPIQICGDVHGQYYDLLRLFEYGGYPPDANYLFLGDYVDRGKQSVECICLLLAYKIKYPENFFILRGNHECASINRIYGFYDECKRRYNVKLWKTFIDCFNCLPIAAIVEDKIFCMHGGLSPDLNSMEQIRRIMRPTDIPDCGLLCDLLWADPEKEITGWGENDRGVSFTFGPDVVHRFVQKHDIDLICRAHQCVEDGYEFFAKRKLVTLFSAPNYCGEFDNAGAMMSVDESLLCSFQILKPAEKKKANITRGFKSDRSNPSSSQQKKQS

SEQ ID NO: 13887 - protein, 363 aa, Pseudomonas fluorescens Pf-5
MALNSIEELVEDIRQGKMVILMDDEDRENEGDLIMAAECCKAEHINFMAKHARGLICMPMSRERCELLKLPLMAPRNGSGFGTKFTVSIEATEGVTTGISAADRARTVQAAAAKDAKAEDIVSPGHIFPLMAQPGGTLARAGHTEAACDLARMAGFEPSGVICEVMNDDGTMSRRTELEAFAAEHNIKIGTIADLIHYRMIHERTVQRIAEQPLDSELGQFNLVTYRDSVEGDVHMALTLGEICAEEPTLVRVHNMDPLRDLLMVKQPGRWSLRAAMATVAEAGSGVVLLLGHPLDGDVLLAHIRETAEHQPAKKPTTYSIVGAGSQILRDLGVRKMRLMSAPMKFNAISGFDLEVVEYVPSE

SEQ ID NO: 13888 - protein, 478 aa, Salmonella typhimurium LT2
MRQTKLYPVVMAGGSGSRLWPLSRVLYPKQFLCLKGDLTMLQTTICRLNGVECESPLVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 13889 - protein, 420 aa, Ustilago maydis 521
MTVAQTVAQADEAIKAGNNQEGERILKSILTNQSTSTDDAQLKEQEAALLRLGGLYRDTQNAEALAETVRSSRTFMSSIAKAKTAKLVRTLIDYFEGIPGSQQTQIQATKENAEWAKSERRIFLKQNLETKLIGLYFDSKNYREALPLIDTLLRELKKLDDKMILTEVHLLESKVNHAISNLPKAKAALTSARTAANSIYCPPTLQAQLDMQAGVLHAEDKDYTTAYSYFFETLEGFALQEDARAPLALKYMLLCKIMLNLSDDVNSIISGKHATKYAGRDVDAMKAVAKAHEDRSLEGFEQALRTYKEELSNDPIVKNHLSALYDTLLEQNLLRVIEPYSRVEIAHIAKEVRQPVREVEVKLSQMILDKVFHGILDQGAGCLVVYDQPVEDKTYQVTLDTLKHVGNVIDSLYKKANKLS

SEQ ID NO: 13890 - protein, 410 aa, Photobacterium profundum SS9
MLQGFRGGRTPLLLLLRLLSLLLAGTFLAGVVLANSEFRHELESNLEPFKGLLLGLFFITVGAGIDFSVLFGEFGTVIGLTLAVMLIKATVLLVLSFIFKVQGSDRWLFALSLAQAGEFGFVLLSYTVQNHVLPTDIAQTLSLVVALSMFLTPGLFILFDKVILPRFQKTENEREADVIDEQGTVIIAGIGRFGQIVNRLLVANGVKTVVLDHEVGQIENMRSIGIKSFFGDAIRPDLLHTSGIEEAKVMIVAIDDKERAVELVKYVRKTYPHIRILARAYDRGHHHALRCTGADYMISETYRSALALGTQALKDVGFHPFRAEQLKAAFVETEAKSKELLYQTWKESTEDNKFNASYRELFMQLEEALGEAMKGERSDKHAKSERGWTPPPKGYSDVVEKLQAEKGDEN

SEQ ID NO: 13891 - protein, 253 aa, Synechococcus elongatus PCC 6301
MNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 13892 - protein, 229 aa, Listeria monocytogenes str. 4b F2365
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPAGENLKVTLERVIPYWMDTIAPEIKEGRRVVIAAHGNSLRALVKFLEGIGDDEIMDLEIPTGVPLVYELNDDLKPVNKYYLDK

SEQ ID NO: 13893 - protein, 219 aa, Psychrobacter arcticus 273-4
MSDQQAQKQAAAKAALRYIEDDMILGVGTGSTVNCLIELLPTLKLAGAVASSQVTEDRLRALGIEIVDLNFAGQLDVYIDGADEVNAHLQLIKGGGGALTREKIVAAASNKFVCMVDESKSVEILGRAFPVPIEVLPQARSYVARQLARMGGEPVYREDFVTDYGNVILDTYDLDVSNPLALEQQLNNIVGVVCNGIFAANQADVLLKASSNGVEILNR

SEQ ID NO: 13894 - protein, 344 aa, Zea mays
MSKSGALDLASGLGGKINKVEVKSAVDEYEKYHGYYGGKEEARKSNYTDMVNKYYDLATSFYEYGWGESFHFAHRWNGESLRESIKRHEHFLALQLGLKPGMKVLDVGCGIGGPLREIARFSSTSVTGLNNNEYQITRGKELNRLAGISGTCDFVKADFMKMPFDDNTFDAVYAIEATCHAPDPVGCYKEIYRVLKPGQCFAVYEWCVTDHYDPNNATHKRIKDEIELGNGLPDIRSTRQCLRAVKDAGFEVVWDKDLAEDSPLPWYLPLDPSRFSLSSFRLTSVGRMITRTMVKALEYVGLAPQGSERVSSFLEKAAEGLVEGGKKEIFTPMYFFFVRKPLLE

SEQ ID NO: 13895 - protein, 112 aa, Brassica napus
  misc_feature (19)..(19): Xaa can be any naturally occurring amino acid
  unsure (1)..(112): unsure at all Xaa locations
CVVLYICFLVMGYGPIPNXFCSEISPTRVRGLCIAICAMVFWICAIIVTYSLPVLLSSIGLVGVFSIYAPVCVISWVFVYLKVPETKGMPLEVITDYFAFGAQASAPSKDDT

SEQ ID NO: 13896 - protein, 285 aa, Kluyveromyces lactis NRRL Y-1140
MSRYTLAIVGCGVMGQALLSAIYNAPKASDEALQYYPSKIIACNDVPASAELVEKLVSGFETSPNGIEVEIATNDNERAVAEAKVIILGLKPHIVEPVLQQIPNEDGSKLLISLAAGVTLNQLSQYYKKVSRVMTNTPAKYGYGTAIVSHSTSVEPQDKAIVSELVSQVGKCLELPEKNMDAATALVGSGPAFVLLMLESMMEAGLKMGIPLKESRECAMKVLEGTAKMVEISGQSPGVLKHQVCTPGGTTIAGLCVMEDKGVKSGIIRGIEEAARVSKELGQKK

SEQ ID NO: 13897 - protein, 472 aa, Oceanobacillus iheyensis HTE831
MQSYKMFVGGKWFGNNLEQIDVINPATNEQIGTIPNGGKEEAKQAVDAAHNALKEWSARTAEDRSNYLVKWHELIKEERETIAKIMTEEQGKPLKEAIGEVDYANGFISWYAEEGKRIYGDIIPASHTNKRIFVQKKPVGVVAAITPWNFPAAMITRKVGPALAVGCTVVIKPATQTPLTAFKLVELAEKAGIPRGVINIVTGSSSQIGKVWNDDGRVRKLTFTGSTEVGKILMKDAANTMKKISLELGGHAPFVVMEDADLDKAVAGVIASKFRNAGQTCVCTNRVYVHESIKDIFQDKLTEAVSKLKVGNGLEEGINIGPLIDQSAVDKVDEQVKDAISKGGRVTFGGKSLRGLYVEPTIVVDATDDMLCMYEETFGPLVPVTTFRDEEEVIARANNSPYGLAAYVFTENIGRAIRISEALEYGIVGLNDGAPSTPQAPFGGFKESGLGREGGYYGIEEFLEIKYISLAF

SEQ ID NO: 13898 - protein, 412 aa, Oryza sativa
MHEVNPASSPPISSQLISSPFSRSKDPCFPSGSAMATAVASQVAVSAPAGSDRGLRSSGIQGSNNISFSNKSWVGTTLAWESKATRPRHANKVLCMSVQQASESKVAVKPLDLESANEPPLNTYKPKEPYTATIVSVERIVGPKAPGETCHIVIDHGGNVPYWEGQSYGIIPPGENPKKPGAPHNVRLYSIASTRYGDSFDGRTTSLCVRRAVYYDPETGKEDPSKNGVCSNFLCNSKPGDKVKVTGPSGKIMLLPEEDPNATHIMIATGTGVAPFRGYLRRMFMEDVPKYRFGGLAWLFLGVANTDSLLYDEEFTSYLKQYPDNFRYDKALSREQKNKNAGKMYVQDKIEEYSDEIFKLLDGGAHIYFCGLKGMMPGIQDTLKKVAEQRGESWEQKLSQLKKNKQWHVEVY

SEQ ID NO: 13899 - protein, 459 aa, Fusobacterium nucleatum subsp. vincentii ATCC 49256
MESNQKMKFWSIVLLTINSIIGTGIFLSPGAVAKLVGDKAAIIYLAAAVFAAVLAVTFAAASKYVVKSGAAYAYAKAGFGDEVGSYVGITRVVSASIAWGVMATGVVKTTLSIFGQDSSNMKNVTIGFITLMLILLIINLIGTKLLTIISNISTIGKMGALGITIIAGIFILIFSGGNHIEELNLLKDAEGNNLIPEFTTSVFVTALIGAFYAFTGFESVASGSADMEKPEKNLPRAIPLAIAIIAAIYFGIVFVSMYIDPVAMVTSKDPVVLASIFKNQLLQKIIVIGALMSMFGINVAASFHTPRVFEAMAKEKQVPEFFAKRTKGGLPLTSFILTAAIAVVIPLAFNYNMAGIIIISSISRFIQFIIVPLAVIVFFYGKSKEEVLNANKNFMIDVVIPIIALLLTILLLIKFNWVQQFSTKLDDGTTTINLKAVISMIIGYLILPIILRIYMRAKK

SEQ ID NO: 13900 - protein, 509 aa, Arabidopsis thaliana
MDAQSVSEKLRSSGLLRTQGLIGGKWLDSYDNKTIKVNNPATGEIIADVACMGTKETNDAIASSYEAFTSWSRLTAGERSKVLRRWYNLLSRSEPLHFTKHRYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 13901 - protein, 287 aa, Streptomyces peucetius
MTASTPHHGTPRGGLSGRTVLVTGATSGIGRAAALAVARQGARVVLVGRDPERLRTVTNEVARTAGPAPDAFRADFAELRQVRDLGERLRDRYPRIDVMASNAGGMFWSRTTTQDGFEATIQVNHLAGFLLARLLRERLAGGRLILTSSDAYTQGRIDPDDLNGDRHRYSAGQAYGTSKQANIMTAAEAARRWPDVLAVSYHPGEVRTRIGRGTVASSYFRFNPFLRSAAKGADTLVWLASAPAEELTTGGYYSDRRLSPVSGPTADAGLAAKLWEAGAAAVGDTAH

SEQ ID NO: 13902 - protein, 480 aa, Erwinia carotovora subsp. atroseptica SCRI1043
MSRRLRRTKIVTTLGPATDRDNNLEKIINAGANVVRMNFSHGTAEDHQLRANKVREIAAKLGRHVAILGDLQGPKIRVSTFKEGKIFLNIGDKFLLDANLAKGEGDKEKVGIDYKGLPSDVVPGDILLLDDGRVQLKVLQVEGLKVYTEVTVGGPLSNNKGINKLGGGLSAEALTEKDKADIITAAKIGVDYLAVSFPRTGEDLNYARRLARDAGCNAKIVSKVERAEAVCSDAAMDDIILASDVVMVARGDLGVEIGDPELVGIQKKLIRRARQLNRAVITATQMMESMITNPMPTRAEVMDVANAVLDGTDAVMLSAETAAGQYPAETVAAMAKVCLGAEKIPSINVSKHRLDVQFDNTEESIAMSSMYAANHLKGVTALIAMTESGRTALMMSRISSGLPIFAMSRHEHTLNLTALYRGVTPVHFDSYTDGVAAANDAVILLRDKGFLMSGDLVIVTQGDIMGTVGTTNTIRILRVE

SEQ ID NO: 13903 - protein, 393 aa, Listeria monocytogenes str. 1/2a F6854
MDLPLSKRVKGVAPSPTLAITAKAKQMKQEGIDVIGLGAGEPDFNTPQNIIDAAIESMNKGFTKYTPSSGIIELKQAIVDKLKKDQFLNYETNQIFVGTGAKHVLYSAFQTILDPGDEVIIPVPYWVTYPEQVKLAGGIPVFVETGFDADFKISAADFEKAITKKTKAIVLNSPNNPSGMCYTKEELIAIGEVAEKHQIYILSDEIYEKLYYGNKADLVSIASLSDRLYDLTIVINGVSKAYSMTGWRIGYAAANKEIIAGMSKLADHLTSNPTANAQYAALEAYVGSQEVPEKMYKAFEERMERFYPELNSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 13904 - protein, 198 aa, Triticum aestivum
MAEQTFIMIKPDGVQRGLIGEVISRFEKNGFYLPGLQLQELEKSFADHAYSALVLQPFHARVAPYIISGPVAAMGCEGTTLASTATKITGATRSRASYPGAICGDLCARHRCAQSFHAKRFPSLWAALAPAAWPVPSQAPLARRPSPAPRGLGMHSFRRGGLALPPFSSPAGASASSAAPPPPVRPRAAVRAPDPAPL

SEQ ID NO: 13905 - protein, 449 aa, Myxococcus xanthus DK 1622
MDTLRRWLDEKGVQKVKVGAVDVDGVWRGKYISLEKFLSAAKGGLGFCDVVFGWDLSDDLLDNTQVTGWHTGYPDAHAKVDPSTGRVIPWEPDTAAFLLDFENPDGTPFEASPRQLLQKVAARARSLGYLPRFGAEYEFFIFKEQPQSLRDKDFQGLTPLTPGMFGYSWLRTSLNAPLVHALIDGCNAFGLGIEGFHTETGPGVFEAAIRYDDIEKSADKAALFKTVVKEICARHGVTACFMAKVDAKLPGCSGHVHQSLWDLDGEQNLFHDAKAPHGMSKLLRHYIGGQVALMPELTALYWPTINSYKRSVENTWAPTTVTWGLENRTTAIRVIGESAKAMRLEYRQLGADMNAYIGMAVSLAAGLWGIENEVEPPAPCESNAYAKNDAPPLPRNLKDAVALLKGSERARELLGYGFVDHFVRTREWEVRQYERAVTNWELERYLELI

SEQ ID NO: 13906 - protein, 955 aa, Ipomoea batatas
MSRLSGITPRARDDRSQFQNPRLEIAVPDRTAGLQRTKRTLLVKCVLDETKQTIQHVVTEKNEGTLLDAASIASSIKYHAEFSPAFSPERFELPKAYFATAQSVRDALIVNWNATYDYYEKLNMKQAYYLSMEFLQGRALLNAIGNLELTGEYAEALNKLGHNLENVASKEPDAALGNGGLGRLASCFLDSLATLNYPAWGYGLRYKYGLFKQRITKDGQEEVAEDWLELGNPWEIIRMDVSYPVKFFGKVITGSDGKKHWIGGEDILAVAYDVPIPGYKTRTTISLRLWSTKVPSEDFDLYSFNAGEHTKACEAQANAEKICYILYPGDESIEGKILRLKQQYTLCSASLQDIIARFERRSGEYVKWEEFPEKVAVQMNDTHPTLCIPELIRILIDLKGLSWKEAWNITQRTVAYTNHTVLPEALEKWSYELMEKLLPRHIEIIEMIDEQLINEIVSEYGTSDLDMLEKKLNDMRILENFDIPSSIANLFTKPKETSIVDPSEEVEVSGKVVTESVEVSDKVVTESEKDELEEKDTELEKDEDPVPAPIPPKMVRMANLCVVGGHAVNGVAEIHSDIVKEDVFNDFYQLWPEKFQNKTNGVTPRRWIRFCNPALSNIITKWIGTEDWVLNTEKLAELRKFADNEDLQIEWRAAKRSNKVKVASFLKERTGYSVSPNAMFDIQVKRIHEYKRQLLNILGIVYRYKQMKEMSAREREAKFVPRVCIFGGKAFATYVQAKRIAKFITDVGATINHDPEIGDLLKVIFVPDYNVSAAELLIPASGLSQHISTAGMEASGQSNMKFAMNGCILIGTLDGANVEIRQEVGEENFFLFGAEAHEIAGLRKERAEGKFVPDERFEEVKEFIKRGVFGSNTYDELLGSLEGNEGFGRGDYFLVGKDFPSYIECQEKVDEAYRDQKIWTRMSILNTAGSYKFSSDRTIHEYAKDIWNIQPVVFP

SEQ ID NO: 13907 - protein, 966 aa, Solanum tuberosum
MATANGAHLFNHYSSNSRFIHFTSRNTSSKLFLTKTSHFRRPKRCFHVNNTLSEKIHHPITEQGGESDLSSFAPDAASITSSIKYHAEFTPVFSPERFELPKAFFATAQSVRDSLLINWNATYDIYEKLNMKQAYYLSMEFLQGRALLNAIGNLELTGAFAEALKNLGHNLENVASQEPDAALGNGGLGRLASCFLDSLATLNYPAWGYGLRYKYGLFKQRITKDGQEEVAEDWLEIGSPWEVVRNDVSYPIKFYGKVSTGSDGKRYWIGGEDIKAVAYDVPIPGYKTRTTISLRLWSTQVPSADFDLSAFNAGEHTKACEAQANAEKICYILYPGDESEEGKILRLKQQYTLCSASLQDIISRFERRSGDRIKWEEFPEKVAVQMNDTHPTLCIPELMRILIDLKGLNWNEAWNITQRTVAYTNHTVLPEALEKWSYELMQKLLPRHVEIIEAIDEELVHEIVLKYGSMDLNKLEEKLTTMRILENFDLPSSVAELFIKPEISVDDDTETVEVHDKVEASDKVVTNDEDDTGKKTSVKIEAAAEKDIDKKTPVSPEPAVIPPKKVRMANLCVVGGHAVNGVAEIHSEIVKEEVFNDFYELWPEKFQNKTNGVTPRRWIRFCNPPLSAIITKWTGTEDWVLKTEKLAELQKFADNEDLQNEWREAKRSNKIKVVSFLKEKTGYSVVPDAMFDIQVKRIHEYKRQLLNIFGIVYRYKKMKEMTAAERKTNFVPRVCIFGGKAFATYVQAKRIVKFITDVGATINHDPEIGDLLKVVFVPDYNVSVAELLIPASDLSEHISTAGMEASGTSNMKFAMNGCIQIGTLDGANVEIREEVGEENFFLFGAQAHEIAGLRKERADGKFVPDERFEEVKEFVRSGAFGSYNYDDLIGSLEGNEGFGRADYFLVGKDFPSYIECQEKVDEAYRDQKRWTTMSILNTAGSYKFSSDRTIHEYAKDIWNIEAVEIA

SEQ ID NO: 13908 - protein, 902 aa, Saccharomyces cerevisiae
MPPASTSTTNDMITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDEGGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVPQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPRRLFGHLLPRHLEIIYDINWFFLQDVAKKFPKDVDLLSRISIIEENSPERQIRMAFLAIVGSHKVNGVVELHSELIKTTIFKDFIKFYGPSKFVNVTNGITPRRWLKQANPSLAKLISETLNDPTEEYLLDMAKLTQLEKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSLANVGFFSSDRCIEEYSDTIWNVEPVT

SEQ ID NO: 13909 - protein, 344 aa, Streptomyces avermitilis MA-4680
MRATLIYGAGDVRVEDVPDPKIQQPTDAVVRVLRSCICGSDLWPYKSRPATEQGERIGHEFLGVVEDVGSDVSGLKNGDLVVAPFVWSDNTCDFCAEGLHTSCRHGGWWAADGVDGGQGEAVRVPQAQGTLVKLPVAEDSALLPSLLTLSDVFCTGHHSAVTAGVDPRTTVTVVGDGAVGLSAVLAARRLGAERIILMGRHKDRTDLGRDFGATDVVPERGEEGIERVRELTGGDGTHTVLECVGTLPALQMSLGVVRAGGTVSRVGAPQYDDVPLGFQEFMNNITLTGGVAPARAYIDELLPDVLEGKVEPGRVFDRTVGLDDVPAGYRAMDDREALKVLIRP

SEQ ID NO: 13910 - protein, 275 aa, Bartonella quintana str. Toulouse
MSIHQTIKRITAAEIRSRKGQEPIVSLTAYQAYSARIADPYCDFLLVGDSVGMVVHGFETTLPVSLDMMILHGQAVMRGAKKALVVIDMPFGSYEESPEQAFSNASRILAETGCGAVKLEGGVYIAETIDFLCKRGIPVMGHIGLTPQAVNRFGGFKTQGRNESNWQQIEADAAAIEEAGAFAVVVEGVVEPLAVRLTEMLSIPTIGIGASSQCDGQILVMEDMLGYGTWVPKFVRRYGALEQEMEKAIKSYADDVKSRAFPSEAEIYKLKQKSG

SEQ ID NO: 13911 - protein, 337 aa, Zea mays
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYLDEDLLSTDFQGDNRSSIFDAKAGIALNDNFVKLVSWYDNEWGYSTRVVDLIRHMHSTK

SEQ ID NO: 13912 - protein, 432 aa, Kluyveromyces lactis NRRL Y-1140
MSALVRHSPLIGLGFLQSTVYPKKVTCYFSTCMWKCHSSIGKVIGIRTTSMRTTVPTRRICSSGRLLLQFGSRARQKQEDLDYQQAILRRNMAQHPKVICLGNPLLDIQVDVTESYLAKYGLKSNDAILVEAGSGDAKLNIFDEIVEMEDVKFVAGGAAQNTARGIAYVLGKDQVGYFGSVGEDKFSARLLKENDAAGVISLYQVQKDISTGKCAALITGHDRSLVTDLAAANHFTPDHLDKHWDLVESASLFYIGGFHLTVSPEAIVKLGKHAQENNKPFILNLSAPFIPAFFKSALEQVLPYTTYVIANESEAAAYAESFGVEADKEDLAAIAKHIVGDSKTRTVIFTHGLEPTVSVSAEGTNTYDVVPLDPSKIVDTNGAGDAFAGGFVAGLAQGKSLETAIAQGQWLAALSIQEVGPSYPAEKKQFQA

SEQ ID NO: 13913 - protein, 616 aa, Thermoplasma volcanium GSS1
MVEVKIIKSDGFFNEVLISSDKKIHFDTAYAEGDFNCFGEGSIVSETTDDLKFKIANLIPGKYHFKIAIDQYKILREAENRSGSYSFSIWLEKPYHNPDYAQFCAIIDKKLMDVRIAVPKHSISVSIFTKDTLKPVYSRRASFDTFDAVEYVFDGMSDYYFEVDNSRLPKEGYFSPKVHIEHEGGSKIIYHIFPDRFFRVGPHLPTLSRWGDKPTFSSFFGGNLRGITEKIGYIKALNVDTIYLNPVYKSKSNHRYDVDDYFSIDGLLGGEQDFIELVNEAHENGIKIVADMVFNHTSTDFPYFLDALKNGKNSKYWNWYIFHGEGAAVFDGRAKGKTKPLYETFMGVGRMPKLNHKNAEVRKFCIDVMKYYKNKFGVDGFRYDVAHSIYPEFFLEAVKEFGNEMLHIGEAWCLPSMFMLSGYWNSFTNYYLRNAIIKFVREEINITEFYNMIQNMIISYGPLIQQNVMNILDSHDTERILRAFKGNKKKVKLAYSILFMFDGFATIYYGDEVGLDGGRDPDDRRCFPWDNMDEDMLQFLKKLGEIRRMYHTGSAGIITVEETQECKYITRLSGESIIKVAIAKKPVTLEGEIILSSCGEKTIYEGDFALSIAKYA

SEQ ID NO: 13914 - protein, 257 aa, Glycine max
MATYWSHALKTIPSSFVKPVTVSAKTTSLYLTPSITKPFLPFTSSNHSLTENLKLNSTLPHFCLSSVPKKSFTCRSQAEPVDSEKVQELTVYEINERDRGSPVYLRLSYKSVNSLGDLVPFSNKLYTGDLQKRIEITSGICILIQNKAEKKGDRYEAIFSFYFGDYGHIAVQGPYLTYEDSYLAVTGGSGIFEGVKGQVKLHQIVYPFKILYTFYLKGIKDLPQELLVKTVEPIPSVEPSPAAKALEPNATIAGFTD

SEQ ID NO: 13915 - protein, 324 aa, Arabidopsis thaliana
MLHFGKILEFRNDNFVRCLNLLGIVRSMSTLKLDISRFQRRDVSKEIGDKCFHSFRILIDRLFHWLRMDYILSQRKFQLSVTEKKDASTKLYQIIRASNKSGRSIKNNRRTETTKPAGELRGEKNPAKKGNSNSSSVDHCFTSASRAFTQKKLADLKSLFFSLASKSQSNDQYVSYPVFQEYFGLSGSLGERIFDMVTQHRKDDKMTFEDLVIAKATYEKGTDDEIAEFIYQTLDVNGNGVLRRSDLESFLVVILKSVFSTESSDAESSDYKEMVDALLDAATFSKSDDGSEKGMSFEDFRSWCPLVPTIRKFLGSLLIPPGPG

SEQ ID NO: 13916 - protein, 314 aa, Sphagnum cuspidatum
VGINGFGRIGRLVARVISDRDDIELVAVNDPFISAEYMAYMFKFDSVHGQWKNHDIKAQNENSLLLGGKPVAVYGLKDPSEIPWGKHGADYIVESTGVFTDKAKAAAHLKGGAKKVVISAPSKDAPMFVMGVNEDKYTADLDIVSNASCTTNCLAPLAKVINDKFGIVEGLMTTVHSTTATQKTVDGPSHKDWRGGRAAGVNIIPSSTGAAKAVGKVLPELNGKLTGMAFRVPTIDVSVVDLTVRLEKPASYDAIKAAIRAEANGKMKGILGYTEEDVVSTDFITDSRSSIFDAKAGIALTDNFVKLVAWYDNE

SEQ ID NO: 13917 - protein, 517 aa, Lolium rigidum
MDKAYIAILSCAFLFLVHYVLGKVSHGRRGKKGAVQLPPSPPAIPFIGHLHLVEKPIHATMCRLAARLGPVFSLRLGSRRAVVVSSSECARECFTEHDVTFANRPSSRRKLLASFNGTALVTSSYGPHWRNLRRVATVQLLSAHRVACMSGVIAAEVRAMARRLFHAAEASPDGATRVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVLSLAYLQCIVSETLRLYPAAPLLLPHESSADCKVGGYNVPADTMLIVNAYAIHRDPAAWEHPLEFRPERFEDGKAEGLFMIPFGMGRRRCPGETLALRTIGMVLATLVQCFDWEPVDGVKVDMTEGGGFTIPKAVPLEAVCRPRTVMRDVLQNL

SEQ ID NO: 13918 - protein, 249 aa, Treponema pallidum subsp. pallidum str. Nichols
MRGYFIAGNWKMHKTCAEAVALAQELVRELRGGPHTYMIAPSFTALDAVGKVLRGSNVLLGAQDVSSEEWGAHTGEVSVLQLEDLGVQVVIVGHSERRHGRGENDKLINQKVRRVLESGLRVILCVGERLQEYEAGCTNEVVGTQVRAGMADVCGSLMHNVTVAYEPVWAIGTGKTATPAQANAVHAHIRSVVREMYGAAIAEALCIQYGGSMKAENARALLAEEHIDGGLIGGASLEAASFVPIARSV

SEQ ID NO: 13919 - protein, 305 aa, Sphagnum cuspidatum
GFGRIGRLVLRICLQHDDIEVVAVNDPFIDSKYMAYMFKYDSTHGIAKVDVHAVDDKTLQIGSKTVKVFGSRDPSEIPWGSAGADFIVESTGVFTTTAKAEAHFKGGAKKVIISAPSADAPMFVMGVNHESYKSGMNIVSNASCTTNCLAPLAKVVHDNFGIIEGLMTTVHATTATQKTVDGPSGKDWRGGRGASQNIIPSSTGAAKAVGKVLPELNGKLTGMSFRVPTPNVSVVDLTCRIEKGASYDEIKAAMKAASEGPMFGYLGYTEDDVVSTDFVGDSRSSIFDAKAGIALNLNFIKLVSW

SEQ ID NO: 13920 - protein, 517 aa, Lolium rigidum
MDKAYIAILSCAFLFLVHYVLGKVSDGRRGKKGAVQLPPSPPAIPFIGHLHLVEKPIHATMCRLAARLGPVFSLRLGSRRAVVVPSSECARECFTEHDVTFANRPKFPSQLLASFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLEFRPERFEDGKAEGLFMIPFGVGRRRCPGETLALRTISMVLATLVQCFDWEPVDGVKVDMTEGGGFTIPKAVPLEAVCRPRAVMRDVLQNL

SEQ ID NO: 13921 - protein, 348 aa, Marchantia polymorpha
MAGSTEPSTISSGKVKIGINGFGRIGRLVARVALERDDIELVAVNDPFISTEYMAYMFKYDSVHGRYTKNTIEAKDDKTLLFGKFPVSIFQCRDPAEIPWGQTGAEYVVESTGVFTTKDKAAAHLKGGAKKVVISAPSADAPMFVMGVNEKEYTTDIDIVSNASCTTNCLAPLAKVIHDKFGIVEGLMTTVHSITATQKTVDGPSAKDWRGGRGASFNIIPSSTGAAKAVGKVLPALNGKLTGMSFRVPTADVSVVDLTVRTEKKATYEEVKAAIKAESEGEMKGIMGYTEDDVVSTDFIGDSRSSIFDAKAGIALNDNFMKLVSWYDNEWGYSNRVVDLILHMASTQ

SEQ ID NO: 13922 - protein, 251 aa, Ehrlichia chaffeensis str. Arkansas
MKLNLSNINLPNGYTLEHHKILYSTNYEAIKLAECGAEDGTIIISDKQIKGRGRYERTWYSPTGNLYFSIIITKFKETFPLPFIAALSVGKTLEEILINNNNTTSKVEYKWPNDILVNSKKISGILLESKTLNNTLQKWIVVGIGINMYKAPTYATTIKEHNQNFTLSNLELLEKVINNFYNFRKHYIYHGFADIRNLWLKQTCHLNREITVKSYKHTYTGQFITIDTQGNMLMKQNDKTICITSGEIFNI

SEQ ID NO: 13923 - protein, 432 aa, Marchantia polymorpha
MAASSMISSTLASSISTTLQSGAKAEGRNANSQSMVAFSNQGRSVNMQTKGSFFSSTELLSSGTPSRKQQLSGPIRATATQTPTISKKSGSKEKAKIGINGFGRIGRLVLRIALSRDDVEVVAVNDPFLTADYVRYLFKYDSTHGVYPGEVEVIDENTLSVDGHKIKFFGSKTPADIPWGDSGVDYVVESTGVFTNIAKASAHLQGGAKKVIISAPSEDAPMYVMGVNEEKYSADQNIVSNASCTTNCLAPLAKIVHQEFGIVQGLMTTVHATTATQKTVDGPSGKDWRGGRGAGQNIIPSSTGAAKAVGKVLPELNGKLTGMAFRVPTPNVSVVDLTCRLEKKASYDDIKKVIKAASESSMKGILGYTEDAVVSSDFIGDARSSIFDAHAGIGLGDGFMKFVSWYDNEWGYSNRVVDLIEHIAAVVSAKKN

SEQ ID NO: 13924 - protein, 430 aa, Physcomitrella patens
  misc_feature (217)..(217): Xaa can be any naturally occurring amino acid
  unsure (1)..(430): unsure at all Xaa locations
LEGRPTPRSSAALGSSSLRASSTSRGHVSVSTSGVCAQKKNVSFSAEDSFAGSVKSLRVAASPVSRSISRSFTVRATATEFPVRTTKSGSQEKIRIGINGCGRIGRLVLRVILARDDVEVVAVNDPFIDTKYMAYLLKYDSTHGLLKSEVNAVDDNTLQVGSQTIKVFGCRDPAEIPWGSVGADFVVESTGVFTAVDKASAHFKGGAKKVVISAPSXDAPMFVMGVNQQSYKDSMNVVSNASCTTNCLAPLAKVIQDNFGIEEGLMTTVHATTATQKTVDGPSGKDWRGGRGAGQNIIPSSTGAAKAVGKVLPELNGKLTGMAFRVPTPNVSVVDLTVRLKKSGSYEDIKAAIKAASEGPMYGILGYTEDDVVSNDFVGDARSSIFDAKAGIALSDKFVKLVSWYDNEWGYSNRVVDLDLHMAGVKANLY

SEQ ID NO: 13925 - protein, 610 aa, Haloarcula marismortui ATCC 43049
MNAVNCGSPDAEVTMRSAKIVCTLGPASDSVDDIASLAKAGMSVARLNASHGSPEHRREMIDRIRQVDEAVEEPVAAMLDMPGPEVRTAEIDEPIQLTEGSTIRYVVGDDATPEEVGLSQSITAVEPGDRVLLDDGRIETTVERVEDETVFATVENGGELAARKGVNVPGVELDLPTITENDEQELDVAAEKEPDFVAASFVRDGEDIYEISQALEERGVDIPIIAKIERAGAVENLDSIIDEAYGVMVARGDLGVECPLEDVPIIQKRIIRRCHEAGVPVITATEMLDSMVHSRRPTRAEASDVANAVLDGTDAVMLSGETAIGDHPARVVETMDRIIRDVEGSEEYAESREQRVPNAGDTRTDALARSGRFLARDIGASAIVAASESGYTALKSAKYRPSIPIVASTPSERVRRKLALSWGITPVTTEYTTEGADAVIQTAVQAALDTEAADSGDTVVVLSGMMTELEGMNTANMLKVHVAAETVASGRSIVDGLVTGPVHRISTAPPRESPGDLSNVPEGAILAVPEGFDGEFVGDTSRIGGIIDGHEGVTSYAAIVARELSIPMISNADLPDAVSDGSTVTLDSERGVVYEESVGREDISGRERDY

SEQ ID NO: 13926 - protein, 811 aa, Archaeoglobus fulgidus DSM 4304
MGDNMEITLKVNQAYPSDSGRGIARLDPDTMLKLQISPGDIIEIEGARKTVAKVWRAPKRDWGKNIIRIDRFIRENAGVGVGDVVKVRKVEYQPAKTVILAPLKKMDLRIYGVDIGEYLKHQFLKRPVVEGDLVPLVGSPALSGFGRYNQQNQAVVFVAVKTEPKGPVVIDETTKVVYRDRPAKGFERFGKAGITYEDIGGLKEELQKVREVIELPLRYPELFQRLGIEPPKGVLLYGPPGTGKTLIAKAVANEIGASFFTINGPEIMSKFYGESEQRLREIFEEAKENAPSIIFIDEIDSIAPKREEVTGEVERRVVAQLLTLMDGLEERGQVIVIGATNRIDAVDPALRRPGRFDREIEIGVPDREGRYEIFQIHTRNMPLEAKYSREFVLDAIERFKRQVDDPELIKNLDFLYDEIKNSETEEEVKGAVKNLLPQEVIDELEVEITKAMLRSLADQTHGFVGADIEALCKEAAMKALRRYLPQIDLNEDEIPIELLESIRVTWDDFMDALREIEPSAMREVFVEIPKVTWNDVGGLEDVKREIIEAVEWPLKYPEKFKKFGIKPPKGVLLYGPPGTGKTLIAKAVANESEANFISIKGGQILSKWLGESEKAVRKIFRKARQVAPCIIFFDEIDAIAQMRGIDEGSRAVERVLNQLLTEMDGLEELHGVVVIGATNRPDILDPALLRPGRFDRMVYVRPPDKKSRLAIFKIHTRDMPLSEDVDLEELADLTEGYVGADIEAICREAVMLAIRENINAEKVEMRHFLEALKKIKPSVNEAMLNFYERFEEKMRTERMQVAATKPFMGYG

SEQ ID NO: 13927 - protein, 469 aa, Psychrobacter arcticus 273-4
MSNKLLDLIKSSNAKWVDFRFTDTRGKEHHMSFPAHSVDEESMEDGKMFDGSSIAGWKGIEASDMILRPDPETAFIDPFFDAVTVVVTCDIIEPSTLQGYDRDPRSIARRAEEYLKSTGIGDTAFFGPEPEFFVFDEVKWSVGMSGVSHEIVAEEAAWSTNKDYEWGNMGHRPRVKGGYVPVPPVDSSQDMRTVMCDRIEDMIGEGCIEVHHHEVAPCQLEIGVAFNTLVRKADEVQKLKYAVHNVAHQFGKTATFMPKPIVGDNGSGMHVHISISKDGVNTFSGDEYAGLSETALYFVGGIIKHARALNAITNPSTNSYKRLVPHYEAPIKLAYSASNRSASIRIPHVSSPKAVRVEARFPDPAANPYLAFAALLMAGLDGIQNKMHPGEAADKNLYDLPPEEEALIPTVAENLEVALQALKDDHEFLLKGDVFTKEMLEAYIALKQEEVQRVNITVHPVEFDLYYSC

SEQ ID NO: 13928 - protein, 253 aa, Secale cereale
MGRKFFVGGNWKCNGTVSQVETIVNTLNAGQIASPDVVEVVVSPPYVFLPTVKDKLRPEIQVAAQNCWVKKGGAFTGEVSAEMLVNLGIPWVILGHSERRSLLAESSEFVGEKVAYALAQGLKVIACVGETLEQREAGSTMEVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 13929 - protein, 472 aa, Pseudomonas putida KT2440
MPVGNHSAHGQATEGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVLGGIGIIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYTFRLAPKDAQGVTSTAS

SEQ ID NO: 13930 - protein, 493 aa, Campylobacter upsaliensis RM3195
MRINLAQNYCEVKMLKKTKIVATVGPASESEEVLRQMIINGVNVFRLNFSHGTHEYHKENLEKIRKVASELNTRIGILQDISGPKIRTGELKEPFDLKKGDRLDFYRSKILGERVDGAHYKLSINQSDILNMLKIGEYVYLYDGSIRAKIVSVNENFIQSVVENDGFLNSNKGINFPNTRINIDVITQKDKRDLLWGIENGVDFLAISFVQNAHDIDEVREILAQNGAKIAIFAKIEKFDAVENIDEIIASSDGIMVARGDLGIEVPYYKVPNIQKSIIQKANNASKPVITATQMLFSLAKAKTATRAEISDVANAVLDGTDAVMLSEESAVGIDPANAVDVMCKTIVEVEKNYPYNKFNRFDYLDDTDKIMQSSTHLAADLNADAIFALTSSGKSAIKIARYRPDIEIIAIAHSEKTLNFLSIVWGVNPAILVNKSDELTKLLKDAVRSSVERGFMSEDKCYILSAGFPTGVEGTSNLIRILKKEQIAYYLR

SEQ ID NO: 13931 - protein, 214 aa, Brassica napus
MVSFPATTETLSLALEANSSEAIQILYQVLEDPSSSPEALRVKEQAITNLCDRLTEEKRGEDLRTLLTKLRPFFSLIPKAKTAKIVRGIIDALAKIPGTTDLQITLCKEMVQWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGIL

SEQ ID NO: 13932 - protein, 396 aa, Mesorhizobium loti MAFF303099
MLAHRTNLFGTSGTAAARAAAKAAADAGKEIIDLTAGEIWSELAPTIRDGAIDAINKGVNRYTDTVGMVELREALARKISLDTGQIWKAEEVAVTSGAKQALFNAAMVLLNPGDEVIIPAPYWTTFPAQVLIAGGTPVFVDTRSNGYVPRPEHIKEAVTERTRAIVVNTPSNPAGAVYDVETLMAIAQLAVSHNLWIIFDECYGDFVHEDHTHHPIVSVAPEIRARALIVSSFSKSLALTGWRIGYLAGPKEVINAVNALQSHTTSNPNVIAQHAVLAHLQRGGSDYEGKLRSRLTSARRIGLDVLAWLTRVPVPRAQGGFYFYLDLSHLLRSASEDGASTTADDIVTALLAETGVAAVSGAAFGDPAGLRLSYGIPSEKLATGLARLVEFLNSWK

SEQ ID NO: 13933 - protein, 329 aa, Gloeobacter violaceus PCC 7421
MSTFDVFALCNPLYDLQVQVSDALLVSFGFPKGGVCLIDREQYDELIPKLAGLPIHATPGGSAANTVIGIQQLGGTTCYTGKVGADSYGAAYRNGMISRGVQANLGVGSQPTGLSVILITPDAQRTMFTYLGACRELGLFDIDPDAIAQSRYLYITGYCWDTQNQKDAVLFAMEQARAAGVPIALSLSDPFVVRRHKEELRRVVNDHVDVLFGNQEEAEVFTETSSPEAAVDVLRSYCNTAVVTMSAAGSYIAHGSHVYRIEPFAVAAVDATGAGDMYAAGLLYGLTHDLAVPATGRLASYLAARVVAQLGPRLDAIDPQVVAELLAEA

SEQ ID NO: 13934 - protein, 427 aa, Pseudomonas aeruginosa UCBPP-PA14
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHNELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 13935 - protein, 138 aa, Oryza sativa
MSSKKIVIKVDFVRAKCKAVAMTVVAKIPGVKSLAADDEKGTMTVVGEVDVVQVVGELRKAKFAAEVVSVEPEKKPEAPKKPDDPPKKPDPPPPCPPPPPPCCPGCNSCRPACQCAAAPGGGVVLYEVEADGYGCINR

SEQ ID NO: 13936 - protein, 148 aa, Mesembryanthemum crystallinum
MEQTFIMIKPDGVQRGLVGEIISRFEKKGFSLKALKFINVDRPFAEKHYADLSAKPFFNGLVEYIVSGPVVAMVWEGKGVVLTGRKIIGATNPLASEPGTIRGDFAIDIGRNVIHGSDAVESATKEIALWFPEGVVNWQSSLHSWIYE

SEQ ID NO: 13937 - protein, 243 aa, Glycine max
LELTKMRKESVEKASIICSLNELDSLGGCEGNTPEQISAQLERLNQTIRRESQRYSESIDDLRMLYKKKERKIIKRQQVYKTLRQKLDACQRALELRKRKFQRNATYLKHQLSWKFNGHLRKKGISGLIKVNYEDKTLMIEVQMPQDASNRAVRDTRGLSGGERSFSTLCFALALHEMTEAPFRAMDEFDVFMDAVSRKISLDTLVDFAEAHGSQWIFITPHDTSSVRAGDRIKKMQMAAPRS

SEQ ID NO: 13938 - protein, 167 aa, Aspergillus oryzae
MASSSTVKRLLSELKNYTNNPNEHLLHLGLVDNDDLFQWEAVLKGVKGTPYEGGLWSLSITIPPNYPNAPPTIRFNTRISHPNISFTTGEICLTLLTTEHWTPAYTLSQTLTEIHQLLTNPEPDSPLNVDVAVLLRDGDIPAWESIVRYWTEEERWQGPESASFSRA

SEQ ID NO: 13939 - protein, 455 aa, Methylobacillus flagellatus KT
MQISFFGAAGTVTGSKHLVTSGNRRVLVDCGLFQGLKVLRLKNWARFPIDPATIDAVVLTHAHIDHTGYLPLLVRQGFRGKVYCSEVTLSLCQLLLRDSAHLQEEEARYANKRGYSKHKPALPLYTKEDAEAALEHLVPLPVGRDVQILDGITVKLQLAGHILGACTVLLKDEQTSILFSGDLGRMEDPLLFPPAPPEAADYLVVESTYGNRLHEKAAPEAQLAEVINRTVKRGGSVLVPVFAVGRAQEVLYYIHKLKQAGAIPADIPVYLNSPMAVDATLIFLTHHAQHKLDAAQCRELAKVAKVVSTVEESMSLNELREPAIILAASGMASGGRVVHHLKALGPDPRNTVLFAGFQAAGTRGAALLDGAESVKIHGEYVPMRAEIASIDNLSAHADYQEIMQWLSQCPQPPKQTFIVHGEPVAADALRHRIEEERQWNVMVPEYLQTVELDGK

SEQ ID NO: 13940 - protein, 163 aa, Oryza sativa
MASATLLKSSFLPKKSEWGATRQAAAPKPVSVSMVVRAGAECKDRLFPKQVSDYTLKLLHRRIPPAVPGIMFLSGGQSEVEATQNLNAMNQVPNPWHVSFSYARALQNTCLKTWGGQPENVKAAQDALLLRAKANSLAQLGKYTSDGEAAEAKEGMFVKNYVY

SEQ ID NO: 13941 - protein, 329 aa, Nostoc punctiforme PCC 73102
MGKKYDVYGVGNALVDIEYEVSPELLQELKIDKGVMTLLDEDSQNHILENLKNLHCHKSCGGSAANTMVAISQLGGKAFYSCKVANDEFGDFYIEDLLNSQVDTNLKNGDRQSGITGKCLVLVTPDADRTMNTFLGITEKFSTQELVSSALADSEYIYIEGYLVTSPTAKEAAIKAREIAEKAGVKTAMSLSDYNMVKFFKDGLLDIIGPGLDLIFANESEALELADTQDFQVAVDKLKTLSKKFAITRGSKGSVVFDGQELIEIAAPQVKAIDTVGAGDMYAGAFLYGITQSMSYEEAGKLASTAASKIVTSYGPRLKTEELKALVSA

SEQ ID NO: 13942 - protein, 583 aa, Myxococcus xanthus DK 1622
MPHDTTLIATIAVGLGLAFVGGFVARWLKLPPLVGYLLAGVAVGPFTPGFVADGGLAGQLAEIGVILLMFGVGIHFSIKDLLAVRNIAVPGAVVQIAAATVMGTAVSHWWGWSLGAGLVFGLALSTASTVVLLRALEERGILDSVNGRIAVGWLIVEDLAMVLALVLLPALGNVLGSADTQTPATAAAGDSLIWTLAFTLGKVCLFVALMVVAGTRLVPWLLTQVAKTGSRELFTLSVLAVSLGIAFGAAALFGVSFALGAFFAGVVVSESELSHRVAEDSLPLQDAFSVLFFVSVGMLFDPMVMVKQPLEVLAVLGIIVLGKSLAAFFIVLAFRYPVNTALTVSASLAQIGEFSFILVGLGVTLGLLPKEGQSLVLSGALLSITLNPLVFKTIDPLLAWLRRHPRFAARMDPEEDELSDLPIGMGDVQLREHAVLIGYGRVGGVIGQSLTEQKIPFVVVEQNREYVERLREEGVPAIYGDAAVPGILEHAHLDTASILIVATPDALQARAIVEQAKGVNPSLPAVVRTHGDEERDYLVSLGVDRVVMGEHALARSMLDYVLERLSALKAGPLLPAPADAVVP

SEQ ID NO: 13943 - protein, 88 aa, Zea mays
IGPNVPSQLAIDLNAQGLARYAIICQENGLAPIVEPDILVDGPHDIDRCAYVTETRLAVCYKALNEHHVLLEGTLLMTNMVTPGSDCK

SEQ ID NO: 13944 - protein, 585 aa, Listeria monocytogenes str. 4b F2365
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEMLPAFEKSAAVVVEEGGLTSHAAVVGINLGIPVIVGAKDATSLVKDGEIITVDSRQGVVYNGKTATH

SEQ ID NO: 13945 - protein, 604 aa, Magnaporthe grisea 70-15
MSGAEAPLIANIDATGEVEPENASSEGIHEDGANLPRLPDAPPGLFIWLLVLSAGISGLLFGYDTGVISSTLVSIGDSLSGRQLTSLDKSVITSCTSLFALLISPFSSSIADSLGRKRVILVADFLFAVGAILQACSDTVAEMVAGRSIVGAGVGAASFVVPLYIAETAPADHRGKLITINVLFITLGQVIAYVIGWLFAEYGDKSSGWRWMVGLGAVPAVVQAVLLLGMPETPRWLVKSGREEEALEIIRRVSGGKHRSTSDRVAQRVLEEIQVEIREESEARRRLLASRDGMQSSRPEWMERWSELVKVRRNRRALTVACLLQGLQQLCGFNSLMYFSASIFTMVGFATPTLTSLTVAVTNFVFTVLALLLVDRIGRRRILLYSLPFMIAGLLLAAFAFSFISISSAPTSSPIPSAAKTGDAQLSPRAAAVMILISIMIYVASYAIGLGNVPWMQSELFSLSVRSVGSGVATGTNWLANFVVGLTFLPLMDAFGPAATFTMYGAVCGIGLVLIWRIYPETTGLSLEEAASLLEGSAWGVRDNQASFGCKISGANWDRARNHLRATIGTLKGGATGGPERIGKTDTEAPAWDLLGEGIRYYLV

SEQ ID NO: 13946 - protein, 625 aa, Silicibacter sp. TM1040
MDSFLSQASIYLAAAVIAVPIAARLGLGSVLGYLAAGIIIGPILGLVGAEAEELQHFAEFGVVMMLFLIGLELDPRALWAMRHHLIGLGGLQITASTALLAGAAIFFGHSWQVGLAVGLALSLSSTAIVLQTLSEKGLTRTGGGRATFSVLLTQDIAVIPILALLPLLATQHALSLSEDGSIVRAEEAHGAGHHSLSLVEGLPGWAVTLTTIGAIAFVILAGVYLTRPVFRFIHASNLREMYTALALLIVVGISFLMTLVGLSPALGAFLAGVVLANSEFRHELESDLEPFKGLLLGLFFITVGAGINYRLFLAEPGDVIGLALLVIFAKGAVLYFVGRAFGLRGRNHWLFTLGLAQAGEFGFVLLAFSLQLNVVTADLSEKLLLVIALTMLITPLLFILYEILSKRMKDAQVEHTPDEIDEEGTVIIAGIGRFGQIVHRLVNASGFKTVLLDSDMKAVQLMRRFGVKSFLGDPTRPELLKAAGISKAKVLVVALDDQESATKLVTYARRNYPDIHIVARAYDRNHVFELYKAGANDIVREMFDSSLRAGRYVLENIGLSEYEAAQAEQTFYAHDRHTIRELAGHWIPGTPASENPAYIKRARELEKDLETALLSLAEDHIKHRA

SEQ ID NO: 13947 - protein, 553 aa, Shigella flexneri 2a str. 301
MLAGIAIGPWGLGFISDVDEILHFSELGVVFLMFIIGLELNPSKLWQLRRSIFGVGAAQVLLSAALLAGLLMLTDFAWQAAVVGGIGFAMSSTAMALQLMREKGMNRSESGQLGFSVLLFQDLAVIPALALVPLLAGSADEHFDWMKIGMKVLEFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMAPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 13948 - protein, 108 aa, Zea mays
  misc_feature (40)..(40): Xaa can be any naturally occurring amino acid
  misc_feature (61)..(61): Xaa can be any naturally occurring amino acid
  misc_feature (90)..(90): Xaa can be any naturally occurring amino acid
  unsure (1)..(108): unsure at all Xaa locations
MLAYCGKIKDELITNAVYIGTHGKGILADDESTGTIGTRXSRINRQNVEENRTTLRELLFXSPGAIQYITHVILLDDTMHHKTKDGYPSXDVLKDAGITAWTSKGGGF

SEQ ID NO: 13949 - protein, 253 aa, Thiomicrospira crunogena XCL-2
MRQLFVAGNWKMHGDKASIKTLVTGLNAKADSVGDVLVAVCPPAIYLDYTKNCLMAGEIALGGQNMAIEPVQGAYTGETSASMLKDVGCQYVILGHSERRAIYGETDQDIAAKVKTALDSGLTPILCVGETLEERESGQLESVISQQLDAVISEVGIDQFADVVIAYEPVWAIGTGKTASAQQAQDVHAFIRGQLAKLNPSVAEKVIIQYGGSVKPNNASELFSQPDIDGGLIGGASLNADDFIAICQAAGEQ

SEQ ID NO: 13950 - protein, 141 aa, Streptococcus pyogenes M49 591
MNWLITSQPYKELNMKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRSLSSHCEDGGWILGHLINGTQAEYVHISH

SEQ ID NO: 13951 - protein, 280 aa, Triticum aestivum
  misc_feature (234)..(234): Xaa can be any naturally occurring amino acid
  unsure (1)..(280): unsure at all Xaa locations
VTLLEQVCTKKQAATGPEFPGYRRPTRPAMVTAKLSSPATARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGPRFAKWRTVVSIPWGSYWHYLSREAAWGDLLAMLAIAXQDMGLVPIWGSQRIPPQGGPWHPRKLFEVGKKRGCPKGVLLTWAKI

SEQ ID NO: 13952 - protein, 470 aa, Ehrlichia chaffeensis str. Arkansas
MFLSIEDTLNYIKKNAINFIDLRFTDSNGKWHHITRSAETINAQVLLAGVNFDSSSIPGWQSIEKSDMILLPDVSTAFMDPFSAQSTLVILCNIVDPYKQSQYSKDPRYIAQKAYKYMLSTGIADKCYFGPEVEFFIFDNAQFYAGMYNSYFKIDSAEHDILFQKREFSNNSHRPKVKGGYMPTPPIDSLHDIRSEMLTMFKEVGIIPLIHHHEVAASQCEVGFQHDELLLSADNVQKCKYIVHGVASSYGKTATFMPKPVIKDNGSGMHCHQSLWKDNVNIFVNPDGSISETCLYYIGGIIKYGKAINAFTNPSTNSYKRLVPHFEAPTWLTYSYENRSSAIRIPYVPKNDLNAKRIEARFPDPLANPYLCFSAQLMAGLYGIQNKIHPGPAIDKNLYSLDKEELQQFTSVASSLEEALDSLDNNREFLLVGDVFTNDQIDAYINLKMLEVKDLQLHPHPIEFINYYSS

SEQ ID NO: 13953 - protein, 213 aa, Malus x domestica
PIKAPILVEQGLFWDNEELISLLSKESEQNELQKPLQISPSLAGARREAVDWMLRVASHYSFSALSAVLAADYFDGFLSSLQLQVEKPWMTQLAAVACISLAAKVEETQVPLLLDFQVEDSKYVFEARTIKRMEILVLSTLQWKMNPVTPISFIDYITRRLGLKNHLCWEVLKRCELVLLSLISDSRFMSFLPSVVATAIMLHVVNNIEPCLL

SEQ ID NO: 13954 - protein, 473 aa, Myxococcus xanthus DK 1622
MKRIRQTIEVSEPLWRALELMSRDMGVDRDALVAQALFQLARQNGYVSPTAVSLGGEAQVAGGAVTAAEPVVQAAAPVVVASSVVAPPVPEPVAAAVPPVNPGGGAQESVSAVAVVADTAAPVVGAFSADDATEEPATEPPGVTSVPLSVAQVNSTELVLARMQEILAEVEASVLPSEGLAAQSDDADDDGSDDSDDEESDDADDDESDDSDDEESDDADDDESDDSDDEESDDADDEDSEESSDEDSEDDASDEDAEESSDEDSEDDASDEDAEEEDSEDDSESEEAASDDEAEVPAGSGVKGDVSSDDIAAELAALGIEDEPAEAAKVEAPVATPITARPLVARPVPKIRPPDEAATILEDQSAETTNIVKAPAPLEVFVQWAQGAPVAVSTERFTIGRGPRCSLVVKSERVSREHAVVTRVGDEVFIEDLNSSNGTWFNNERITRQQVSDGDEYMLGTEAVSFTMRPAGG

SEQ ID NO: 13955 - protein, 280 aa, Myxococcus xanthus DK 1622
MDGKVCLITGATGGIGLEAAKALARMGATVVLVGRDAGRTEAAVAAVKEAAPSAQVDWLRADLASLKSVRELAQTFRSRYPRLDVLLNNAGLIIDRRQVTEDGLEATMATNHFAPFLLTNLLLDVMKATGPARIINVSSDAHAAGKLDFDDLQSERGFIGFRVYGTSKLANILFTRALAKRLEGTQVTTNALHPGVVRTGFGHNTQGFFRHLVKLGAAFMISAEKGARTSVYLASSPEVEAVSGQYFYKCRPKKPSSAARNDALAERLWQVSEQLTGVKG

SEQ ID NO: 13956 - protein, 219 aa, Acinetobacter sp. ADP1
MSSLIQAEIFFSALSPAEQRIQQALDDIRHGKPVLVMDDFDRENEADLIVAAETLNVETMARMIRDGSGIVCFCLTEQLADHLELTPMVQNNSSQFHTAFTVTIEAAQGVTTGVSAKDRVKTIHTAIQDGAIASDLNRPGHVFPLRARDGGVLTRRGHTEATIDLARLAGLKPSGVLCELTNPDGSMATGIQVLAYAQTHHLTVITIEELVQYRIKHNV

SEQ ID NO: 13957 - protein, 289 aa, labyrinthulid quahog parasite QPX
KLIEYKTYLQGLPYFDRLDYVSMIAQEHTYSLAIESLLEIQVPIRAQYIRVIFLEITRILNHLLAVSCHALDTGAITPFFWGFEEREKLIEFYERVSGARIHAAYIRPCGVSFDLPKGLLDDIYHFCNQFKVCLDEFEELLTYNRIWRQRLVDIGIVSAKEAKAWGFSGVMLRGSGLCWDIRKNEAYEVYKKLSFNIPVGTNGDCFDRYLVRIEEMRESLCIIFQCINIIPEGPVQSHDLKYRKVGKTIIKNSIEGLIHHFKYSTEGFSVPSGEVYCATEAPKGEFGVF

SEQ ID NO: 13958 - protein, 392 aa, Oryza sativa (japonica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVQDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 13959 - protein, 423 aa, Magnaporthe grisea 70-15
MAAGDSQRLREAQEAAKSNPKKAEELYKEIVSKPPSVTSDAAVKEYELALLSLGELYRDQKNSNDLVELIKRSRTVLSSFAKAKTAKLVRQLLDFFDGIPNTTDLQVSVTKSCIEWATSERRTFLRQNLETRLVTLHMAKQSYYEALTLINGLLKELKRLDDKLMLVEVQLLESRVYHALGNISKARAALTSARTSAASVYTPPMLQANLDMQSGMLHAEDKDFNTAFSYFIEALDGYHSQDATKNATAALQYMLLCKIMLNLVDDVNTLMASKQAAKYAGQSLEAMKAIARAHANRSLEEYEQSLAAYRHELGGDAFVRSHLRRLYDAMLEQNLIKVIEPFSRVEIDHIAKMVGLDTQQVERKLSQMILDKVIIGVLDQGAGCLIIFDETQRDEAYDHALATIEKLSSVVDVLYTNQASMLE

SEQ ID NO: 13960 - protein, 387 aa, Triticum aestivum
MHPTRWELSHMVDLQAAALVISVVAAEVPSQSSICSQPPLRPSQLQISFPMAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDHFVKLVSWYDNEWGYSTRVVDLIRHMHSTK

SEQ ID NO: 13961 - protein, 169 aa, Zea mays
  misc_feature (57)..(57): Xaa can be any naturally occurring amino acid
  misc_feature (65)..(65): Xaa can be any naturally occurring amino acid
  unsure (1)..(169): unsure at all Xaa locations
IPPSRHTIASHLVSALSDPTEWYTSFIMIKTDGFHKLLVVEIISRLENKVFDLIVSXIVNAERSXANKLYIDVASCPSSTPPEIIISGPVEVMDWKGNTDSTTGRTIIVASNPQSYEAGTIQGIFAADVEKNDVHEEDGIVTADKDIALRVPEGHADCENSQHPYIYEE

SEQ ID NO: 13962 - protein, 137 aa, Helicobacter pylori J99
MKQRTLSIIKPDALKKKVVGKIIDRFESNGLEVVAMKRLHLSVKDAENFYAIHRERPFFKDLIEFMVSGPVVVMVLEGKDAVAKNRELMGATDPKLAQKGTIRADFAESIDANAVHGSDSLENAHNEIAFFFAAREF

SEQ ID NO: 13963 - protein, 417 aa, Thiomicrospira crunogena XCL-2
MSEIRNYTLNFGPQHPSAHGVLRLVLELDGETIVRSDPHIGLLHRGTEKLAEYKPFNQSIGYMDRLDYVSMMANEHAYVMGIEKMLGIEVPERAQYIRVMFDEITRILNHLMWLGAHALDIGAMTVFLYAFREREDLMDCYEAVSGARMHATYYRPGGVYRDLPDTMAKYEESKWHSGKKLDQLNETREGSLLDFIEAFTERFPGYVDEYETLLTDNRIWKQRTVDIGIVSPERALQLGFTGPMLRGSGIAWDLRKKQPYEVYDKLDFDIPVGATGDCYDRYLVRVAEMRESNKIIKQCVKWLKENPGPVISDDHKVTPPSREDAKSNMEALIHHFKLFTEGYSVPEGESYTAVEHPKGEFGIYMVSDGANKPYRLKVRAPGFAHLASLDEMAKGHMIADVVAIIGTQDIVFGEVDR

SEQ ID NO: 13964 - protein, 143 aa, Brassica napus
  misc_feature (133)..(133): Xaa can be any naturally occurring amino acid
  unsure (1)..(143): unsure at all Xaa locations
MPLSSLRSVSVPLSDRKLPTFRAFSSTAMADAGMDDVQRRLMFEDDYLVAATGFQSLWSLALATVDVYAILVKRSLQNRRLVSLFAIGDGVTSTMTFAAAFATAGITVLIDNDLNSCSANHCVQFETSTALAXFISWFAALLL

SEQ ID NO: 13965 - protein, 103 aa, Glycine max
MALRWVLYSACHVLGYPMSNTEEEAECKKGLCLANNFNEVDQYYPSSGFQMPLHYPRYTKQDYESMEEWTVDLLLKQYGLSFKGTLHEKRAFAMGAFLWPDQY

SEQ ID NO: 13966 - protein, 248 aa, Magnetospirillum magnetotacticum MS-1
MISETLPAPFSHLGLNSVGSTNDEVRRRVQDGSAADLLVVTAKRQTSGRGRRGRVWESPEGNLHASFAIRVERPLAEAAQIGFVAALALAEALDELVPGHDVRVKWPNDVLVDGRKVAGMLLESVGDGWLVLGIGVDVECRPAPSETLYATIALAELGYGGDSMVVLGALCRHFGPWLDLWRAEGFAPIRAGWLQWARGLGEAALVRLEAETLSGVFKGLDEEGGLLLDQGEAGIRRVLAGDVFFPGL

SEQ ID NO: 13967 - protein, 462 aa, Oceanobacillus iheyensis HTE831
MVKMQEWIEVTNPATGEVIDRVERGGKVEAREAVDKASEAFNDWSKRTAYERSELLMNWNALITKHQDELAEIMTMEQGKPIKEALGEVQYANNFVSWYAEEGKRLYGETIPASKADKRILVQRQPVGVIAAITPWNFPAAMITRKVAPALAVGCTAVVKPASATPRTAIRLAELAEEAGIPKGVLQVVTGSSGDISDAWMQDSRVRKISFTGSTEVGKILMKKSAETVKKVSLELGGHAPLIVMKDADIEKAAEGATASKFRNAGQTCVCTNRIYVHESIKDEFIKAFERKVRELRVGNGLEEGIDIGPLIDHDALEKVETHIRDAAHKGASIVYGGDKVGDDSLFYKPTILSNVTDNMLCMTEETFGPVAPVTTFSTEEEAVKRANHSPYGLAAYLFTENLATAIRISEQLEYGIVGINDGVPSTAQAPFGGFKESGIGREGGHHGMEEYVEVKYISIQL

SEQ ID NO: 13968 - protein, 234 aa, Helicobacter pylori J99
MTKIAMANFKSAMPVFKSHAYLKELEKTLKPQHFDRVFVFPDFLGLLPNAFLHFTLGAQNAYPRDCGAFTGEITSKHLEELKIHTLLIGHSERRVLLKESPSFLKEKFDFFKGKNFKIVYCIGEDLTTREKGFRAVKEFLSEQLENIDLNYSNLIVAYEPIWAIGTKKSASLEDIYLTHGFLKQILNQKTPLLYGGSVNAQNAKEILGIDSVDGLLIGSASLELENFKTIISFL

SEQ ID NO: 13969 - protein, 469 aa, Sinorhizobium meliloti
MTTANEVLKQIKENDVKFVDLRFTDPKGKLQHVTMDVVCVDEDMFADGVMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKPNGVEVRFPDPTANPYLAFAAMLMAGLDGIKNKLHPGKAMDKDLYDLPPKELKKIPTVCGSLREALESLDKDRKFLTAGGVFDDDQIDSFIELKMQEVMRFEMTPHPVEFDMYYSV

SEQ ID NO: 13970 - protein, 399 aa, Burkholderia mallei ATCC 23344
MSSNRGVVYQGPGKVEVRKIDYPKMVDPSGRAIGHGVILKVVSTNICGSDQHMVRGRTTAPVGLVLGHEITGEVIEVGRDAETLKIGDLVSVPFNVACGRCAMCKEQHTGVCLNVNPARAGGAYGYVDMGGWIGGQAEYVLVPYADFNLLKFPDRDRAMAKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAQEAPATVLNSLMEITRPAGAIGIPGLYVTDDPGAVDVAAKHGSLSIRFGLGWAKSHSFHTGQTPVLKYSRNLMQAILFDRLPIAEIVNVAVISLDDAPEGYKKFDGGAPRKFVIDPHGMLKAA

SEQ ID NO: 13971 - protein, 260 aa, Agrobacterium tumefaciens str. C58
MSLPQKIGFIGTGAITDAMVRGLLVKPAAVPHVMVSQRSADISARLAADFPQVIISRDNQMIVDGCDTVMLAIRPQIAEEVIRPLRFRDGQKVISVVAATSRDALLDWIGADVRLAQAIPLPFVARRKGVTAIYPADTDTAAIFNVLGNAVECTTKAEYDLLAAASALMATYFGIMQTTTEWLAENGLPEDKARAYVTPLFAGLSEVALLSGGKTDFTEMSREFATKGGLNEQVMQDFDRNGGSNALKEALSRVMERIAQ

SEQ ID NO: 13972 - protein, 136 aa, Streptococcus pyogenes M49 591
MRIADYSVTKAVLDRHGFTFKKSFGQNFLTDTNILQKIVDTAEIDQNVNVIEIGPGIGALTEFLAENAAEVMAFEIDDRLVPILADTLRDFDNVQVVNQDILKADLQTQIQQFKNPDLPIKVVANLPYYITTPILM

SEQ ID NO: 13973 - protein, 381 aa, Aspergillus oryzae
MRWFTIERLFFIWKLLKYQYSNPSFVLKAVKDVAFEDRPVPALQDPWDVRVQIAQTGICGSDVHYWQRGRIGDFVLTSPIVLGHESSGTVMDVGSAVKNLKVGDRVAIEPGIPCRHCEYCHSGSYNLCPNDRFAATPPHDGTLSKYYITQSDFCYPIPDHMNMEEGAMVEPVAVACQITKVGNVRANQKIVVFGCGPIGLLCQAVSKAYGAKKVIGVDISKSRAEFAKTFGADDVFVPPPPPADVSPEEWSEKLAKIIKEQFDLGEGPDVVLEATGAQPCIQTGIHLTKKGGTYVQAGMGRENVMFPITTACIRDLTIRGSIRYSTGCYSTAVDLIASGKVDVKRLITNRYTFEEAEQAFELVRQGKESVIKVIIEGYQGR

SEQ ID NO: 13974 - protein, 474 aa, Burkholderia vietnamiensis G4
MQPAEIGTPLRRTLGARHINLMALGATIGVGLFLGSATAIRLAGPSILLGYAFVGVFVFFVMRALGEMAVAHPVAGSFNRYAYEYIGPRAGFVTGWTYWFMWILCIMAEVTAVAIYMKFWFPGMPAWVWSLAALATMGLLNFVAVRAFGELEFWFAAIKIVTIVFMILSGIGIIGFGFGNGGVATGIGNLWRHGGFLPNGMWGLASAIPMVVFAYLGVEIIGLTAGETKNPEKSLARAVNSVFWRIAIFYIGALFIIMSLYPWNAIGTQGSPFVLTFERLGIRGAAGIINFVVLSAALSSCNSGIFGTARIVFNLAQQGQAPRIFAHTSKSGIPACAVVLTLVAALLGVLLNYVAPKGLFEWLTAIGTFAGLFSWAIILVAHYRFRRQRVAQDNRMLMPWWPYSSYCTLAFLAVLVAFMLKFDETRVAVIVGPLWLAFLWIVYGLSAKNGASRQGVPSPSASFAVEGVTRDIRD

SEQ ID NO: 13975 - protein, 158 aa, Zea mays
  misc_feature (27)..(27): Xaa can be any naturally occurring amino acid
  misc_feature (39)..(39): Xaa can be any naturally occurring amino acid
  misc_feature (47)..(48): Xaa can be any naturally occurring amino acid
  misc_feature (55)..(55): Xaa can be any naturally occurring amino acid
  misc_feature (85)..(85): Xaa can be any naturally occurring amino acid
  misc_feature (99)..(99): Xaa can be any naturally occurring amino acid
  misc_feature (122)..(122): Xaa can be any naturally occurring amino acid
  misc_feature (126)..(126): Xaa can be any naturally occurring amino acid
  unsure (1)..(158): unsure at all Xaa locations
RRWRNGAYLMMIKPDGGQRGLIGEIIXRCEKKGLYLKAXRLRNVQRXXAEQRDAXIGGCQRFSQGLVSPIISGPVGAMASMDKSXCTTGRKIMGAPNPXLVSEPGTIRGDFVVDIGRNVINXEETXVESANKEIALWFPEGPCLIGRSSQPTWHLTRG

SEQ ID NO: 13976 - protein, 294 aa, Listeria monocytogenes str. 4b F2365
MTKTLQDRMILPGNETIPYIGLGVFQVTEQEFIAGAVEKAIEVGYRLFDTAAVYNNEAIVGQAIASSAVSREELFISSKVWNGDLGFDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDAIDMEKIDRLETGKRVGPDPDDLEYFLSSIERERAYLSGENAE

SEQ ID NO: 13977 - protein, 412 aa, Burkholderia pseudomallei K96243
MKPIQKSNKLLNVCYDIRGPVLEHAKRLEDEGHRIIKLNIGNLAPFGFDAPDEIIQDMIRNLPASSGYSDSKGVFAARKAIMHYTQQKGVHGVGLDDIYIGNGASELIVMATQALLNDGDEVLLPAPDYPLWTAAVSLSGGTPVHYVCDESNRWMPDPDDIRRKITPNTKALVVINPNNPTGALYSDALLIELIAIAREHGLIIFADEVYDKIVYDGKSHTALASLAEDVITVTFNSLSKSYRSCGYRAGWMSVAGLTAENRRRAHDYLEGLGILSSMRLCANVPGQYAIQTALGGYQSINELIMPSGRLYKQRELAYDMLTSIPGVSCVKPEAALYMFPRLDPKLYPIENDQQFILELLLRERVLLVQGTGFNWPTPDHFRVVFLPNVDDLTDSIERIARFLDGYRKRNSV

SEQ ID NO: 13978 - protein, 383 aa, Listeria monocytogenes str. 4b F2365
MMNNSKIAKKHQQMPVNILADIGTLAKTMPDILDLSIGDPDLITDESIINAAFEDVRAGHTKYTESGGDVELIDAIRGYFSRNYDLSFERSQIRATVGALHGMYLTLQTILDDGDEVIIHEPYFSPYKDQVLNSGGTPIIIPTYEKDDFAINVDILEAAITDKTKALILNSPNNPTGAVFSPETFEKIANLAKKYDFFILSDEVYDGFSFYEDFVPMAKFAPDHTITFGSMSKNFAMTGWRLGYMIAPTYLNEAAKIINEGITYSAPTPSQRAAIYALNHSETLIPLVTETFQKRLEYIAKRVEEIPYLSLHPLKGSIYAFINISKTNMDSVSFTEYVLKETQVLVIPGLAFGESGDNYVRLAATQDISVLEEAFNRLAKLTF

SEQ ID NO: 13979 - protein, 472 aa, Bacillus cereus G9241
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIVFLAIVTISFYAFGIGKRPPLDVPNDQEISSK

SEQ ID NO: 13980 - protein, 303 aa, marine gamma proteobacterium HTCC2207
MRKASNEMIESLPLVNLVIEVLDARIPFSSSNPFIQDLVTEKPSIKILNKCDLADPEITQVWQDYYEQQDNTKTMALDLQHFDPSKQVIDLINKLCPQKEGRNTLVMVTGIPNVGKSSLINSLAGRHIAKTGNEPAVTKGQQKINLRNGIMLLDTPGILWPKIENPNGSYRLATTGAIKNTAVSYEDVAFFAADFLLEKYPELLQKRFKFETLPHSEIELLEIIGAQRGCLRGGGQVDLERVSTIFVNELRAGTLGNITFETPAVIDLEMKQVEVLRAEKEEREKLRLEKVAARRRKAKANRR

SEQ ID NO: 13981 - protein, 411 aa, Triticum aestivum
PTRPSTHASDYLAEAVGGNGDGSSSKGKPLLLWLNGGPGCSSLGYGAMEELGPFRVMSDGKTLYRNPYSWNHAANVLFLESPAGVGYSYSNTTADYGRSGDNKTAEDAYLFLANWLERFPEYKGREFYITGESYAGHYVPQLAHDILRHASPAINLKGIMIGNAVINDWTDNKGMYDFFWTHALISDETAEGIDKNCNFTAAGAATSALCDDASDEAGESLRDIDIYNIYAPNCQSEKLVTPPIAPSIENFDPCTDYYVDAYLNRPDVQKAMHANVTRLDHPWSACSEVLTRWVDSAKTVLPIIRELMKNNIRVWVYSGDTDGRVPVTSSRLSVNQLQLPVAAKWRPWFSSTKGAGEVGGYIVQYKGDLSLVTVRGAGHEVPSYQPRRALVLVQNFLAGKALPDCKECEQN

SEQ ID NO: 13982 - protein, 193 aa, Malus x domestica
MGFTGMIYMVTMVFSLIVLILSSSTVGFDYFQFTQQYQPAVCNFTATPCKDPPDKLFTVHGLWPSNAKGNDPEGCKTQKYQKMQILEPQLEIIWPNVYNRTANEVFWRKQWYKHGSCASPPLQNQTHYFETVIKMYRTQKQNVSYILSKANIEPKGEKRTRVDIENAIRSGTNNMVPKLKCQTNGRMTELVEV

SEQ ID NO: 13983 - protein, 400 aa, Magnetospirillum magnetotacticum MS-1
MGFLADALSRVKPSATIAMTQKARELKASGMDVISLSVGEPDFDTPDHIKEAAIDAIRRGETKYPPVSGIVPLREAIVKKFKRENGLDYKVSQTIVGTGGKHVIYNALLATLNPGDEVVIPRPYWVSYPEMVILCGGTPVFAETDMAHDFKLQPEELERAITPKTKWIILNSPSNPSGAAYTRDEMKKITDVLMRHPHVWVLTDDMYEHLTYGDFEFVTPAQVEPGLYDRTLTMNGVSKAYAMTGWRIGYAAGPEQLIKAMDFVQGQQTSGASSISQWAAVAALDGTQEHLARFKAAFQERRDLVVSMLNQSNGLKCPVPEGAFYVYPSCAELIGKTTESGKTLASDEDFVTELLQAEGVAAVHGSAFGLGPNLRISYATSNKTLEEACRRIQRFCGSLR

SEQ ID NO: 13984 - protein, 552 aa, Aspergillus nidulans FGSC A4
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLASEVTASGLIIEYWNPPVSVGLWIAIVLVESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLVCFPPSLHLNTPDQKQRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 13985 - protein, 347 aa, Rubrobacter xylanophilus DSM 9941
MKALVYHGPGEKSWESKEDPRIERPTDAVVRIDTTTICGTDLHILKGDVPEVAEGRTLGHEAVGTVVDAGPGVENFEEGDRVLVSCISACGRCAYCRRGMYGQCLQGGGWILGHLVDGTQAEFARIPFADNSLYEVPEGLSDEQVVFISDILPTGYEVGVLNGKVEPGDTVAIVGAGPIGLASMLTARLYGPSRIIAIDLADSRLEQARRFGADTTINNSAQDAVEMVMELTGGLGADVVMEAVGVPATFELCTGLVRPGGHVANIGVHGAPATLHLERLWARDVTITTGLVDTYSTPTLLRLVAEGRLDPTPFATHRFALGEILDAYETFADAARTQALKVVLSAE

SEQ ID NO: 13986 - protein, 197 aa, Zea mays
MPPVNSFVLMPLLDLFVLIHPFVVFLVRGCGDPESEFESLRRDWEVLCSDKLGLSLELGSFAAGVMISTTDLAQHTLEQIEPIRNLFAALFLASIGMLINVHFLWNHVDILLAAVILVITVKTFIVAIVVKGFGYSNKTSLLVGMSLAQIGEFAFVLLSRASSIHLIEGKLYLLLLGTTALSLVFASIPFKLFILSR

SEQ ID NO: 13987 - protein, 445 aa, Methanocaldococcus jannaschii DSM 2661
MVNSSPLWKKLMRKCKGENMALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 13988 - protein, 169 aa, Triticum aestivum
MAPTVMASSATSVAPYQGLKSTAGLPVSRRSNGASLGSVSNGGRIRCMQVWPIEGIKKFETLSYLPPLSTEALLKQVEYLIRSKWVPCLEFSKVGFIFREHNTSPGYYDGRYWTMWKLPMYGCTDSTQVINEVEEVKNEYPDAYVRIIGFDNMRQVQCVSFIAFKPPGC

SEQ ID NO: 13989 - protein, 459 aa, Burkholderia vietnamiensis G4
MMQARDVKTAADARKIVEERGLTHVEVAVTDLDGVLRGKYLSRDKFFSALENSFGFCSVLFGWDCNDELYDEACKIEYTGWHNGYRDDEVRVIPESCRELPHKNSLLFLAEAHSEHGARVCPRNLLSRVLARADELGFSVVSGFEYEFYGFNETPQSAAEKGYRDLKLLTPTSCGYSVLRAAVQSELFQDLLKIGQVMDFPIEGLHTEAGKGAMEAALSLDTGIGSADKAVLFKTFSKAVAQQRDITLSFMAKYSMEMPGCGGHIHLSLKDKDGKPVFFDAAQAHQMSKTMRHFIAGQQLLMPEFLAMVAPTVNAYSRLVPGYWAPTSATWGVDNRTCALRVVGGSPKSKRIEYRVTSADTNPYLVQAAVLASGLWGIEHELEPTPPSTGNAYVQKVSGELTLPRTLAEAAGRLRSSRAARDCFGDAFVDHFASTREWEDREYRRHVSDWELKRYFEII

SEQ ID NO: 13990 - protein, 93 aa, Glycine max
MGVTKEEVESSLKAKLNPSHLEVVDTSGGCGASFVVEIVSEQFEGKRLLERHRMVNAALEEEMKQIHALSIKKAVTPDQWKQQQESNQSNPAA

SEQ ID NO: 13991 - protein, 290 aa, Streptococcus agalactiae 2603V/R
MRIADKTVTRAILERHGFTFKKSFGQNFLTDTNILQKIVDTAEIDKGVNVIEIGPGIGALTEFLAENAAEVMAFEIDDRLIPILADTLARFDNVQVVNQDILKADLQTQIQAFKNPDLPIKVVANLPYYITTPILMHLIESKIPFAEFVVMIQKEVADRISAMPNTKAYGSLSIAVQYYMTAKVSFIVPRTVFVPAPNVDSAILKMVRRDQPVVSVQDEDFFFRVSKVAFVHRRKTLWNNLTSHFGKSEDTKAKLEKALEIAKIKPSIRGEALSIPDFASLADALKEVGI

SEQ ID NO: 13992 - protein, 125 aa, Castanea sativa
ALGGPEHVDIIQGIERGDALPGLRNYLDIAETARKVGFEVVKERDLAKPPALPWWTRLKMGRIAYWRNHILVMVLSALGIAPKGTLDVHEMLFRTADYLTRGGDSGIFSPMHMILCRKPESPASS

SEQ ID NO: 13993 - protein, 125 aa, Triticum aestivum
  misc_feature (90)..(90): Xaa can be any naturally occurring amino acid
  misc_feature (101)..(101): Xaa can be any naturally occurring amino acid
  misc_feature (107)..(107): Xaa can be any naturally occurring amino acid
  unsure (1)..(125): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLXFSKVGFIFREXNASPGXYDGRVLGNVGKLNVSGGT

SEQ ID NO: 13994 - protein, 391 aa, Rickettsia sibirica 246
MTNNTKTITLNLGPQHPATHGVLRLILEMDGEVVNNADPHIGLLHRGTEKLIEHKTYLQAIPYFDRLDYVSPMCQEHAFALAVESLLECEVPRRAQFIRVLFSELTRILNHTLNIGSQALDIGATTPLLWLFEEREKIMEFYEHVSGSRMHSNYFRPGGVAADLPEGLLEDIDKFIEQFPSKLHDIESLLNENRLWKQRLVDIGVVSQKEAMDWGFSGPMLRGSGIAWDLRKSNPYDVYDEMDFKVPIGKNGDCYDRYFVRMLEMYESIKIIKQCIEKMPKGAIKTDDPKLTPPTRAKMKESMEAMIHHFKLYTEGYDVPAGETYKAVEAPKGEFGVYLYSQGGNRPYRCRIKAPGFAHLQGLDFMSKGHLMADVITIIATLDIVFGEIDR

SEQ ID NO: 13995 - protein, 132 aa, Candida albicans SC5314
MSGGKGKAGTSEKASTSRSAKAGLTFPVGRVHRLLRKGNYAQRIGSGAPVYLTSVLEYLAAEILELAGNAARDNKKSRIIPRHLQLAIRNDEELNKLLGDVTIAQGGVLPNIHQNLLPKKSGKGGVKASQEL

SEQ ID NO: 13996 - protein, 180 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 13997 - protein, 249 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLAEREANETINVVVRQLNAIADKVQNWSKIVIAYEPVWAIGTGKTATPEQAQEVHAEIRKWATNKLGASVAEGLRVIYGGSVNGGNCKEFLKFHDIDGFLVGGASLKPEFHNIVNVHSL

SEQ ID NO: 13998 - protein, 409 aa, Triticum aestivum
MAAATTTASRPLLLSRQQAAASSLQCRLPRRPGSSLFAGQGQASTPNVRCMAVVDTPSAPAVAPARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 13999 - protein, 257 aa, Saccharophagus degradans 2-40
MNTNTKRKPIVIANWKLNGGLELICTSVASFIGKHFEADIAICPPYIYMRDMLTFLQHSEISIGSQNVSKFKSGAYTGETSAQMLKEAGCKLCLIGHSERRSMFKENNLSCQIKIGNALNHGLMPILCVGENKEEHDAKITKDVIFRQVTECLEGVELDGRKICIAYEPIWAIGTGASATPEIAQDVHSFIRQELIKLYGEETANSIRLLYGGSVTKDNAKDLLAKEDVDGLLVGGASLDPGHFLAICQHASDSSAS

SEQ ID NO: 14000 - protein, 86 aa, Zea mays
  misc_feature (30)..(30): Xaa can be any naturally occurring amino acid
  unsure (1)..(86): unsure at all Xaa locations
MAGAAKASWMVAMSVGAVEALKDQVGLCRXNYALKSIHRAANVRGGVLQGAKQLPASAEAAAEKRRGEKAEEGLRTVMYLSCWGPN

SEQ ID NO: 14001 - protein, 358 aa, Triticum aestivum
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIIWQENGLVPIVEPEILVDGPHDIDRCAYVTEVVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 14002 - protein, 339 aa, Flammulina velutipes
MAVKVGINGFGRIGRIVLRNALQVGGIEVVAVNDPFIDLEYMVYMFKYDSVHGRFKDDVHTKDGKLFIAGKPIAVFNERDPANIPWSSAGAEYIVESTGVFTTIDKASAHLKGGAKKVIISAPSADAPMFVCGVNLDKYDPKFKVISNASCTTNCLAPIAKVMHDKFGIVEALMSTIHASTATQKTVDGPSNKDWRGGRAVNNNIIPSSTGAAKAVGKVIPSLNGKLTGLAFRVPTLDVSVVDLVCRTEKSATYEEIKAAMKEASEGSLKDILGYTEDSVVSTDFVSDNRSSIFDAAAGIQLNGNFVKIIAWYDNEWGYSRRVCDLLVYAAQQDAKAQV

SEQ ID NO: 14003 - protein, 303 aa, Rubrobacter xylanophilus DSM 9941
MDGLVSKVLLATDGSREAARAAGMARELSGALGAELHVLYVQPIPEAYINQWEMAGPEFIDGIFKRAEGEARKKAEEEAAKLGKDGVAGVHAAVGRTDAEIVRVAEELGAEIVVVGSRGLGALSRALLGSVSTSVVRHAHTSVLVVRGEGRDRYLPGRILAAVDGSREAEAAARMAAEISGATGSELHLLYVLDLTPRPPYPHPLAGESWDRHLEEAKEKARAFVEERAKQLREAGAEVAVAKVAFGEPDKKIVEEAEELGASLVVTGSRGLGSLRRSLMGSVSDSVVRHAHCPVLVVRRRAE

SEQ ID NO: 14004 - protein, 294 aa, Escherichia fergusonii
IVFRAAQKRSDIEIVAINDLLDADYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYAGQDIVSNASCTTNCLAPLAKVINDNFGMIEGLMTTVHATTATQKTVDGPSHKDWRGGRGASQNIIPSSTGAAKAVGKVLPELNGKLTGMAFRVPTPNVSVVDLTVRLEKPATYEQIKAAVKAAAEGEMKGVLGYTEDDVVSTDFNGEVCTSVFDAKAGIALNDNFVKLV

SEQ ID NO: 14005 - protein, 238 aa, Rhizopus niveus
MKAVLALATLIGSTLASSCSSTALSCSNSANSDTCCSPEYGLVVLNMQWAPGYGPDNAFTLHGLWPDKCSGAYAPSGGCDSSLYSSSIASVIKSKDSSLYNSMLTYWPSNQGNNNVFWSHEWSKHGTCVSTYDPDCYDNYEEGEDIVDYFQKAMDLRSQYNVYKAFSSNGITPGGTYTATEMQSAIESYFGAKAKIDCSSGTLSDVALYFYVRGRDTYVITDALSTGSCSGDVEYPTK

SEQ ID NO: 14006 - protein, 473 aa, Pseudomonas syringae pv. tomato str. DC3000
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 14007 - protein, 577 aa, Novosphingobium aromaticivorans DSM 12444
MEPHPGIPFLREALVLLAAAGLAVPLLNRIRVNPILGYLLIGGVIGPYGLGLLAADYPFLSHAVISDIAGVRGLAEIGVVFLLFMIGLELSLERLWSGRALVFGMGSLQILLTAGLIAWIATGLGVEEPTALIVGAALSLSSTAIVMQLLIHGRRQFSAVGKTGFAILLMQDLAVVPILFMVGVIATPGSGGLAAGLAGALGKATLAIVLIYLAGRLLLRPVLRQVAQTRSPEMFTAAVLLTVIGVSALTARFGLSMALGAFLAGLLLAETEYRHQIEVDIEPFKGLLLGLFFMSVGMGIDWRQVLASPLEIAGMVTGLWLLKAVVITGLAIAFGRPRHVAAEAGMLLGQGGEFAFVIVGVAAGLGVVGGVLEQQILIVTGISMLLTPVVAHLARQLSAAMERKRLAAAADTDESFADCEGHIIIAGFGRVGQTLARALDAENVAFVALDADAAMTAGLKDRHLPVFYGDASRSEILAKAGIDHAAAVVVTMNDPEAASRIVHQIHQRWPSMPIHARARDPEHARRLLELGASFCTPETVEASLQLAANVLVGAGVDAEVTRRRITEQRAYETGDSP

SEQ ID NO: 14008 - protein, 1134 aa, Methylobacillus flagellatus KT
MNKRQLQGKLKAEKDLRFNDDPLWYKDAVIYQVHVKSFFDANNDGIGDFAGLIRKLDYIVELGVNTIWLLPFYPSPRRDDGYDIAEYKGVHPDYGTLFDVKRFIVEAHKRKLRVITELIINHTSDQHPWFQRARRAKPGSAARNFYVWSDTDTAYSQTRIIFTDTEKSNWTWDPVAGAYYWHRFFSHQPDLNFDNPRVFKAIISIMRFWLDLGVDGLRLDAVPYLIEREGTSNENLPETHEILKRIRSEIDQNYPDRMLLAEANMWPEDVQEYFGDGSNECHMAFHFPLMPRMYLALAQEDRFPISDILRQTPEIPPTCQWAIFLRNHDELTLEMVTDKERAYMLNFYATESRARLNVGIRRRLAPLLQRDRRRLELLNSLLLSMPGTPVIYYGDEIGMGDNIHLGDRDGVRTPMQWSPDRNGGFSHADPARLVLPPIMDTQYGYHAINVEAQSSDPHSLLNWMRRLLAIRKQYHAFGRGSMRLLYPNNRKILSYLRTHIPGGESADEEQIILCVANISSTAQAVELDLAEFSGYDPMEMMGGSVFPRIGQQPYVLTLGAYDFYWFRLTKNRQPLNGAGEQDGSLPEYLTLVLNQQLTSLFAPQLRRTMEQDILPAYLPCQRWYAGKQKDTLAAIQLTLLGVLDAIDPAEPPFLLAQVETSTATGADQYFLPMGVVSDEQEMPALVRRLALANVRRGPRVGALTDAFALDGFVRAVLHHLRSDSTLDSEQGSIHFNSTASLHQVDFKTELEIRRTDQEQSNSSLIINDLAVMKLLRRVQPGINPELEVARHLAKVGYANTPPLLGDVTFIDADGMPHTQVIMQAFVHNQGNAWQWTLDRLNRLLHDNLSADLMKQALAVDDASPLKELTNFAAMLGQRLAELHIALTKDTDNPSFSPEIFSAAQVETWRDKLHEQADDVLALLDRGPWSGDADAQHASAICSRREQLFQAIDELVQHVVGQPRIRIHSDFHLGQVLMISGDVMIIDFEGEPARSLEQRRQKDHPFRDVAGLLRSFSYAAAHVEKSDMGKPAGEHAERRQGLLRDYEGCSKRAFMQAYFAHSHLPPTSQAPDSAPVLAEELPAGDQAILNLCLLEKVIYEIAYEAANRPAWIGIPMRGLLGLLDEMRADGNPEQP

SEQ ID NO: 14009 - protein, 305 aa, Corynebacterium glutamicum ATCC 13032
MSVVGTGLFFGSPEEERDKLMQSLMDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 14010 - protein, 183 aa, Zea mays
  misc_feature (74)..(74): Xaa can be any naturally occurring amino acid
  misc_feature (91)..(91): Xaa can be any naturally occurring amino acid
  misc_feature (99)..(99): Xaa can be any naturally occurring amino acid
  misc_feature (102)..(102): Xaa can be any naturally occurring amino acid
  misc_feature (124)..(124): Xaa can be any naturally occurring amino acid
  misc_feature (137)..(137): Xaa can be any naturally occurring amino acid
  misc_feature (167)..(167): Xaa can be any naturally occurring amino acid
  unsure (1)..(183): unsure at all Xaa locations
MASSMLSSAAVVTSPAQATMVAPFTGLKSSAAFPVTRKANNDITSIASNGGRVSCMKVWPPVGKKKFETLSLPXLTLPKLNWVKEVDYLLXTSGFLCVXFEXEHGFVYREHGSTPEYYDARYWXMGESFPWSGCTDXSRVEGKSKKGKAENLTPFLRIFGFQNNRQXQGIIFIRKKPTSFPGG

SEQ ID NO: 14011 - protein, 321 aa, Magnaporthe grisea 70-15
MAYGAKTTGSAIVGDYASQIANKTILTTGVSPTTLGAAFVTTIATASPALLILAGRNLAKAEETAEAIRAVAPQVPIRTLELDLADKQSVRKAAATVLAWDDVAGIDVLVNNAAIITDEYGTIEGIERVFAVNHLGPFLFTNLVLPKVLAVKGRVVNVASEGHRFSNVRFMDLNFEDGKIYNKWRAYGQSKTANMLFSLSLARKLGSRGLVANSPHPGTIITPLSEGMDLALEYELTRPYDQFVGYYPKERGVIKTLDEGISTHIYAAFEPSLKDHNGTFLLDCHVADPNVDFVMSWAASEVEAEKLWKLSEELVGEKFEW

SEQ ID NO: 14012 - protein, 473 aa, Pseudomonas fluorescens Pf-5
MPVGNQLPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVVGGIGIIAFGFGNDGVALGISNLWSHGGFMPNGVTGVLMSLQMVMFAYLGVEMIGLTAGEARNPQKTIPNAIGSVFWRILLFYVGALFVILSIYPWNEIGTQGSPFVMTFERLGIKTAAGIINFVVITAALSSCNGGIFSTGRMLYSLAQNGQAPAGFAKTSNNGVPRRALLLSIFALLLGVLLNYLVPEKVFVWVTSIATFGAIWTWVMILLAQLKFRKGLSPAERAGLKYRMWLYPISSYLALAFLVLVVGLMAYFPDTRVALYVGPAFLVLLTVLFYLFKLQPTNVQQGSARSAS

SEQ ID NO: 14013 - protein, 587 aa, Aspergillus oryzae
MPRSRQPARFSSEAPSESSSSTSPDRNVDDDTDFFTAQANDSQSSVGGIATSRDVHAQNEHYVLPPIGRLPPELLIAIFAKLSSPADMLSCMLVCRGWAANCVGILWHRPSCSNWVNMKSITMTVGKEDSFFSYSDLIKRLNLSALMEEVSDGTVVPFAQCNRIERLTLTNCSKLTDKGVSDLVEGNRHLQALDVSDLRSLTDHTLYTVARNCPRLQGLNITNCVKVSDDSLIVVSENCRHIKRLKLNGVIQVTDRAITSFARNCPAILEIDLHDCKSVTNRSVTSLMATLSNLRELRLAHCTEINDLAFLELPKQLSMDSLRILDLTACENIRDDAVERIISSAPRLRNLVLAKCRFITDRAVWAICKLGKNLHYIHLGHCSNITDAAVIQLVKSCNRIRYIDLACCVRLTDRSVQELATLPKLRRIGLVKCTLITDRSISALARPKASPHSSISSLERVHLSYCVNLTMPGIHALLNNCPRLTHLSLTGVQEFLRDELTKFCREAPPEFTHQQRQVFCVFSGDGVKQLRDHLNRTVPPAREMNEATMYDDDEELDEDEGQVTGLMHATAINDDDDDYIDIGHPQG

SEQ ID NO: 14014 - protein, 313 aa, Shewanella oneidensis MR-1
MAIQWYPGHMHKARKEIEEAMPQVDLVIEVLDARIPYSSENPMVSKLRGDKPCIKLLNKSDLADPEVTAQWIEYLEREQGVKATAITTLQPGMLKMLPDLCRKLVPSRDKTEKDIRTMIMGIPNVGKSTIINTLAGRVIAKTGNEPAVTKTQQRINLRNGIVLSDTPGILWPKVDNEASSYRLAVTGAIKDTAMEYEDVALFAAGYFLKAYPKEICERYNISELPKDDMALLEEIGRKRGALRPGGRIDLHKASELLLHEYRSGKIGLLSLETPAMAEIEKAEVERILAEKAAEKAAKLEAEKLKRSGKRHND

SEQ ID NO: 14015 - protein, 158 aa, Brassica napus
  misc_feature (12)..(12): Xaa can be any naturally occurring amino acid
  misc_feature (14)..(16): Xaa can be any naturally occurring amino acid
  misc_feature (19)..(19): Xaa can be any naturally occurring amino acid
  misc_feature (21)..(22): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (50)..(50): Xaa can be any naturally occurring amino acid
  misc_feature (54)..(55): Xaa can be any naturally occurring amino acid
  misc_feature (57)..(57): Xaa can be any naturally occurring amino acid
  misc_feature (60)..(62): Xaa can be any naturally occurring amino acid
  misc_feature (65)..(65): Xaa can be any naturally occurring amino acid
  misc_feature (92)..(92): Xaa can be any naturally occurring amino acid
  misc_feature (94)..(94): Xaa can be any naturally occurring amino acid
  misc_feature (100)..(100): Xaa can be any naturally occurring amino acid
  misc_feature (105)..(105): Xaa can be any naturally occurring amino acid
  misc_feature (114)..(115): Xaa can be any naturally occurring amino acid
  misc_feature (118)..(118): Xaa can be any naturally occurring amino acid
  misc_feature (121)..(121): Xaa can be any naturally occurring amino acid
  misc_feature (126)..(126): Xaa can be any naturally occurring amino acid
  misc_feature (137)..(140): Xaa can be any naturally occurring amino acid
  misc_feature (144)..(144): Xaa can be any naturally occurring amino acid
  misc_feature (149)..(149): Xaa can be any naturally occurring amino acid
  unsure (1)..(158): unsure at all Xaa locations
MVSSMLSSAAVXTXXXQDXMXXPFTXLKSSAXFPXTRKANNDITSIASPXGRVXXMXVGXXXGKXKFETLSYLPDLTEVELYKEVDYLLRNXWXPCDEFXLQNGXVYREHGSTXXYYXGRXYWTMXKLPLVACADSXXXXNESXECKTXYPNAFIKII

SEQ ID NO: 14016 - protein, 280 aa, Sinorhizobium meliloti 1021
MPLIPRKTILEKFHGMISAGKPIIGGGAGTGISAKAEEAGGIDLIIIYNSGRYRMAGRGSAAGLLAYGNANEIVKEMALEVLPVVKATPVLAGVNGTDPFILMPQFLAELKAMGFSGVQNFPTIGLFDGRMRRGFEETGMGYGLEVDMVAEAHRLDLLTTPYVFNEEEAIAMTKAGADIVVAHMGVTTGGAIGATSAISLDDCVSEIDAIAAAARSVRKDVIVLCHGGPISMPEDARYILDRCPGCNGFYGASSMERLPAEVAIRRQTEEFKALAISTVV

SEQ ID NO: 14017 - protein, 418 aa, Glycine max
MAASSLLRSALLAPSSCDRPKVYTNASSSNLKSKGLHSSIFGTSIQCDSLVLQNCNGRGIQPIKATATEIPLPTQQSRSTGKTRVGINGFGRIGRLVLRVATFRDDVDVVAINDPFIDAKYMAYMFKYDSTHGPFKGSINILDDSTLEINGKHVKVVSKRDPAEIPWSDFGADYVIESSGVFTTVEKASSHLKAGAKKVVISAPSADAPMFVVGVNEKTYNPKMDIVSNASCTTNCLAPLAKVVNEEFGIVEGLMTTVHATTATQKTVDGPSMKDWRGGRGAAQNIIPSSTGAAKAVGKVLPELNGKLTGMAFRVPTPNVSVVDLTCRLKKNASYEDVKAAIKYASEGPLKGILGYTDEDVVSNDFVGDSRSSIFDAKAGIALSASFVKLVSWYDNEWGYSNRVLDLIEHMALVGAQN

SEQ ID NO: 14018 - protein, 398 aa, Sinorhizobium meliloti 1021
MKRIYVVGTADTKGEELVYLASCVEAAGGRPVLVDVGTRRPTVLVDISAETVAAVHPGGAAAVLSGNDRGTAIAAMGEAFARFLPARDDVAGVVGMGGGGGTSIITAGMRRLPLGLPKVMVSTLASGDVGPYVDVSDIIMMPSVTDMAGLNRVSRVILKNAAEAITAMANRPAEETASKPAIGLTMFGVTTPCVTAIVERLKADHDCLVFHATGTGGRAMEKLADSGLLSGVLDITTTEVCDLVFGGVLPATEDRFGAIARTDLPYVGSVGALDMVNFWAPETVPERYSGRLLYRHNPNVTLMRTTPEECAAIGRWIGAKLNLCSGPLRFLIPERGVSALDIEGGAFFDPAADAALFEALETTVNRSDRRRIERLPLHINDPQFAEAAVAAYRDIANP

SEQ ID NO: 14019 - protein, 166 aa, Paracoccidioides brasiliensis
FYEYGWGSSFHFCRFAYGEPFRQSIARHEHYLAHWIGLKENQLVLDVGCGVGGPAREIVKFTGVNVIGLNNNDYQIDRAIHYATKEGLSDKLRFTKGDFMQMSFEPETFDAVYAIEATVHAPSLEGIYSEIYRVLKPGGTFGVYEWVMTDKYDNDNAEHREIRLGI

SEQ ID NO: 14020 - protein, 343 aa, Bartonella henselae str. Houston-1
MNERLEDIALTLVGAGKGILAADESTATIGKRFESIGVECTEDNRRAYREMLFTAKEAMESAISGVILFDETLRQKASTGQMLTDLIRDAGAVPGIKVDTGAKPLAAFPQETITEGLDGLRERLKDYYTLGARFAKWRAVIAIDAQTLPTRGAISQNAQALARYAALCQEAGLVPIVEPEVLMDGPSRQHSITRCFEVTKVVLHTVFKELFEARVLFEGMILKPNMVIDGKDARIASVEEVAEKTVHVLKQTVPAAVPGIAFLSGGQTDEEATAHLSAMNALGALPWKLTFSYGRALQAAALKAWAGKNENIVVAQKAFCHRARMNHLAALGQWTKDQEKSCA

SEQ ID NO: 14021 - protein, 437 aa, Brassica napus var. napus
  misc_feature (150)..(150): Xaa can be any naturally occurring amino acid
  misc_feature (208)..(208): Xaa can be any naturally occurring amino acid
  unsure (1)..(437): unsure at all Xaa locations
MKGVRKTYDNSYTLSSLFVFFVLIILRPIFSTTTLSSTESLTISSNRTLVSPGNIFELGFFNTTSSSRWYLGIWYKKISERSYVWVANRDNPLSNAAGTLKISGNNLVLLGHSNRSVWSTNLTRENERSPVVAELLANGNFVMRDTNTTXSSRFLWQSFDYPTDTLLPEMKLGYEPKTGLNRFLTSWRSSDNPSSGDFSYKLEARRLXELYLSSGIFRVHRSGPWNGIRFSGIPDDKKLSYLVYNFTENSEEVAYTFLMTNKSIYSRLTVSFSGYLERQTWNPTLGMWNVSWSLPFDSQCDSYRMCGPYSYCDVNTSPICNCIQGFIPSNVEQWDQRVWANGCIRRTRLSCSGDGFIRMKNMKLPETTMATVDRSIGVKECEKKCLSDCNCTAFANADIRNGWTGCVFWTGRLDDMQNYVTDHGQDLYVRLAAADLV

SEQ ID NO: 14022 - protein, 338 aa, Ranunculus acris
MTGKIKIGINGFGRIGRLVARVALARDDVELVAVNDPFITTDYMTYMFKYDTVHGQWKHHELKVKDEKTLLFGEKPVTVFGCRNPEEIPWGETGAEFVVESTGVFTTKEKASAHLKGGAKKVVISAPSADAPMFVVGVNHTEYKSDIDIVSNASCTTNCLAPLAKVINDRFGIVEGLMTTVHAMTATQKTVDGPSSKDWRGGRAASFNIIPSSTGAAKAVGKVLPALNGKLTGMAFRVPTVDVSVVGLTVRLEKKATYADIKAAIKEESEGKLKGILGYTEDDVVSTDFIGDNRSSIFDAKAGIALNDNCVKLVSWYDNEWGYSSRVVDLIVHMSKTQ

SEQ ID NO: 14023 - protein, 563 aa, Aspergillus nidulans FGSC A4
MILLQTSLIWVVYAVVVVVLFAVASVFIYVYQSPRDRSPSVTLTCIVAITSLLATILLLPVDVALVSSTVSSSVGQRKDWATPEVVDRITFSLTLVYYILYSLDILLCLLVVPFVYFWYEEYDEVAAQTGEQSSGQRFWGASKYTLSFIAILIILFLVGVFVPISRANGGNGLDPFKSLLGENREDPHIETRSQVSANCWFAGGERALTFALGLLITIGMYVYALHTSTGLAVLPIRLIKGGPRLSNAGSWNATFTVQLDSNRERRRQLEGRCGGNFDHLSSKDRRELDALIREERTLIRRQRLAQEADGKGNALLPRMWFRLEAFFRPFRRLVGLILLLLVLLIWVSMILTASDKAKNSICKRHCGYVLGHINIFNPINEIFVQSAKLFPIDYAIFTMLVLLLFFGTVVGIATVGIRFLWISIFRIRLGHTSPQALLVMTAILMLSILALNYSISMIVAPQYATFGPQTFCDRLSGSSVLPELQCVVKRCSEAFGSDAAKKGDRVYLLALITSLLRSPKLDEQQLDEDAEEAEEEALLSGSRRNMDDRWQSIVGRASRSEDT

SEQ ID NO: 14024 - protein, 478 aa, Bartonella henselae str. Houston-1
MKRARKVKIIATLGPSSFSISMIEKLFMAGADVFRLNMSHTDRETMVDLVQRIRKVEKTVRRPIGILVDLQGPKLRVGCFDKGQEDLRIGQSFTLDDRDILGDAQRVFFPHGEVLAAIKPGDRLLIDDGKLELLAQVCDGHSVQCLVVAGNRISDRKGVSLPDTVLPFGPMTLKDKADLQAVLEQPVDWVALSFIQRPEDIIAVRALTKSKVSLMAKIEKPQALEHIEEIIDVADGIMIARGDLGVEMPLERVPAIQMELIKACRLAGKPVVVATQMLESMITSSVPTRAEVSDVATAVYTGTDAVMLSAESASGRYPEEAVLMMDRIAQQIEQDQTYAAQVGAQHPAPESTGTDAISLAARQIAETLQLTAIVAYTASGTTGVRTSRERPNRPIIALSPIVKTARRLALVWGLHCVVTEDARDLEDMVDRAAAIAFQEGFCQGGDRFLVTAGVPLGTPGATNLLRIASVSQDGTKGV

SEQ ID NO: 14025 - protein, 271 aa, Silicibacter sp. TM1040
MDMNEIAARGLVLLGCGKMGSAMLKGWLEGGLPREAVYVMDPNPSDWLKGTGVHINATVPEQPAIVLVAVKPQVMGAALPSAKSYGGGGTLFISVAAGTPISTFETMLGESTPIVRAMPNTPAAVGRGITALIGNAHVDEAKMAQADALLQAVGQTVRLDDEGQMDAVTGVSGSGPAYVFHLIETLAAAGVAQGLPEPLAMQLAKATVAGAGALAEAAEEDPSALRVNVTSPNGTTQAALEVLMDEETGFPPLLQRAVAAAAKRSEELSRG

SEQ ID NO: 14026 - protein, 120 aa, Saccharomyces cerevisiae
MTGERIEKVKINDEFAKSHFLTTQWRETKRQRHYKMPVTEQGLRERIESAIPQVYHIIVTDLSYGCGQSFDIVVVSDFFQGKSKLMRSRAVNKAVKEELQEIHAFSCKCYTEEEWSKIVV

SEQ ID NO: 14027 - protein, 416 aa, Oryza sativa
  misc_feature (269)..(269): Xaa can be any naturally occurring amino acid
  unsure (1)..(416): unsure at all Xaa locations
IMLGVLSIPSLIYFALTIFYLPESPRWLVSKGRMAEAKRVLQGLRGREDVSGEMALLVEGLGVGKDTKIEEYIIGPDDELADEGLAPDPEKIKLYGPEEGLSWVARPVHGQSALGSALGLISRHGSMVSQGKPLVDPVVTLFGSVHEKMPEIMGSMRSTLFPNFGSMFSVAEQQQAKGDWDAESQREGEDYGSDHGGDDIEDSLQSPLISRQATSVEGKEIAAPHGSIMGAVGRSSSLMQGGEAVSSMGIGGGWQLAWKWTEREGADGXKRRFLLLATIPILIVALAILILVNILDVGTMVHASLSTVSVILYFCFFVMGFGPIPNILCAEIFPTTVRGICIAICALTFWIGDIIVTYTLPVMLNAIGLAGVFGIYAVVCILAFLFVFMKVPETKGMPLEVITEFFSVGAKQAKED

SEQ ID NO: 14028 - protein, 315 aa, Helianthus tuberosus
MSISCSDCFSDLLCCEDSGILSGDDRPECSYDFEYSGDFDDSIAEFIEQERKFVPGIDYVERFQSQVLDASAREESVAWILKVQRFYGFQPLTAYLSVNYLDRFIYCRGFPVANGWPLQLLSVACLSLAAKMEETLIPSILDLQVEGAKYIFEPKTIRRMEFLVLSVLDWRLRSVTPFSFIGFFSHKIDPSGMYTGFLISRATQIILSNIQEASLLEYWPSCIAAATILCAASDLSKFSLINADHAESWCDGLSKEKITKCYRLVQSPKILPVHVRVMTARVSTESGDSSSSSSSPSPYKKRKLNNYSWIEEDKR

SEQ ID NO: 14029 - protein, 273 aa, Bradyrhizobium japonicum USDA 110
MSVQSAIRRKTAPDLRIRKNGEPIVMLTSYHAHTAALVDRHCDAILVGDSLGNVMHGFETTVPVTLEMMILQGCAVMRGSSQALVVVDMPFGSYEGSKEQAFQSAVRIMKETLCGAVKLEGGARMAETVAFLSERGIPVMGHIGLTPQSINTLGSFRAQGREEANWAPIENDARAIAEAGAFSIVIEAVAEPLARKITQSIAVPTIGIGASAACDGQILVLEDMLGLSPRSPKFVRRYGNLGPAIEEAIAGYARDVKSRAFPGPEHVYDMKKS

SEQ ID NO: 14030 - protein, 363 aa, Pseudomonas syringae pv. tomato str. DC3000
MALNNIEELVEDIRQGKMVILMDDEDRENEGDLIMAAECVKPEHINFMARFARGLICMPMTRERCETLKLPLMAPRNGSGFGTKFTVSIEAAEGVTTGISAADRARTVQAAAAKEAKAEDIVSPGHIFPLMAQAGGTLARAGHTEAACDLARMAGFEPTGLICEVMNDDGTMSRRAELEEFTLQHDIKIGTIADLIHYRMIHERTVQRIAEQPMDSELGSFNLVTYRDSVEGDVHLALTLGKICAEEPTLVRVHNMDPLRDLLMVKQPGRWSLRAAMRAVSEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 14031 - protein, 344 aa, Glycine max
MFFLSLPFSSCFRASQPNHDPTTLSTNLTTYIYHTEYGTVSLTWSRSMLGRSLHVNLHNHSSFHLHVKPWRKKGSKKLSHNTVFLWNLSSARFESGRPEPRSRFYLAIEVEHSLSLLVGDLSPKSKAKKPSKTQQQLLVLKRDHVHVAPHRSRVYQTKARLGGKVREIEIDCDGYNGNGGGYENENESSLRLLFGVDGEKVLEVTRLKWKFRGSERVEIDGVHVQISWDVHDWLFEKDKDNNHCSTNNNNNNNGNEGHAVFVFKFEEDEVRGGGGKEEEQQWSLGSGGEWRNGKSWSSSSLSVSSSVGSFGGSSSVMEWSSRRRMSWWFLLGFLWLFMLGEGEH

SEQ ID NO: 14032 - protein, 392 aa, Oceanobacillus iheyensis HTE831
MQSLYKSNIVRNMPPYLFAHIQKKKQKLMEQGSDVIDLGIGAPDLPPPSYIIEELSKHIKNRHLHRYSPYQGIPELRQAVATFYQEKYNVTLDPEEEILILIGSKEGLVHLIQSVINPGDKVILPDPGYPVYKMGVHMTQGRAVYLPLDKNKEYKPNWKMLSEQDKEEAKLLFLNYPNNPTGATAQKETFVKAVQIANKYNICIAHDAAYDHVTFSDYKSPSLLQVDGAKKVGVELGSLSKNFNMTGWRIGYIVGNSSVIQALATLKSNIDTSQFIPVQIAAIKALEQSEDEIRTIHHTMEKRMLKTWKLLKNAGFEVKKTKGTIFLWVKVPKGYTSSSFTEQVLDQAHVIVTPGSAFGEQGEGFFRIALTVPEERLIEAVQRIDSWLNGGK

SEQ ID NO: 14033 - protein, 137 aa, Streptomyces coelicolor A3(2)
MTQRSLVLLKPEAVRRGLTGEIISRIERKAGWQITALELRTLDTETLEQHYGEHKGKPFYEPLVEFMASGPVVAMVVEGERVIEGVRALAGPTDPIAAAPGSIRGDYGVIVRENLIHASDSEESAERELKIFFPGRV

SEQ ID NO: 14034 - protein, 136 aa, Corynebacterium glutamicum ATCC 13032
MTERTLILIKPDGVTNGHVGEIIARIERKGLKLAALDLRVADRETAEKHYEEHADKPFFGELVEFITSAPLIAGIVEGERAIDAWRQLAGGTDPVAKATPGTIRGDFALTVGENVVHGSDSPESAEREISIWFPNL

SEQ ID NO: 14035 - protein, 478 aa, Nicotiana tabacum
MAAVNGVGISWPSKLTQGQRPKLVFSPSPRRCTPSSSTIKMTASVDEKKKTFTLQKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGGPKAATSDTLTAPYNDISAVESLFEEHKGEVAAIILEPVVGNAGFIQPNLDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYEYLDKITGELTQGILDAGKKTGHAMCGGYIRGMFGFLFAEGPVNNFSDAKKSDTEKFGRFYRGMLEEGVYFAPSQFEAGFTSLAHTSEDIQKTVAAAEKVLKQI

SEQ ID NO: 14036 - protein, 731 aa, Cryptococcus gattii
MGKGKNHDRKANPGFGKVKSKSGTSTGEFTLKRVKGENFYRDAKSAARVKMLNGGKAVRDRDGKIVEAAAFQKGEKEAEPGRVKPDRRWFGNTRVISQSALDHFRTALKEQKADPYSVLLKRNKLPMGLLQDDTKDSGSRPHIVETEPFGDTFGPKAQRKRPRLDIGSIEELGESSAAAATAAEAATAESQANGTADLADIYHPTTSTAREPIYAKGTSRRIWGELYKVLDSSDVVIHVLDARDPLGTRCKPVVEYLRKEKAHKHLVYVLNKVDLVPTWVTSGPYAYAYANGPARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYNLEHVEGGWHGEQGATVILTAIAKKSGKLLKGGEPDQEAAAKMVLNDWIRGKIPFFVAPPAKSEPGAPTAATAAAATTTEAEKKKTEAEEQELAEERETMEILEEQERSLGKVLGIKRVKGVEQPISKIVTMTKFIGDDARRYVEEEEVVDQDKEMVEKEEEEEEEEDEDEDEEEEELAWEDVFPEEADAVDGGEEVEESDKEETDDEEDVDEEEAVPSAKQLGKRKAIDSDEEEQTANKSKRMTTNKQKATNFYTHANVKNRNRDRKVPKNPGKRSRGDDETTGKKAKKRR

SEQ ID NO: 14037 - protein, 327 aa, Rhizobium sp. NGR234
MARVFISWPGYSPRDEDTGARLIAAGHELVLRPKRGNRTADELATLLEDCDAAIVSTDPFTREVLAGDRNLKVIARVGVGTDSIDHDAAKEFGVGISVTPGMNAETVADQTLAMILGLMRRVVTQDQAVKAGRWDRVGEATPTELYRKTVGLIGAGIIGKAVIRRLLGFGVRVLYFDAMVEKVHGAERCGSLDQLLGSSDIVSLHAPLLADTRELMNAARIALMPKGSYLINTSRGGLVQQPAVFAALRSGHLAGAALDVFEVEPPGAEALADVPNLIASAHIGGISTESIARMTRSATTSVLSVLNGEIPDTVINPDALRERLAGA

SEQ ID NO: 14038 - protein, 478 aa, Nicotiana tabacum
MAAVNGVGISWPSKLTQSQRPKLVFSPSPRRCTPSSSTIKMTASVDEKKKTFTLQKSEEAFSKAKELMPGGVNSPVRAFKSVGGQPIIIDSVKGSRMRDIDGNDYIDYVGSWGPAIIGHADDEVLAALAETMKKGTSFGAPCLLENTLAEMVISAVPSIEMVRFVNSGTEACMGVLRLARAFTGRPKIIKFEGCYHGHADPFLVKAGSGVATLGLPDSPGVPKAATTDTLTAPYNDISAVESLFKEHKGEVAAIILEPVVGNAGFIQPNPDFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGPGTYDYLDKITGELTQGILDAGKKTGHAMCGGYIRGMFGFFFVEGPVNNFSDAKKSDTEKFGRFYRGMLEEGVYFAPSQFEAGFTSLAHTSEDIQRTVAAAEKVLKQI

SEQ ID NO: 14039 - protein, 114 aa, Arabidopsis thaliana
LIFLCVYLNCQEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 14040 - protein, 287 aa, Cytophaga hutchinsonii ATCC 33406
MGIRNSKTFTSTDIATYYDVSEDHYMYFWDLNQSHSLHYGYWDASTKTFREALANINRVLAEKASITAGTRVLDAGCGVGGSSIWLAKNKQANVTGITVSKKQAARANTSAAAVNPGGTAVFDVQDYTNTPYHSESFDVVWAIESVCHAANKEDFIKEAYRLLKPGGQLIMADFFIVKDGNADDQRSIDAWGHGWAVPFFEKKDAFQHMLLKAGFNTADMIDSTEHIRRSAKRLYYAFFPGWIISKLYNLVNRRTTEFSKNNVYTAYYQYKTLKKELWKYYIVHAKK

SEQ ID NO: 14041 - protein, 439 aa, Acidobacteria bacterium Ellin345
MPLLRTLTLRDVVLLIVGTVIGSGIFLVPGPVLRNVHNRVDLALAVWLLGGLLSLMGALTYGELGAMKPQAGGLYVYLRDCFGRPLAFLYGWALFFMMSSGSVATLAVAFSTYLRQIVPLNDIEAKIVASAMIVVVGVINVIGTRKSANVQNVATALKVAAILAMTVVLFALGGHSSATVTATTTQTGTLYSGFGLAMISVLWAYEGWQYCTFSAGEIADPQKTFPRALLVGSLVLVSVYVLANLGYLAALGAGGAAASNRVASDAIGAVLGPGFAKLISLAILVSMFSAANGLILTSPRVYYAMAQDGVFFRKLAEVHPRYQTPAFAVIAGCAWSIVLAVSGTFEQLLTYVIFTGWIFYAFGALAVFVYRRREPDAERPYRVPGYPVTPILFVLAATALVVNTVIAQPARAAVGLGLVLAGAPVYFIWNARSKRQAKD

SEQ ID NO: 14042 - protein, 501 aa, Ehrlichia ruminantium str. Gardel
MTNHSVILCILDGWGNNKNSQFNAIAQADTPYWDSIISQYPQSNIVTHGPDVGLPDRQIGNSEVGHISLGSGRIVLQDLCRINEEIKNIRKNTHLLEFTEQIKRNNGICHIAGLLSDGGIHSSLSHMLDIIDALSYLKIQVVIHIFLDGRDTPPISALKYINILCSHIKDLNNVSIATISGRYYSMDRDNRLDRTTKAYNSIAFGDGKRYEEPISAVQDNYNAGITDEFIIPCVIGNYQGMNPTDGFIMTNFRSDRVIQILKMITEDQNTNHITLKNTIGMIKYSNELNIPCLFPNKKISNTLGEIISNQQLHQLRIAETEKYAHVTFFFNGGREEVFENEERIIIPSPSVTTYDLVPEMSAYEITDTLIKKINLQKYSLIIINYANADMVGHTGNIEATKKAITTLDQCLGKILKCIHNTNYILVITADHGNAEEMFDVQNNMPYTAHTLNPVPFVVCNYPKKIKLKNGRLSDVAPTILEILNIKQPEEMTGISLIDTSN

SEQ ID NO: 14043 - protein, 345 aa, Streptococcus pneumoniae TIGR4
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 14044 - protein, 426 aa, Glycine max
MTEKLSNNPSLNVPLLSEWNHHDEEKAIASHPSTKNTVSFFRTCLNGLNAISGVGILSVPYALASGGWLSLVLLFAIAAAAFYTGTLIKRCMDKNSNIKTYPDIGELAFGKIGRLIISVSMYTELYLVSIGFLILEGDNLNNLCPIEEVQIAGFVIGGKQLFVILVALIILPTVWLDNLSMLSYVSASGVFASAVIILSISWTGTFDGVGFHQKGTLVNWRGIPTAVSLYAFCYCAHPVFPTLYNSMTNKHQFSNVLLVCFLLTTVGYASMAIIGYLMFGADVESQVTLNLPLNKVSSKLAIYTTLVNPISKFALMATPITNALKDLLPRAYKNRATNILVSTVLVISATIVALSVPFFGDLMSLVGAFLSVTASILLPCLCYLKISGTYNEFGCETIAIVTIIVAAIAMGISGTYTSVMEIVHHL

SEQ ID NO: 14045 - protein, 469 aa, Zea mays
KIDNSGFWRLLTVREGRCPGEAVVSQNAESQISEVMLIVQVCSTSVDEALMKEEFDKLSAALAREGAATCSPPLPLTTIVVQDHKGISNAAPTDCPLIPLLVPKGDQLDGTTEDKIRIHDHISNLKFSLSPTAFFQVNTLAAERLYTLAGDWANLNSDTLLFDVCCGTGTIGLTLAQHVGMVVGIEMNESAVSNACRNALVNGIKNCRFVCGKAEDVMGPLLTEYLGSPQQQAAASKSNSEIDDTSKTEDMIGCASYDGENIDSSKQRHDNAEGQQPMDTSVDHPTCASEVDGMDVVDCNHDENNVASGEQNCGEASLINGKPIETSSDNSLEQGKTCKDGSSSPNNNVLAANACQFKNVVAIVDPPRVGLHPTVIKALRTHPRIRRLVYISCNPDSLVANGIELCTPTPEKQEKNKGNRGWRSMSSAGLARQRTKSMPNSEPFIPKRAMAVDLFPHTPHCEMVMLFER

SEQ ID NO: 14046 - protein, 181 aa, Oryza sativa
MTEGSRKTYGADHLQNQTPESRGACLFSVAMALEQTFIMIKPDGVQRGLIGEVIGRFEKKGFYLKAMKLINVEKSFAEKHYADLSSKPFFGGLVEYIVSGPVVAMVWEGKQVVSTGRKLVGATNPLAAEPGTIRGDFAVDIGRNVIHGSDSVENARKEIALWFPEGIAQWRSNQPPWIYEV

SEQ ID NO: 14047 - protein, 119 aa, Zea mays
  misc_feature (44)..(44): Xaa can be any naturally occurring amino acid
  unsure (1)..(119): unsure at all Xaa locations
RQSEILHAEQNDYKTADIYLVGAFEAWGSLDDPKAIFILKYILXCKIMANQTDYVTGIISPIAVLKYLGPNNHAMNADSYTYSNRSLKYFETALRDYKSHLYDDHIVHRHISSLYDTLL

SEQ ID NO: 14048 - protein, 202 aa, Zea mays
ECSLFVGEVVVSPPYVFLPVVKSQLRQEFQVAAQNCWVKKGGAFTGEISAEMLVNLGVPWVILGHSERRALLGESNEGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDII

SEQ ID NO: 14049 - protein, 241 aa, Nostoc sp. PCC 7120
MRKIVIAGNWKMFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNSDVPIQYGGSVKPNNIDEIMAQPEIDGVLVGGASLEAASFARIVNYL

SEQ ID NO: 14050 - protein, 179 aa, Pyrus communis
FTQQYQPAVCNSNPTPCKDPPDKLFTVHGLWPSNVNGSDPKKCKATILNPQTITDLKAQLEIIWPNVLNRKAHVRFWRKQWRKHGACGYPTIADDMHYFSTVIEMYITKKQNVSEILSKANIKPEGRFRTRDDIVNAISPSIDYKKPKLKCKINNQTTELVEVGLCSDNNLTQFINCPH

SEQ ID NO: 14051 - protein, 486 aa, Gluconacetobacter diazotrophicus
MAKKAPSSAPTTTPSPSAEAVAKVFSLIQEHSVELVDLRFTDPRGKWHHTTQHISTIEQDTFRDGFMFDGSSIVGWKAINESDMVLLPDPTTAVMDPFSAKPQLILICDIIEPSTGQFYNRDPRATAKLAEAYLKSTGLGDTAFFGPEAEFFVFDSVKFGTGPNFGIYQLDSIEGPGASLKDYPEGNMGHRPTVKGGYFPVPPVDSENDLRAEMLSTMGEMGLPIEKHHHEVAQSQHELGTKFATLVKSADFMQIYKYCVHNVAHSYGKSATFMPKPIYGDNGSGMHVHQSIWKSGKPVFAGNGYADLSDQALYYIGGIIKHAKALNAFTNPSTNSYKRLIPGFEAPVLLAYSARNRSASCRIPYATSPKAKRVEVRFPDPTANPYLAFAAMLMAGLDGIKNKIHPGDAMDKDLYDLPPDELKQIPTVCGSLREALEALTADHEFLLAGGVFTKDQIESYIDIKWQEVFKFEHTPHPAEFEMYYSV

SEQ ID NO: 14052 - protein, 487 aa, Legionella pneumophila subsp. pneumophila str. Philadelphia 1
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLIITYINLAKVDTFGEIEFWLALIKIISLLAFVFLAILIFFGLIHGSEPPGIIGFKYLLGDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 14053 - protein, 535 aa, Magnaporthe grisea 70-15
MGLVEVVLEHVSVKAAVLWIVGSWVLYLVVKNVLEERKINKLGARAARMPSRLPLSLDNIIRAVRANIQNRNLQMWRSHMSHSITYTVEGRLLFQRIILTADPENIKAILATQFTDYGKGEPFHQEWKPFLGDSIFATDGEKWHTSRQMLRPQFVKDRVSDLECFESHIKTLFKAMANGGALEGEHQHVELSAINGKRFEITDLFFRFSLDVATDFLLGYDVKSLSTPHAEFAEAFNEVQHVQSTITRSGPAQALVPKGSYYRGLKVMDNFINPFIDRALRLSPDELASKTKSDHGYTFLHELASFTRDRKVLRDQIVAVLLAGRDTTAATLSWTIYELGRHPECVKRLRQEIAEVVGFGRTPTYADLKSMKYLQNVMHETLRLYPAVPFNVRLALHDTTLPRGGGPDGTLPVPVLKDTPIGYSTLLMQRRRDLYPPVSENFADPDVFSPERWFHWQPRPWQYVPFNGGPRICIGQQFALTEMGYVLVRMFQQYERVVSYMDEIDGGNPTIKADIVMQPGDGVIVAFWEGDNEKI

SEQ ID NO: 14054 - protein, 429 aa, Legionella pneumophila str. Lens
MFKRIALVCALFSGVCFAEGKQLLDKVVAIVNDNVITSSELNAQVELSKKQIIAQNMQMPDESVLRKQVLQHLIDVDLEMQMAKQNGITIENAEIDEAIEKIAASNHLNLSQMRDEITKQGISWQEYRQNIRKEMLISRVQQKAVGKDIIVTNEQVDQYLKTAGRIENSNLTYHLKNIVIPLSEEPTTRQLQRAKIEAENLLNKIKKGEDFSRLAIEESSGEFALEGGDLGERHLAELPEVFAKEVVHMKVGQVAGPIRAGNGFHLIKLVAVGGENQRHVITQTHVRHILLKPDASMVPSEAIKQVNNIYRQIQSGKDFALMAKQYSLDAASAVKGGDLGWVNPGELVPEFEKTMNSLPLHKVSKPVKTQYGWHLIEVIARRQKDDSEAFKKQQVRQFLQQRKFVEAVQNWQQHLRSQAYINIVDKDLA

SEQ ID NO: 14055 - protein, 390 aa, Methylobacillus flagellatus KT
MRALTYHGSKDVRIETVPDPVLQADDDIIIRVTSTAICGSDLHLYRGKIPQLHDGDILGHEFMGIVEDTGHGVTEVRKGDRVIIPFVIACGHCFFCAQQQFAACETTNPGPGPSLNKKSGTPPAALFGYSHLYGGIPGGQAELVRVPHGNVGPFKINGSLADEQVLFLTDILPTGYQAVLNAGVGKGSSLAIFGAGPVGLMAAACARMMGVETIFMIDDLQYRLDFAQAQYNTISINLDEVEDPADYILEHTAHRGVDGSIDAVGFEAKGSVVESALTALKLETSNGKVIRQCIAATRRGGTVSIPGVYAGFIHGFLIGDAFDKGLTFKMGQTHVHRFLPELLEFIENGDLHPADIITHRMALEDAPLGYRIFNDAEENCRKVVLTPGLH

SEQ ID NO: 14056 - protein, 180 aa, Arabidopsis thaliana
  misc_feature (35)..(35): Xaa can be any naturally occurring amino acid
  misc_feature (87)..(87): Xaa can be any naturally occurring amino acid
  misc_feature (96)..(96): Xaa can be any naturally occurring amino acid
  misc_feature (101)..(101): Xaa can be any naturally occurring amino acid
  misc_feature (144)..(144): Xaa can be any naturally occurring amino acid
  unsure (1)..(180): unsure at all Xaa locations
MASSMLSSATMTASPDQATMNTPFDGLKSSDAFHXTRKANNDITSITSNDERVNCMQVWPPIGKKKFETLSYLPDLTDSELPKECDXLIRNKWIPXDEFEXEHGFVYRGHAKSPGYYEGRYWTMRKLHLFGSTDSARVLEEVQXCNNEYHNACIMIIGLDNTRQVQCIMIIAYKPPSFTG

SEQ ID NO: 14057 - protein, 489 aa, Burkholderia vietnamiensis G4
MQKSPTEARHRETAVDVRSAEFIQYTSNGSAAISAQIQEESNSALGHGLKQRHVVMLSIGGSIGAGLFVGSGHAIAEAGPAAIVAYIFASLLVVLVMRMLGEMACAMPDSGSFSTYAGKAIGPWAGFTIGWMYWWFWVLVVPLEATAAANILNSWFPDVAVWKFCLGVTLLLTATNLVSVKHYGELEFWFATIKVVAIILFIACGVAAILGFIPGLHINATANIFSDGGFAPKGWAPIAGAMLTTMFTFLGTEVVTIAAAESANPAREISRAITSVVWRISLFYLGSILVIIAIVPWNDPSLTTIGSYQAVLQKIGVPYAKFIIDALILVAVGSCLNSAIYTASRMIFSLGARGQAPRAVTRTSRSGVPVAAVLASTLVAFVGCAANYLAPKSVFDALLSTTGAIALLVYLVIALSQLRMRRRILLTSKLKVRMWLHPFLGLFVVFLITGALVVMVSGETHRQEVVATLAFSGLLAVAGYAHQRWQRRR

SEQ ID NO: 14058 - protein, 452 aa, Acinetobacter sp. ADP1
MNNDSSKLQRGLKNRHIQLIAMGGAIGTGLFLGSAQVIQSAGPSIILGYAIGGLIAFLIMRQLGEMIVHEPVAGSFSHFAYKYWGKFPGFLAGWNYWVLYILVAMTELTAVGKYINYWWPQIPAWQSVLFFFVVITLVNLTNVKFYGESEFWLAIIKVVAVISMIIFGLYLLFTADSSSTASFSNLWAHGGFFPNGFEGLFYMLAFLMFAFGGIELIGMAAAEAENPAKTIPKAINQVVFRILVFYVGSLTILLSLVPWNQLDLGGLDKSPFVMIFSQLGIGWAAHLLNFIILTAALSVYNSGMFANSRMLFGLAQQGNAPKIFTKVNKQGVPIPAVLFSALLIFGCVLLNYFVPEDALGHLMYVVVGALVLNWAMISLTHLKFKAAVKKLKLNVTFPALWAPVSNYLVLIFIALVLFIMWQQGFKESVIMIPVWIVLMFGLFHLLTNKDHT

SEQ ID NO: 14059 - protein, 515 aa, Halothermothrix orenii
MKLKRLSFFMFVTLLVFISVFPVYANDFEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 14060 - protein, 266 aa, Bacillus licheniformis ATCC 14580
MAEGMISGIVQSKKLPASQIYVTNHTNHRRLEELQQKYGIQGVKKEQLDYQNIDCFILAMKPKDAEGALNSMKPHIKPHQLIVSVLAGISISFIENTLHDMQPVIRIMPNTSSAIGASATAMAEGSHVTADLSKTAKQLLQCMGEVYSIEESKMDIFTGIAGSGPAYFYYLMEHIEKAGAEAGLSQKLTREIGAQTLLGAAKMLLESPEDTAVLKDNITSPNGTTAAGLKALEESGGGEAIEQAVKQAAKRSKTISLELEQLVAAK

SEQ ID NO: 14061 - protein, 408 aa, Hericium erinaceum
MLRAFLTTSAILASVVLANARLPGFSSADSHSLFKRISSGCSTSGAASCSSGSVGNTCCTESPGGLLLQTQFWDTNPSTGPSNSWTIHGLWPDNCDGTFEENCDSSRDYTNIAGLLQAQGASDTLSFMQEFWVDINGQNEQFWEHEWATHGTCMSTLEPSCLPSGSPTGAEAVAFYQTVVKLFKSLPTYDWLSQEGITPSSSKTYTLSDFTSALNKASGFTPALNCNGNTVNQISWYFHLKGSIIDGNFVAIDTPASGSCPSSGLKYPLKSGSSTSTSAGTSPTGSPGGLPSKATISALTSSGSSLGGLLSAGKWSTQTPGTYTISGSSNSFTLTSSKGACAVTSGEFACGGSSSSTFSAVTSGSNLLLAFQGSTAFSSDASPSGQAQETVFTGSSHSVQFSLTLIST

SEQ ID NO: 14062 - protein, 473 aa, Zea mays
MAGAAAAAVASGVSARPAAPRRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVAAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHEMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 14063 - protein, 269 aa, Oceanicola granulosus HTCC2516
MDMNDVKTRGLVLLGCGKMGSAMLAGWLRGGLPPEAVWVIDPKPSDWLQAQGVNLNAGLPPSPAILLVAVKPQMMDDALGAAEIDARTLVVSVAAGTLLARFEATFGADTPVVRAMPNTPAAVGRGITALIGNAAANDDHLALAEALLSAVGQTVRLESESQMDAVTAVSGSGPAYVFHLIETLAAAGEAEGLSPELAMQLARATVGGAGQLAEDADETPGQLRINVTSPNGTTQAALEVLMDAESGFPALLRRAVHAAAERSRELGRG

SEQ ID NO: 14064 - protein, 329 aa, Gibberella zeae PH-1
MSPHSASTTVNELVNEYADIIKGKVILTTGVTLNSLGGLFIQETASKSPELLILAGRNASKLQELAEAIAKGYPSVKTRNLVVDLSSLASVRKAAEGVNSWEDVPVIDVLVNNAGIMAVPYAKSVDGFESQFAICHLSHFLLTNLIMDKILASKSPRIVNISSNVHSLGPVRFADPHFSNGETYNEWSAYGQAKTSNALFSISLAQKLGGRGLQSYSVHPGLILTTGLGTHLDFASMEGDLGAIIKAHRERGNTEGWKFLDPVPVEVGAATHAFAAFDPNLRANNGAYLLETRVSDPFVDTYKSWARDPVDAEKLWRLSEELVGQKFGY

SEQ ID NO: 14065 - protein, 251 aa, Cytophaga hutchinsonii ATCC 33406
MRKKVIAGNWKMNKTLEEGLSLASEVANMAKDEVPADVNLVMCIPYISLAAVSKVINDKVAIGAQNVYQKESGAFTGEISAPMLKSVGVKYVIIGHSERREYFGETNQQLADKVTISLANGLTPLFCCGETLAQREAGIHINFVNAQLTESLFHLSPEDFKKVVIAYEPIWAIGTGVTASDEQAQEMHAKIREHLASKYGAAVADEISILYGGSMKPDNAKGLLACKDIDGGLIGGASLKSRDFIDIAKSY

SEQ ID NO: 14066 - protein, 408 aa, Psychrobacter arcticus 273-4
MALSLQKDKIRFLLLEGLHDNALKVLKDAGYQNIENISHALDQDELIEKIKDAHFIGIRSRTQLTREVLEHAQKLIGIGCFCIGTNQVDLDAAREFGIPVFNAPFSNTRSVAELVLAEAIMLYRGIPEKNATVHRGGWGKSATNSHEVRGKTIGIVGYGSIGSQLSVLAESFGMKVIYHDVLTKLPLGNAVQVASLEELLSTADIVTLHVPELPSTRYMMKAEQFAHMKEGSYFINAARGTCVEIDDLTAVLESGKILGAAIDVFPKEPKSADEEFESPLRKFDNVILTPHIGGSTQEAQANIGLEVADKFVRYSDQGNTATAVNFPEVSIPFKEGTHRLLHIHKNVPGVLSQINRLFAEANINILAQSLMTEGDVGYLVMDVDYNDSTAALDQLKDVQETIRVRILF

SEQ ID NO: 14067 - protein, 1131 aa, Burkholderia pseudomallei K96243
MKPADTLEDVGRAQFVAHMARRPRRARRREAPGVADTPLWYKDAIIYQLHVKSFFDANNDGVGDFAGLIAKLDYIAELGVDTVWLLPFYPSPRRDDGYDIADYRGVHPDYGTLADVRRFIREAHARGLRVITELVINHTSDQHPWFQRARRAKRGSVHRDYYVWSDTDLKYAGTRIIFLDTETSNWTHDPVAGQYYWHRFYSHQPDLNFDNPAVVREVLQIMRFWLDLGIDGLRLDAVPYLVEREGTSNENLPQTHAILKLIRATIDAEYPNRMLLAEANQWPEDVQEYFGDEDECHMAFHFPLMPRIYMSIASEDRFPIIDIMRQTPALAPSNQWAVFLRNHDELTLEMVTDSERDLLWQAYASERRARLNLGIRRRLAPLMERDRRRIELINSILLSMPGTPVIYYGDELGMGDNLHLGDRDGVRTPMQWSSDRNGGFSRADPELLVLPPVMGTLYGYDAINVEAQTRDPHSLLNWTRRILSTRRATRVFGRGAIRFLRPGNRKILAYLRELDGETPVLCVANLSRASQAVELDLSEFAGCVPTEMTSDSPFPPIGQLPYLLTFPPYGFLWFALSEHGREPAWHQQYAEPLPEYLTLVMRRGETQPGAALLDTLAQDALPSWLARRRWFASKERRVDSARFDALTPIPGEPFQYAEARVAVDGREERYVVPLASAWGSETPQPLFAQLALARVRRGHTVGLLTDAFALPSFAHGVLRQLRAGAAVPVAGGGRLEFRPEPDLARLDPGDAPGVRWFAAEQSNSSLVIGEAIVLKIVRKLAAGVHPEAEMGRHLRRIGYRNVAPLVGEVVRIGADGAPHTVAILQEYVDNQGDAWTRSCDFLKRAIEELALPAANDADAAAPSAEPEMIDGYATFAGIVGKRLGELHAALAQPSDDAAFAPQRVSPARVDGWIGDALGWFERAASLLAERLDTLEGQTRAAAELLVAQRAAVAEALRALVPRELDGCCIRIHGDFHLGQVLDVQGDALLIDFEGEPARPLEQRRAQSHPLRDVAGFLRSLSYASAAAQFTIEKAPQQAAERKRALFERFGQAAADRFVAQYREALSAASREFVEPRYADRLLALFLIEKASYELCYEAANRPDWLSVPANGLAALVARLIGGAAPQQEDAR

SEQ ID NO: 14068 - protein, 350 aa, Picrophilus torridus DSM 9790
MDYKIIEDPLNGMIKISGVYLELLDSDYFQRLRYIKQLGMCNLVFPGANHTRFEHSIGTMFIARKFMDHLNIDAEEIGIAAMLHDIGHPPFSHSLEDLFHELYGMRHEDMTFKIINGIYPYNDSKIPGIIEKYHYDLKMISDLATGKKSRYSWIISGPVDSDELDYIRRDAFYTGTGINIDYERIINTSSMDNNDLIIEEKGIPAIEAAMIARLIMYKSVYFHKTCRIAQKMLEIAYKNYSYDVKDLKKTDFELMYDMLKYDKSCNIIRNIMNRRLYKVYKRIKYDEDEYKKLSKNIIDVIPPLSFFGSDRIKNNIYVYVNNRKENLKDISPIIRALDDYISNKYIFLMK

SEQ ID NO: 14069 - protein, 87 aa, Zea mays
  misc_feature (41)..(43): Xaa can be any naturally occurring amino acid
  misc_feature (46)..(46): Xaa can be any naturally occurring amino acid
  misc_feature (57)..(57): Xaa can be any naturally occurring amino acid
  misc_feature (74)..(74): Xaa can be any naturally occurring amino acid
  misc_feature (85)..(85): Xaa can be any naturally occurring amino acid
  unsure (1)..(87): unsure at all Xaa locations
QSEVEATLNLNAMNQSPNPWPVSFSYARALQNSVLKTWQGXXXNVXAAQKALLVRAXANSLAQLGRFPGEGRAXEAKKGMFPKGXPY

SEQ ID NO: 14070 - protein, 139 aa, Caulobacter crescentus CB15
MTERTFSIIKPDATRRNLTGAINAVIEAAGLRIVAQRRVKLTEAQAKKFYEVHAERPFYGELVGQMTAEPVVVQVLQGDNAVLKYREVMGATNPENADEGTIRKLFALSIGENSVHGSDSLENAGIEIAQFFTEDEIVG

SEQ ID NO: 14071 - protein, 343 aa, Bartonella quintana str. Toulouse
MNECLGDIAQALVCAGKGILAADESTATIGKRFESIGVESNEDNRRAYREMLFTAKEAMESAISGVILFDETVRQRASTGQMLTDLIRNAGALPGIKVDTGAKPLAAFPQEMITEGLDGLRERLKDYYALGARFAKWRAVIAIDAYALPTKGAISQNAQALARYAALCQEAGLVPIVEPEVLMDGASRQHSITRCFEVTQAVLNMVFKELFEARVLFEGMILKPNMVIDGKDARTASVEEVAEKTVRVLKQTVPAAVPGIAFLSGGQSDEEATAHLSAMNALGPLPWKLTFSYGRALQAAALKAWGSHHQNIALAQKAFCHRARMNHLAALGKWTKEQERSCA

SEQ ID NO: 14072 - protein, 186 aa, Lycopersicon chmielewskii
FFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMV

SEQ ID NO: 14073 - protein, 255 aa, Debaryomyces hansenii CBS767
MPTLREDSVYLAKLAEQAERYEEMVENMKTVASSGQELSVEERNLLSVAYKNVIGARRASWRIVSSIEQKEEAKGNESQVSLIRDYRSKIEAELSKICEDILSVLTDHLISSAQTGESKVFYYKMKGDYHRYLAEFAISEKRKDAADLSLEAYKSASDVAVTELPPTHPIRLGLALNFSVFYYEILNSPDRACHLAKQAFDDAVADLETLSEDSYKDSTLIMQLLRDNLTLWTDLSEAPAPTEEQQPSEPKADEE

SEQ ID NO: 14074 - protein, 213 aa, Lycopersicon pimpinellifolium
IFNLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 14075 - protein, 339 aa, Triticum aestivum
  misc_feature (202)..(202): Xaa can be any naturally occurring amino acid
  misc_feature (302)..(302): Xaa can be any naturally occurring amino acid
  unsure (1)..(339): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKGINDRFGLVEGLMTTVHAMTATQKTVDGPSSKDWERWXRAASFNIIPSSTGAAKVVGKVLPEAYGKLTGMAFRVPTVDVSVVDLTVRLAKPATYDQIKAAIKEESEGNLKGTLGYVDEDLVSTDFQGDNRSSIFDAKXAGIALNDNFVKLVSWYDNECKYSTRVVDLIRHKHSSK

SEQ ID NO: 14076 - protein, 441 aa, Medicago truncatula
MNNSVASENSFIIESDEEDDKDFNKGDDGNDSDSSNYSNENPPQRKQSSYNPSWPQSYRQSIDLYSSVPSPSIGFLGNSSLTRLSSSFLSTSLTRRHTPEVLPSVTKPLIQPTEEEKHQRRSSHTLLPPLSRRSSLLKKESKVSHEVPSRHCSFGQAVLNGINVLCGVGILSTPYAAKEGGWLGLSILFIFGILSFYTGLLLRSCLDSEPGLETYPDIGQAAFGTAGRIAISIVLYVELYGCCIEYIILEGDNLASLFPNAYLNLGGIELNPQTLFAVVAALAVLPTVWLRDLSVLSYISAGGVIASVLVVLCLLWIGIEDVGFQRSGTTLNLGTLPVAIGLYGYCYSGHAVFPNIYTSMAKPNQFPAVLVACFGVCTLLYAGGAVMGYKMFGEDTLSQFTLNLPQDLVATKIAVWTTVVNPFTKYPLYACMHLDGKDYSS

SEQ ID NO: 14077 - protein, 194 aa, Zea mays
  misc_feature (18)..(19): Xaa can be any naturally occurring amino acid
  unsure (1)..(194): unsure at all Xaa locations
PRVRSDGRSVKSIIAHVXXPLKLILVHGSAEATEHLKMHCAKNLDLHVYAPQIEETIDVTSDLCAYKVQLSEKLMSNIISKKLGEHEIAWVDAEVGKEDEKLILLPPSSTPPPHKPVLVGDLKLSDFKQFLENKGWQVEFAGGALRCGEYIMVRKVGDSILKGSTGSQQIVIEGPLCEDYYKIRELLYSQFYLL

SEQ ID NO: 14078 - protein, 457 aa, Enterococcus faecalis
MKNYPVKKNDVIEVEIIDLTHEGLGVAKVDHYPLFIENALPGEKLEIKVLKTGKSFGYGKVLTVLKSSEQRVPVKDENFTKVGISPLQHLAYGAQLSFKTQQVENVMQRVAKLQEVPVLPTIGMNDPWHYRNKAQIPVRKIDNQLQTGFFRKNSHDLIPMEHFYIQDPEIDAAIVKIRDIMRKYSVKPYNESDNTGNLRHIVVRRGYHTGEMMVVLITRTPKLFPISKIVPDILEAIPEVVSIVQNVNPKRTNVIFGDETILLHGSEKITDTIFDLKFEISARSFYQVNPQQTEVMYQKVKEYAALTGNEIVVDAYCGIGTIGLTLAQDAKQVYGIEVIEEAVKDAENNAKLNNIENATFTAGLAEELLPKLVENGLQPDVVVVDPPRKGLDGQLVNTLIETQPERIVYVSCNPATLARDIALLTEGGYEAKEIQPVDNFPQTTHIESVTLLTKAVD

SEQ ID NO: 14079 - protein, 393 aa, Gossypium hirsutum
MNLSATEKDLMIVNMGPHHPSMHGVLRLIVTLDGEDVVDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELVYDLFEAATGMRMMHNYFRIGGVAADLPYGWLDKCLDFCDYFLTGIVEYQKLITRNPIFLERVEGIGVIGGEEAINWGLSGPMLRASGIKWDLRKVDHYECYDEFDWEIQWQKEGDSLARYLVRISEMTESIKIIQQALEGIPGGPYENLEIRCFDRERDPEWNDFEYRFISKKPSPTFELPRQELYARMEAPKGELGIFLIGDQSGFPWRWKIRPPGFINLQILPQLVKRMKLADIMTILGSIDIIMGEVDR

SEQ ID NO: 14080 - protein, 386 aa, Lycopersicon esculentum
MALHATAFSFTGVSTSSKSSRSALLSLPRRCAVKATSQYPHSFPRCKIQGRALPSDNGLVEKDESSLVVCFGEMLIDFVPTTSGLSLAEAPAFKKAPGGAPANVAVGISRLGGSSAFIGKVGEDEFGYMLAEILKENNVNSDGMRFDPGARTALAFVTLRKDGEREFMFYRNPSADMLLQEDELDLELIRKAKVFHYGSISLITEPCKSAHIAAAKAAKDAGVILSYDPNLRLPLWPSAESAREGILSIWNTADIIKISEEEISFLTQGEDPYDDNVVRKLYHPNLKLLLVTEGPEGCRYYTKDFSGRVKGIKVDAVDTTGAGDAFVAGILSQLASDVSLLQDEGKLRDALSFANACGALTVMERGAIPALPTKEVVLNTLLKSVA

SEQ ID NO: 14081 - protein, 484 aa, Novosphingobium aromaticivorans DSM 12444
MAKLDPRGRKVKILATVGPASRDPEMLEKLFRAGADAFRVNMSHGEHAIHAETIANIRALEKKVNRPITILCDLQGPKLRVGKFKDGRAVIRHSGHFTLDRNPEPGDETRVCLPHPELFGVLHKGQRLLIDDGKLRLRVIRADENEILCSAEVGGVISDRKGVNVPDAVVPVPALTDKDRRDLSFAVEQGADWIALSFVQRPEDVAEARRLLGGHGSLMAKIEKPAAISRLEEIVELSDGIMVARGDLGVELNPEEVPPLQKRIVETARRQGKPVVVATQMLESMIEAPTPTRAEVSDVANAVYDGADAVMLSAETAAGAWPEEAVTIMHRIAAQVEADPGYGARVHFLETLPDPTTADALAQAAASITETLPISGIIVFTGSGSTARRVARERPGVPMLVLTPSHKTARKVGLLWGAHAVSTKDIGSFEEMIAKGKRMALRHGFGSAGSKLVALAGVPFGTPGATNLLHVVTLTGDELTRHGE

SEQ ID NO: 14082 - protein, 194 aa, Saccharomyces cerevisiae
ISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEVKHQSKYSDKSKEKLLKKRKKKERGCNNL

SEQ ID NO: 14083 - protein, 456 aa, Burkholderia thailandensis E264
MTAVDAYRREAHMQDIDDFLRQHRITEVEAIIPDMAGIARGKIIPRNKFETGESMRLPQAVMVQTVTGDYPEDGALTGVTDPDMVCVADASTICLIPWAVDPTAQVIHDCVHFDGSPVEISPRYVLRRVLDLYRAKGWKPVVAPELEFYLVDMNKDPDLPLRPPVGRTGRAETGRQSYSIEAVNEFDPLFEDIYEYCELQGLDIDTLIHEVGAAQMEINFLHGDALSLADQVFLFKRTVREAALRHNMYATFMAKPMENEPGSAMHIHQSVVDIETGRNLFIGASGDVTPMFRGYLAGLQKYTPALMPIFAPYINSYRRLSRFMAAPINVQWGYDNRTVGFRIPHSAAAARRIENRIPGVDCNPYLAIAATLAAGYLGVTQALEPTEPLASDGYSLPYQLPRNLEEGLTLMSACAPLAEMLGEKFVKAYLALKETEYEAFFRVISSWERKHLLLHV

SEQ ID NO: 14084 - protein, 477 aa, Burkholderia vietnamiensis G4
MSTDDKIQTYEQEDLKRDLKNRHIQMIAIGGAIGTGLFYGSSWAIRTAGPAILLVYLVAAIAIYFVMRALGEMAVEEPVSGSYISYSNRYIHRFAGFLNGWNAFIFLLATSAADLNALGNYMHFWFPGIPIWVTAGAAVSLMFVVNIIGVKIYGEAEFWFSLVKVVAIVAMIVFGVGMVLFGIGNNGVPIGYHNLIDHGGFFPKGAGGTFLAIVMVAFAFGGVENLGLAAGEAQDVKTTMPKAVNATFWRLLIFYVGAIAVLLLVFPWTSLTSKGSPFVEVFTKIGIPAAAGIMNLVVIMAVLSAVNASVFTNSRTFYNLSLQKNAPAFLGVTNSRKVPHRAILMVFATMFAGVMLNYLMPEQAFELFSSVTVFALVCAWGSIVISHLRFRKNKIRKGEDGQLGYKMPFYPYSNYIALIFLAAVLIGIAILPDMRMSLVVSAVWVLVVFIAYTFYVRKESTRESIASETGDAKDLLA

SEQ ID NO: 14085 - protein, 476 aa, Solibacter usitatus Ellin6076
MANELQDFLKLSYTELEELNLEAKADRMGRKPMHEIQEKRLKYLTDEKRIKAVTVLFSDLEGRLHMLDYDKKFLVKSWDNLTFDGSSIRGFTAQRESDLRLNMDWSAFYWAPSDIFGAGKVLVFGEVIDKDGTPYSADIRGVLKAYAQSLFDKQGYTLNAANEIEGFLFNGSDAERRYHETTKFDYVNTGGYYHSLPGDPLRKFIDTCAEVQRAMGFQNEKDHPEVAPSQFEINYSYAEVVAAADQIQLYKLICRQVATGMGLTASFLPKPVVGVNGSGMHTNVSITKNGKNLFWDPSGQEKMSKFAWQFVDRILTHGNDLCLLLNASVNAYRRLDPHFEAPNQIKASATDRGSMIRIPIGNERSSRVEVRSVGPDANPYMVMLSVFRTGLDGETAKIKNLRSAERYLPDNVYDALANFKNAEWTTKLLGEDVKGRYADLKQSSADRCPRLLGTFVKAPEVQYHHEVYNQFLWNMF

SEQ ID NO: 14086 - protein, 601 aa, Vibrio vulnificus YJ016
MMALTSDFLQTSVVFLSAAVVAVPLAQRSGLGSVLGYLLAGVAIGPWGLGLISDVDAILHFAELGVVLLLFLIGLELNPKKLWQMRGPILGLGGAQVVITTLLIACIIQWFGVSWNTALVIGMGLALSSTAIALKVLEEQGLARTETGQSGFAVLLFQDIAVIPMLALLPLLAGSGMSGDWLSSLLTFSAVVGLLVGGHFLLRPLFRYVVLTGVRELFTVTALLVVLGIAMLMQQLGLSMALGTFLAGVLLAESEYRHELEIAIEPFKGLLLGLFFIAVGMAVNLGLLVVHPIEVISAVLGLVALKGAVLYLLGRVSRMRAKARSRMAAILSQGGEFAFVIFTAASKEGLLNPSEVSFLLVVVSLSMVTTPLLLNIQKWWYARTLNQESDVLAPDVVDTEPRVIIAGFGRFGQIVGRLLYANKIKVTVLESDASQIQLLRKYGYKVFYGDATQLDLLRAAGAAKAEALVICTDSPDQVMSIVELCQQHFPNLKVLARARSRVEAYQLLSHGVSTYSRETFLGALDLGRQTLVEIGMHPYQAKRAEAHFRKLDNAMLKELLPQHNQDKKLAQRAKEARKELEEIFAHEMENDHQSRNFWDER

SEQ ID NO: 14087 - protein, 271 aa, Oryza sativa
MEGMGQQKRRPLVVMASAQAAARGGANPLAELTDRVKTLEAGLRAWLAKQPTHVEAAVATAVGAVQGGALGGLMGTLAPDGGSPFPVPQPPPGADPNALASFKQAQALAGGPLVQARNFAVMTGANAGISCVMRRIRGVEDVQRSAHFDSMGAAFGSGALFSIVSGMGSPNPVANAITTGVAFAVFQGGFFMIGQKFSQPPSEDIYYSRGRNMLKQLGLQNYEKNFKKGLLTDQTLPLLNDSALRDVKIPPGPRLLILDHIQRDPELTKST

SEQ ID NO: 14088 - protein, 543 aa, Zea mays
  misc_feature (405)..(405): Xaa can be any naturally occurring amino acid
  unsure (1)..(543): unsure at all Xaa locations
PRVRPFFLFIELALVLCFITLYYRHLQSKKTSPLEPTEWPVVGHLPGLVANIHRFHDWATGVLAGVGCNFEARGGRTGLRYFITCDPSNVRHIFTSNFANYPKGEEYAAIFDVLGGGIFNADGESWRRQRVKAQMLMTGPRFRAFTARCSRDKVERSLLPFLAHHAAADDEGRPTPCDLHDVFLRLTFDMTCTLVFGVDPGCLALGLPGVPFARAMDDALETLFLRHITPTACWKLMSVLGVGQEKKMAAARRTIDCFVATTVAKRRADKLREGEGEGVCSSFDLLSSFICHEDDSSENDDDDDVFLRDTTVNLLLAGRDTTGAALSWFFYLVSKNPRVEQKLLDELAPIVASRRRAGGAAADAASGMVTFDADELGSGLVYLHAALSECLRLYPSVPFEHKVAXAADVLPSGKELKAGDKVLVFNYSMGRMEGVWGKDCTEFRPERWLNEDGTKLRYEPSYKFISFNAGPRTCLGKEMAFVQMKAVAAAVLWNFAVEVVPGHVVEPKLSIILHMKNGLAVKVRRRDGTYGAAPPSSVTPLLF

SEQ ID NO: 14089 - protein, 268 aa, Saccharophagus degradans 2-40
MKNKNTDPMQGHRARKRFGQNFLEDQGIINAIVRSIGPKASDNLVEIGPGKGAITAQLIESCPSMQVVELDRDLIPILLAQFAIYNDFRIHQTDALKFDFGQLATPERPLRVVGNLPYNISTPLIFHLLSFGELIADMHFMLQKEVVLRLAAGPGDKNYGRLSVMTQYVCQVENLFEVPPECFNPRPKVDSAIVRLTPYRTQPFVAAHPDKLAKLVKTAFAQRRKTLRNNLKNLDEELDLEALDIDLTRRAESLSLEEYVNLSNTLWP

SEQ ID NO: 14090 - protein, 380 aa, Zea mays
MTKSSGALDLARSTGGSLSKDQVKSAVDQYVKYHDLHGGEQESRKSNYADLANKYYDLVTGFYEYGWGDSFHFAGGYPGETSREAIKRHQHFMALQLGLKKGMKVLDVGCGIGGPLIEIARFSSTSITGLTNNDYHVSRGKVCILAFFLEYKNCIAYGYAPFNFWLQEHIFSAGLSEQCCSLKGDFMNMPIADNTFDAAYAIQATCYAPEAQGVYSEVYRVLKPGQYFALDEWCLTDRFDPKNTKHLTTKAEIELGDGLPDIRTTRQCVQAMKDAGFEVVFAKDLAQDFPCPWYQTMDPNYFSWTNFQCTRPGRIITRAIVNTLEFLRIAPAGSVGAYNVLTSASDGLLKGGREGIFTASFFVLGRKPLKETEIVNGGNL

SEQ ID NO: 14091 - protein, 211 aa, Lycopersicon chilense
NLHLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIM

SEQ ID NO: 14092 - protein, 498 aa, Acinetobacter sp. SE19
MGGIPHIPFCLTSVICQGCLIMNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 14093 - protein, 660 aa, Oceanospirillum sp. MED92
MTHGFFEQFLVILCCAVIATTLFRRIQLPPLLAYLSVGALVGPYALGVIEDVHSIEFLSELGVVFLLFMLGLEFSVSRMIAMRKAVFGLGSLQVIITSAVIIGFCTLIGMPLTTSVVIAGALSLSSTAIVSRELIHRNELDTPHGQLSVGTLIFQDLAAVFFLIVVPTLNGGASEINGSQVALMLLEGGTLLIVLLLIGHIVMPMLFHESARSGSSDVFVLTSLAAALLAAWLTEAAGLSMALGGFLAGMMLGESRYRYQLEADIRPFRDVLLGLFFVSVGMQLDLQSLLENWYWVLVFTLCLITAKTLIITFIGSLLHKDLVNSLRAGLSLSQGGEFGFALLALALGSQLISPEINTLTVATIIISMIITPIIMNHTHRVDGLLAKQQLEQEDSIDPSGSQIDNHNLNNHVIICGFGRVGQIMARFLDQAQIPYIAIDNDPVRVMEASTAGEHICFGDARRDDILEAVGAKNARMLILSFPETESSLPALKHIRSRFVDLPILVRTRDDSQLDEFQTAGATEVIPEALEGSLMMISHVLSLLGMPHTKIEKQINTVRAERYHMLHGYYHGRHSSKIDSSGRAKEILHPVTIDTDAAEIGKTLKELKLERFKVTVAMIRRQNHSNHNPKGDTRLKSGDIVVLKGPTDKVELAEASILSKS

SEQ ID NO: 14094 - protein, 210 aa, Lycopersicon peruvianum
LSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 14095 - protein, 510 aa, Arabidopsis thaliana
MEKLLAGQTNNGSLKSKTKIVCTLGPASRSVEMVEKLLKAGMNVARFNFSHGSHSYHQETLDNLRTAMENTCIPCAVMLDTKGPEIRTGFLKEGKPVELIQGQEITISTDYTMEGDSNTISMSYKKLAEDLKSGDVILCSDGTISLTVLSCDKNLGLVRARCENSAVLGERKNVNLPGIVVDLPTLTEKDQEDILQWGVPNKIDIIALSFVRKGSDLVEVRKLLGENAKSIMLMSKVENQEGVMNFDKILEYSDAFMVARGDLGMEIPIEKMFLAQKMMIQKANALGKPIVTATQMLESMTKSPRPTRAEATDVANAVLDGTDCVMLSGETAAGAHPETAVLTMSRICKEAEDFIDYDTMHKKIQDIVSLPLSPIESLAASAVSTARSLCAAAIVVLTKGGYTVELVAKYRPSVPILSVIVPEITRTDDFEWSCSESAAHVARRGLIYRGIVPVMATGASARSSNKDSTEETIQFAIEFAKKKGICKTGDSIVALHKIDGSSVVKILNVE

SEQ ID NO: 14096 - protein, 214 aa, Lycopersicon cheesmaniae
AIFNLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 14097 - protein, 175 aa, Triticum aestivum
MAPTVMASSATSVAPFQGLKSTAGLPVCRRSNGASLGSVSNGGRIRCMQVWPIEGIKKCETLSYLPPLRTEALLKQVDYLIRSKWVPCLEFSKVGLIFREHNTSPGYYDGRYWTMWKLPMFGCTDATQVINEVEEVKKEYPDAYVRIIGFDNMRHVQCVSFIAFKPPGCEESGKA

SEQ ID NO: 14098 - protein, 154 aa, Triticum aestivum
MSSSEQTFIAIKPDGVQRGLVGPIISRFENRGFKLAAIKLMTPGKEHLEKHYADLAGKPFFAGLIEYMNSGPICAMVWEGRDAVKTGRSILGATNPLASSPGTIRGDYAIDVGRNVCHGSDSVENAQKEIALWFKEGEVVSWKSAQFNWVYEKA

SEQ ID NO: 14099 - protein, 213 aa, Lycopersicon pennellii
AIFNLSDLLSQEKRAEDLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMV

SEQ ID NO: 14100 - protein, 251 aa, Triticum aestivum
  misc_feature (81)..(81): Xaa can be any naturally occurring amino acid
  misc_feature (96)..(96): Xaa can be any naturally occurring amino acid
  misc_feature (246)..(246): Xaa can be any naturally occurring amino acid
  unsure (1)..(251): unsure at all Xaa locations
MGRKFFVGGNWKCNGTTDQVEKIVKTLNEGQVPPADVVEVVVSPPYVFLPVVKSQLRPEFHVAAQNCWVKKGGAFTGEVSXARCSVNLGVPWVILXGHSERRALLGESNEFVGDKVAYALSQGLKVIACVGETLEQREAGSTMEVVAAQTKAIAEKISDWSNVVVAYEPVWAIGTGKVATPAQAQEVHASLRDWLKINVSPEGAESTRIIYGGSVTAANCKELGAQPDVDGFLVGGASLKPEFIDXQRGPP

SEQ ID NO: 14101 - protein, 198 aa, Solanum lycopersicoides
DLQKLLVQLRPFFSLIPKAKTAKIVNKGIVDAVAKIPGTSDLQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVS

SEQ ID NO: 14102 - protein, 275 aa, Wolbachia endosymbiont of Onchocerca volvulus
MSLIKLSPTIAVTDKVNRLKSQGKEICVLAAGEPDFDTPGHIKKAAIQAINEGKTKYTAVDGTRELKGAIIDKLKRDNDLEYMPSQICVSAGAKQVLFNLLMATINPEDEAVIPAPCWVSYVDMVSFFGGLPVIAECKDNFKLTSELLRSKITEKTKWLILNSPNNPAGVVYTYDELKKIAQILLEYPHVNIITDDIYEHIVYDGKFFTIAQVEPRLYDRVFVVNGVSKAYAMAGWRIGYVAGRSDVVKAISILQSQSTSNPNSIAQAAAVEALN

SEQ ID NO: 14103 - protein, 377 aa, Wolbachia endosymbiont of Brugia malayi
MSDLAKRMSLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYDELKAIAQVLLEYPHVNIITDDIYEHIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATS

SEQ ID NO: 14104 - protein, 322 aa, Glycine max
MAGKKIPDVLLNSGHKMPVIGMGTSVENRPSNETLASIYVEAIEVGYRHFDTAAVYGTEEAIGLAVAKAIDKGLIKSRDEVFITSKPWNTDAHRDLIVPALKTTLKKLGTEYVDLYLIHWPVRLRHDLENPTVFTKEDVLPFDIEGTWKAMEECYKLGIAKSIGICNYGIKKLTKLLEIATIPPAVNQVEMNPSWQQGKLREFCKQKGIHVSAWSALGAYKIFWGSGAVMENPILQDIAKAKGKTIAQVALRWVYQQGSSAMAKSTNSERMKQNLDIFDFVLSEEDLERISQVPQRRQYTGDIWLSENGSCKTLEELWDGDV

SEQ ID NO: 14105 - protein, 149 aa, Petroselinum crispum
METAGKAKKGFGGRKGGPRKKSVTRSVKAGLQFPVGRIGRYLKKGRYAQRVGTGAPVYLAAVLEYLAAEVLELAGNAARDNKKTRIIPRHLLLAVRNDEELGKLLAGVTFAHGGVLPNINPVLLPKKTAEKAAKEPKSPSKAGKSPKKA

SEQ ID NO: 14106 - protein, 141 aa, Acidobacteria bacterium Ellin345
MKTLQRTLSIIKPDAVEKNAEGDIISILLNNNFRILGIKMLHLTKNQAEGFYAVHANKPFFHSLTDFMASGPIVVMCLEKENAIADYRKLMGATNPANAEEGTIRKKWAASIEKNAVHGSDADDTARFELSYFFAGYELAR

SEQ ID NO: 14107 - protein, 137 aa, Glycine max
  misc_feature (84)..(84): Xaa can be any naturally occurring amino acid
  unsure (1)..(137): unsure at all Xaa locations
YDIDTEAGEKRKEEEMIELEGPLGKSDAVNHELVSLERELSTLRKNGKVDAFGLYLYGLVLKQKGSENLARTVLVESVNSYPWXNWNAWTELQSLCKTVDILNSLNLNSHWNEDFFLASVYQELRMHNDSLSKYEYL

SEQ ID NO: 14108 - protein, 124 aa, Glycine max
  misc_feature (6)..(6): Xaa can be any naturally occurring amino acid
  misc_feature (11)..(11): Xaa can be any naturally occurring amino acid
  misc_feature (14)..(14): Xaa can be any naturally occurring amino acid
  misc_feature (17)..(17): Xaa can be any naturally occurring amino acid
  misc_feature (20)..(20): Xaa can be any naturally occurring amino acid
  misc_feature (23)..(23): Xaa can be any naturally occurring amino acid
  misc_feature (25)..(25): Xaa can be any naturally occurring amino acid
  misc_feature (32)..(32): Xaa can be any naturally occurring amino acid
  misc_feature (37)..(37): Xaa can be any naturally occurring amino acid
  misc_feature (41)..(41): Xaa can be any naturally occurring amino acid
  misc_feature (44)..(44): Xaa can be any naturally occurring amino acid
  misc_feature (49)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (56)..(57): Xaa can be any naturally occurring amino acid
  misc_feature (64)..(64): Xaa can be any naturally occurring amino acid
  misc_feature (86)..(86): Xaa can be any naturally occurring amino acid
  misc_feature (92)..(92): Xaa can be any naturally occurring amino acid
  misc_feature (96)..(96): Xaa can be any naturally occurring amino acid
  misc_feature (104)..(104): Xaa can be any naturally occurring amino acid
  misc_feature (107)..(107): Xaa can be any naturally occurring amino acid
  misc_feature (109)..(109): Xaa can be any naturally occurring amino acid
  misc_feature (115)..(115): Xaa can be any naturally occurring amino acid
  misc_feature (117)..(117): Xaa can be any naturally occurring amino acid
  misc_feature (121)..(121): Xaa can be any naturally occurring amino acid
  unsure (1)..(124): unsure at all Xaa locations
MSHFKXKYHDXLIXNAXYIXTPXKXILAADEXTGTIXKRLXSIXVQNVXSXRXALXXLLFTAPXALKYLSGVILFEETLYHEHSCXSPFVEXLKEXGVLPGIKXDKXTXELAGTXGXTTTXVLD

SEQ ID NO: 14109 - protein, 361 aa, Bacillus megaterium
MTIQWFPGHMAKARRQVTEKLKLIDIVYELVDARIPQSSRNPMIDEIIVNKPRIVLLNKVDKADPRVTQQWLDYYKEQGIYALAIDAQAGKGMKQIVSSSKELLQEKFDRMRAKGVKKPRAIRAMIVGIPNVGKSTLINRLASKKIAKTGDRPGVTQAQQWIKVGNELELLDTPGILWPKFEDETVGYKLATTGAIKDTILNMQDVAVYALRFLTSHYPEQLKQRYNLNEIPEDIVELFDAIGSRRGCLMGGGMVDYDKTAELVLREIRTDKIGTFTFDDQLFRFIYELANRENMYIEPSAAAGLQGPLHLMETGSSYIQAQALENDMSKATHLVWSTGGSMVPAEVMNSYYKQGKNLMNG

SEQ ID NO: 14110 - protein, 594 aa, Arabidopsis thaliana
  misc_feature (220)..(220): Xaa can be any naturally occurring amino acid
  unsure (1)..(594): unsure at all Xaa locations
MRRCKNNTDKFSVITMRLLTLLLICTFFFFFSFAYSAESDNETDSVVTREINGTVVESNATSAKPREDSFADMIDRALEKEFPDNDQNEVPDPGSFNNSVADQQAVLETVARVKPKKNETKTKEEKSFFNLDNENGVEDTPRLIDRKDNVFIMSNPKSKYPVLQLDLRLISDLVVVIVSATCGGIAFACAGQPVITGYLLAGSIIGPGGLSFVSEMVQHXVETVAQFGVIFLLFALGLEFSAAKLRVVRAVAIPGGLLQIFLFMCLSGITASLCGGKLTEGIFVGAFLSMSSTAVVLKFLMERNSISALHGQITVGTLILQDCAVGLLFALLPVLGGTSGVLQGVLSMAKSLAILIAFLGALFVLSRTWVPWFLKLMTSLSSQTNELYQLAAVAFCLLVAWCSDKLGLSLELGSFAAGVMISTTDLAQHTLEQVEPIRNFFAALFLASIGMLIHMHFLWNHVDILLAAVLLVIVIKTVVVAIVVKVFGYNNKTAVLVGMSLAQIGEFAFVLLSRASNLHLIESKLYLLLLGTTALSLVTTPLLFKLIPAVVHLGVLLRWFSPDSSTEIGFKGELYHSESAKRISLMIQGSLHDS

SEQ ID NO: 14111 - protein, 284 aa, Xylella fastidiosa Ann-1
MPHVTLLPSPSPIAFIGGGNMARSLIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPNTPALLGAGVTGLFTTSQTTGTQRTIAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQALVAKAIDAATRRARALGKINDTDPT

SEQ ID NO: 14112 - protein, 276 aa, Arabidopsis thaliana
MEILPIPAESFKVGFIGAGKMAESIARGVVASGVLPPNRICTAVHSNLNRRDVFESFGVNVFSTSEEVVKESDVVIFSVKPQVVKKAVTELKSKLSKNKILVSVAAGIKLNDLQEWSGQDRFIRVMPNTPAAVGEAASVMSLGTGATEEDGAIVAMLFGAVGKILKADEKMFDAVTGLSGSGPAYIFLAIEALADGGVAAGLPRELALSLASQTVLGAATMVSKTGKHPGVLKDDVTSPGGTTIAGVHELEKGSFRATLMNAVVAAAKRSRELSQS

SEQ ID NO: 14113 - protein, 364 aa, Mycoplasma penetrans HF-2
MKSINLPTSMKALVFVEKNKIQIVNKPIPTVGPNDALIKVTTTTICGTDIHIVKGEYPVKPGLTIGHEAVGILAAVGDEVTGFELGERVLAGAITPSGYTAACQSGQSSQDGIGTKYGYKPTAGWKFGNIMDGCQAEYVLVKNAMANLARVPNALTDEQVLMCPDIMSTGFSGPENANIKLGDYVGVIAQGPIGLCATTGAKLMGASIIIAIDGNDRRLEIAKELGATHTINFRNVDVVQEVNRITDGRMLDSAIECLGSQSTFEQGFRLLRAGGTLSSLGVYSSDIKLPLDALAAGLGDHKISFALCPGGSERMRRLMSLIENKRVDLRSLVTHTLPFDRIAEGYNIFANQKDGVLKVAIKVS

SEQ ID NO: 14114 - protein, 322 aa, Malus x domestica
ILPFKLPAIGPNDVRIRIKAVGICGSDIHYLKTMKCGDFQVKDPMVIGHECAGIVDKVGSEVKHLVPGDRVAVEPGISCAHCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSTKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEALEPVL

SEQ ID NO: 14115 - protein, 389 aa, Novosphingobium aromaticivorans DSM 12444
MNQLSRALARIAPSRTTAITDRAIQLRAEGRDVISLSVGEPDFATPAHVVQATKDALDAGDTKYTAVVGTAALRSAAALHFSRDLGLEVPPSQVIVSAGGKQAIFHALLATLDPGDEVLIPSPWWVSYPEIVRFAGAEVVDLPTDAAGGFRITAAQLEAAITPATRWLLLNSPGNPTGATYPAQELRALGEVLRRHPRVLVMSDDIYAPLRYGEGRHATLAVECPDLADRILTVSGVSKSHAMTGFRIGVAAGPAWLISAMGRLQSHSSGNPASISQAAAVAAFEGPQDFLLDWRERFRARRDMVCARVNAIPGLSTPVPDGAFYCMVDAAPLMARFGDDEALCLHLLESGVAVVPASAFGGRDGFRISFAADEAKLEEALRRIEKAVA

SEQ ID NO: 14116 - protein, 100 aa, Triticum aestivum
  misc_feature (91)..(91): Xaa can be any naturally occurring amino acid
  unsure (1)..(100): unsure at all Xaa locations
MAPTVMASSATSVAPFQGLKSTAGLPISRRSSSAGLSSVSNGGRIRCMQVWPIEGIKKFETLSYLPPLSTEALLKQVDYLIRSKWVPCLEXFTRLGFVFR

SEQ ID NO: 14117 - protein, 598 aa, Vibrio parahaemolyticus RIMD 2210633
MAITSEFLQSSVVFLSAAVIAVPLAQRFGLGSVLGYLLAGVLIGPWGLRLISDVDAILHFAELGVVLLLFLIGLELNPKKLWQMRGPILGLGGAQVVVTTAVIGSIVSLFDLSMQVSLVIGMGLALSSTAIALKVIEEQGLNGTETGQSGFAVLLFQDIAVIPMLAMLPLLAGEQNVGSWFDAFTVLGSVVALLIGGHFLLRPLFRFVVMSGVRELFTVASLLVVLGISVVMQKLGLSMALGTFLAGVLLAESEYRHELEIAIEPFKGLLLGLFFIAVGMAVNLGLLALHPLEILGAVVALVVVKGLVLYALARAGRVREKARSRMAAILSQGGEFAFVIFTAASQEGILSKEQVAFLLVVVSLSMVTTPLLLMGQKKWFAHTLNQEEESVTSHVVDRRPRVIIAGFGRFGQIVGRLMYANKIKVTVLESDASQIHLLRKYGYKVFYGDATQIDLLRAAGADKAEALVICTDSPDEVMAIVDICRTHFPNLKLLARARSRVEAYQLMSHGVQNYSRETFLGALDLGRQTLVELGMHPYQAKRAEAHFRKLDNAMLKDLLPQHNEDKKLAQRAKEARKELEEIFGREMESDHQSPNHWK

SEQ ID NO: 14118 - protein, 149 aa, Glycine max
MAEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVESANKEIALWFPEGPANWQSSQHSWIYE

SEQ ID NO: 14119 - protein, 151 aa, Schizosaccharomyces pombe
MSTEQTFIAVKPDAVQRGLIGYIISKFELKGYKLRALKFLVPSRDLVEEHYAEHKGKPFYEKLVGFMASGPVCAMIWEGKQAVKTGRLMLGASNPLDSAPGTIRGDYGIDLGRNVCHGSDSIESANREIKLWFQPSEIQVYDRTIEPWIYE

SEQ ID NO: 14120 - protein, 141 aa, Pseudomonas fluorescens Pf-5
MAVQRTFSIIKPDAVAKNVIGKIVSRFEEAGLRVVASKMKQLSKAEAEGFYAEHSERGFFGELVAFMTSGPVVVQVLEGENAIVRNRELMGATNPKEAAAGTIRADFAESIDANAVHGSDSEAAAAREIAYFFAATEVTAR

SEQ ID NO: 14121 - protein, 263 aa, Neisseria meningitidis MC58
MNVYFLGGGNMAAAVAGGLVKQGGYRIYIANRGAEKRERLEKELGVETSATLPELHSDDVLILAVKPQDMEAACKNIRTNGALVLSVAAGLSVGTLSRYLGGTRRIVRVMPNTPGKIGLGVSGMYAEAEVSETDRRIADRIMKSVGLTVWLDDEEKMHGITGISGSGPAYVFYLLDALQNAAIRQGFDMAEARALSLATFKGAVALAEQTGEDFEKLQKNVTSKGGTTHEAVEAFRRHRVAEAISEGVCACVRRSQEMERQYQ

SEQ ID NO: 14122 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 14123 - protein, 1413 aa, Aspergillus nidulans FGSC A4
MADLKPPFTEEAARAKVKIAQNLWNAQDPVRVSQAYTPGCIWRNRTSFFSGTEAIVDFLTAKWKRERNYRLRKELFSFTDNRIAVQFWYEFQDANDSMRWKRCYGLEDWTFDRESGKMCKRMMSGNDILLGPDGNGEGRCDYRLLTQRWDHPTYHPYNRNRRLQQLDLNHFCRARISLAMEETSPFPDSKTMRSPLTDASNRINNCHTPTTERRLMREEHALTSPVPMSIVDSPLSPRNNAENNGPPPVGDSRACSKRNSAVSAASIVSAKGKRKTHVGPWQLGRTLGSGATGRVRLAKHAVTGQTAAVKIVSKKCAAISQSDSIAAMDRNAGTFIGAGGRQMPSGIEREVVIMKLIEHPNVISLYDVWENRGELYLVLEYVEGGELFDYVSNHGPLPEEEAVRLFRQIIAGLGYCHRFNICHRDLKPENILLDGEHNIKLADFGMAALQPAGHWLNTSCGSPHYAAPEIIYGRKYRGDKADLWSCGIILFALLTGFLPFDGEDLHATLQLVRKGDYMIPPHVSAEAADLIQRILQKKPDDRISMKDIWKHPLLKKYEKFHQAICNHYLGPPPPLSPQDCGPPVVRQDIDVDLLRNLQTLWHDVKPERLIEKLISLEPTQERLFYHALVKFRNEQLENYEGQPLRYSTSDYHHISRGQARLSKHLRSRSQNGSQRRSRAPSVKETGKRRPSTRELKPSASVETYDPYRSPFNRVPDKSPQYAHVTIHREAPETSPKPAEVEVDSSNPFLDDEQEIECQQSPPFTLVRKRKQNFNSVKSFQSKTSLISSRRALNSASTPRSVSYKRNVTFHHNRNRSQSSASAKAKRAHCNRQPSEASLISGFDDDPFSDSRSSSLLPAQPAVVRGAGIAVKNSVQRRVQHSDFVWRDEARKVSHELSQICEEAFNGSSLSTGCTDTTCVSPETPATSVSLASPGVSNHQMDSSSSTVCLAATPPADSPKTSHVRRELEETRRRLIEHSMKDGSKEIPQCLAPVIDHLDRLIEQEKTRRPGKVSTKEDYSSMSDLFCGSPVEPTQLSVLSEELNTGRRSDDTPSSKKDRQVSGSTAASSQISRGKRSIRMVPHSSYQSISNTEPRAVHRPAAALIDRPENDRGNALASRVGSNHRHNRTPCELDPIDEHPASPRRSAVRSTDHKKWSWFRKSQNIEEDFVKAPTVVKPLHPSSATVIVHEVHPARNTAENQPKLGKPPSDSQKVSFWSFIKRKKGKNADPESTATNPVLESRRDDERQRAHPGPKLSENKTATKPRRSIRSSGISNNWFARVFQFKPATRVVALNASKIKGRKEIYKMLRDWKQYGMEDIYLDKPNSIIYGRVGESNFLHLRPVDFSADFYTVIEDGRQANLSVVRFRQERGAASSFNRVVDTLCMVMKQRGLLVEDPARAKRMAQVLDAFPNA

SEQ ID NO: 14124 - protein, 122 aa, Triticum aestivum
  misc_feature (18)..(18): Xaa can be any naturally occurring amino acid
  misc_feature (22)..(22): Xaa can be any naturally occurring amino acid
  misc_feature (78)..(78): Xaa can be any naturally occurring amino acid
  misc_feature (90)..(90): Xaa can be any naturally occurring amino acid
  unsure (1)..(122): unsure at all Xaa locations
DSSERSSARFQKKGFYLXGCEXLITCYNRSPHHDTPHLSSQSFFTGLEQNILSGPHVVMPGKSLRGSSAASLMIGAIXPLFSDSGTMRGXLTVHCRNNVIHGSDSLESAMNDIALRFPDRIA

SEQ ID NO: 14125 - protein, 333 aa, Thiomicrospira crunogena XCL-2
MTIKVGINGFGRIGRMAFRAAAKDFANIEVVAINDLLDPEYLAYMLKYDSVHGRFDGTVEVKDGNLVVNGKTIRITAERNPADLAWSDVGADLVIECTGFFLTEESCQAHIEAGAKKVVQSAPSKDHTPMFVYGVNHEEYAGQAIVSAASCTTNGLAPVAKVLNDNFGIKRGLMTTVHAATATQKTVDGPSMKDWRGGRGILENIIPSSTGAAKAVGKVLPALNGKLTGMAFRVPTSDVSVVDLTVELEKETSYDDICAAMKKASEGEMAGVLGYTEEANVSTDFRGDSHPSIFDAKAGIALDPTFVKVVAWYDNEYGYTCNMMRVVEHVGNN

SEQ ID NO: 14126 - protein, 546 aa, Staphylococcus aureus subsp. aureus MRSA252
MLKEIDWRKSVVYQIYPKSFNDTTGNGIGDINGIIEKLDYIKLLGVDYIWLTPVYESPMNDNGYDISNYLEINEDFGTMDDFERLINVAHEKGIKVMLDIVINHTSTEHEWFKAARKSKDNPYRDYYFFKASEDGPPTNWHSKFGGNAWKYDSETDEYYLHLFDVSQADLNWDNPEVRQSLYRIVNHWIDFGVDGFRFDVINLISKGEFKDSDKIGKEFYTDGPRVHEFLHELNRQTFGNTDMMTVGEMSSTTIENCIKYTQPERQELNSVFNFHHLKVDYVDGEKWTNAKLDFHKLKEILMQWQRGIYDGGGWNAIFWCNHDQPRVVSRFGDDTSEEMRIQSAKMLAIALHMLQGTPYIYQGEEIGMTDPHFTSIAQYRDVESINAYHQLLSEGHAEADVLAILGQKSRDNSRTPMQWSDDVNAGFTAGKPWIDISENYHQVNVRQALQNKDSIFYTYQKLIQLRHTHDIITYGDIVPRFMDHDHLFVYERHYKNQQWLVIANFSASAVDLPEGLACEGRVVIQTGTVENNTISGFGAIVIETNA

SEQ ID NO: 14127 - protein, 480 aa, Thiomicrospira crunogena XCL-2
MPSGLRRTKIVATLGPATDRDGELEKMIKEGVDVVRINMSHGNPSEHIERAQNVRDIAARLDREVGILVDLQGPKIRIARFSEGSIFLEQGDKFSLDNNVDPLAGNQKEVGLTYKSLPYDVKAGDRLLLDDGRVVLDVDNVEGERVNCTVVVGGKLSNNKGINLHGGGLSAAALTEKDKEDILTAAEIQCDYLALSFPRSAEDVEYCRSLAEKAGLVCSIVSKIERAEAVNDDFTLDGIILASDVIMIARGDLGVEVGDAQLPALQKKMIKRARQLNRITITATQMMETMIENAIPTRAEVFDVANAVMDGTDAVMLSGETATGHSPSLVIKTMSDIAHEAEKSRSTRESTHRIDEFFTAVDETIAMSAMYAANHFGVQCIAALTESGNTPLLMSRISSGIPIIALTPHIDTRRKVTLYRGVYPTSVDYTGLNDDQVKDRILEELKEKGVAKSGDLIIVTRGQSRGAMGGTNQMEIVKVP

SEQ ID NO: 14128 - protein, 218 aa, Methylococcus capsulatus str. Bath
MTQDELKRKVAEAALDYVKDVTILGVGTGSTVNHFIDLLADLKGGIEGAVSSSQASSERLKKIGIPVLDLNAAGTLDVYVDGADEVNAAKQMIKGGGAALTREKIVAEASRKFVCIVDETKCVDVLGKFPLPVEVIPMARSLVARRLVELGGTPVWRENCITDNGNVILDVHNLTITDPVELERRINDIPGVVCNGVFALRPADVVLIGSPSGVRTLP

SEQ ID NO: 14129 - protein, 780 aa, Coccidioides immitis RS
MAAAFDDEDLSISLPSFDRDGKDDRTPHSRPSMPPPSRPFTVPPEQSPATARDMQRLEQYKTVRILGEGSFGKVKLAIHQATGREVALKIISRRKLLSRDMVGRVEREIQYLQLLRHPHIIKLYTVITTKTDIVMVLEYAERELFDYLVSRGKCNDDEARTFFQQIICAVEYCHRHKIVHRDLKPENLLMDREKNVKIADFGLSNIMTDGNFLRTSCGSPNYAAPEVISGKLYAGPEVDVWSCGVILYVLLVGKLPFDDEYIPNLFRKISAGNFYMPSYISTGAANLIRRMLQVHPVHRITIPEIRRDSWFKKDLPQYLQHPAEEFVATGADPNKAIDLRSIAPGKPAAVRERIRENAVSKLERRMGYGKEDIQEALRKPEPSAIKDAFFIVVENEMMQTNSPTELDGCPSSPQPREGQDASSQGPGTAARPGFSTPRDTPITPLTPYRVTPINTPESRVSHVRILPTSLPYVHDQIMDQRTKDMTARAASPPQDYSQHIEVADLSGTPRERSPEEQAATARALKPHSRSVVDLEKLQYEPPEMLTQVPSQPKRSRKWQFGIRSRNLPYEAMLCLYKAIQAEGGVWEIQPAEPDNHDDDRVPEMTSEIPGPLQRKYRDVPSEYYIPKDLWFIRARLLKQGVLAPGPASSAHSSRSDLEELRRRVSLKGGVLHQEDRSVSGSAGFGAGLSAASSLSSHSATLSYGVWVFIDIQLYQLERDNYMVDFKCDGYQNVVRIEGDGSATEWRPISKRFRNKEKEITSPYPFLDVASDLVAQLAAAT

SEQ ID NO: 14130 - protein, 147 aa, Triticum aestivum
  misc_feature (21)..(21): Xaa can be any naturally occurring amino acid
  misc_feature (35)..(35): Xaa can be any naturally occurring amino acid
  misc_feature (78)..(78): Xaa can be any naturally occurring amino acid
  unsure (1)..(147): unsure at all Xaa locations
MPPKKAAASKANVANKHKVVXEDKTFGLKNKNKSXSNASKCEQSVDQAVQSKPRPANTAAKNKKGQEKAREKELNHLXKVVARHPKVPGGEGPKTTLCELLKVGQCHKGYKCKVSHDLHVPKEGKGTFISTMSCAMYRKKDTGWLAP

SEQ ID NO: 14131 - protein, 522 aa, Candida tropicalis
MSIQDIVETYSTKWYVVVLVALIVYKVFDFFYARYLMYKLGAKPFLQSQTDGYLGFRVPFELMGKKSEGTLIDFTYQRTLELDNPDIPTFTFPIFSVLIISTLEPDNIKAILATQFNDFSLGTRHSHFAPLLGDGIFTLDGAGWKHSRSMLRPQFAREQVSHVKLLEPHMQVFFKHIRKHHGQTFDIQELFFRLTVDSATEFLFGESVESLRDESIGMLNDALDFDGKAGFADAFNYSQNYLASRALMQQMYWILNGKKFKECNAKVHKFADYYVEKALELTPDQLEKQDGYVFLYELVKQTRDRQVLRDQLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 14132 - protein, 321 aa, Malus x domestica
ILPFKLPAIGLNDVQIRIKAVGICGSDVHYLKNMKLADFEVKEPMVIGHECAGIVEKVGSDVKHLVSGDRVAVEPGISCSRCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDKRLAVAKSLGADGTVKVSAKMEDLDDEVAKIKETMGAEVDVTFDCVGFNKTMSTGLNATRPGGKVCLVGMGHSMMTVPLTPAAAREVDVVGVFRYKNTWPLCLEFLRSGKIDVKPLITHRFGFTEKEVEEASLEF

SEQ ID NO: 14133 - protein, 322 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSYSSMRAYGQSKLCNVLHANELTKQLEEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 14134 - protein, 493 aa, Mesorhizobium sp. BNC1
MSTSARNRFPGVSFDPKALRSNLFIGGAWKEGATGNRIPVYDPSTGTVIAEVADAEVEDVMGAIDAAHEALPGWAATPPRHRSEVLRRCFELMIENRDMLAELISLENGKTLADAQGEVAYAAEFFRWFAEETVRLNGELYKAPSGANRILVQHQPIGVSVLVTPWNFPAAMATRKIGPALAAGCTVILKPATETPLTAYALAALCAEAGVPDGVVNVYTSSRSGKTVSAMLHDPRVRKLSFTGSTEVGRILLREAADKVISCSMELGGNAPFIVFDDADLSAALDGAMVAKMRNGGEACTAANRFYVQSGIADAFAKGLAERMKALAIGKGYETGSQCGPLINKDAVERISGLVEEAQSRGARVLAGGKALNREGYYFPPTVIDNVDPASAIMSEEIFGPVAPIIRFDSEDEVLSAANGTEYGLMAYVYTQDLSKGLRVSEKIESGMVGLNRGLVSDPAAPFGGVKQSGLGREGSHHGILEFTETKYIATNW

SEQ ID NO: 14135 - protein, 313 aa, Glycine max
MGANSMLSESSHDLDDQISQLMQCKPLSEQQVRGLCEKAKEILMDESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 14136 - protein, 144 aa, Arabidopsis thaliana
MIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 14137 - protein, 444 aa, Pseudomonas syringae pv. syringae B728a
MLPPETQRLIEQHGIKYVLAQFVDIHGSAKTKSVPVTGLEMVAEDGAGFAGFAICGMGMEPHGPDFMARGDLSSLTPVPWQPGYGRVVCIGHVDGKPWPYDSRYVLQQQVERLSQRGWSLNTGLEPEFSLFKRDVTGSLQMVDASDNLDKPCYDYKGLSRSREFLERLTEALQPVGFDIYQIDHEDANGQFEINYTYSEAMESADRFTFFRMAAGEIANDMGMICSFMPKPDPKRAGNGMHFHLSIASASNKNLFHDASDPSGMGLSTLAYHFAAGLLAHGPALCAFAAPTVNSYKRLVVGNSLSGATWAPAFIAFGANNRSAMVRVPYGRLEFRLPDAGCNPYLVSAAIIAAGLDGIDRQLEIDHVCNENLYKLSLEEIAARGIKTLPQSLNEACDALQADPLFGEVLGSEIVDEFIRLKRMEWVEYSRHVSDWEVKRYIEFF

SEQ ID NO: 14138 - protein, 444 aa, Zea mays
HASENIDIWRQLWRVLERSDLLVMVVDARDPLFYRCPDLEAYAKEIDEHKRTILLVNKADLLPLNIRKRWADYFKAHDILYVFWSAKAATATLEGKKLSGYSEGESASLDLDTKIYERDELLMKLQAEAESIVAQRRISPTVDDHEASSSDSVSSVTKHVVVGFVGYPNVGKSSTINALVGEKRTGVTHTPGKTKHFQTLIISEELTLCDCPGLVFPSFSSSRHEMVACGVLPIDRMTKHREAIQVVADRVPRDILEQIYKIALPKPKPYEPQSRPPTAAELLRAYCASRGHVSHAGLPDETRAARQILKDYIDGKIPHFELPPGVTGPEVDFEQIAGSESPTTSAANESVTDDLDEEDDDAVDPAESNMRDVLDDLESFDLGNGGSKTTAKKKEASHKHHKKPQRKKDRSWRVGNDGGDGTAVVRVYQKPAVNLSTVSLSGRV

SEQ ID NO: 14139 - protein, 320 aa, Zea mays
MQCMEGTIPDSSSTRIAVVTGGNKGIGLEVCRQLAASSTSGVAVVVVLTARDEARGAAAVGKLRGLGLSNVFFHQLDITDAPSIARLADFLKSRFGKLDILVNNAGFVGLEYIQDRIDGTSTTSEEFCGMDMDKRLELLLKWCLRETCDAGKECMRINYHGTKQVTRALLPLLLASDSGRIVNVSSVLGQLRFFGSEALKRELDDVASLTEERLDEVAGAFVADLEAGAVEARGWWPAGFSAAYMVSKAALNAYSRVLARRHPALRVNCVHPGFVRTDMTVNFGMLTPEEGGSRVVAVALLPDGGPTGAYFQERQQAPFV

SEQ ID NO: 14140 - protein, 376 aa, Oceanospirillum sp. MED92
MSEQMIKSRAAIAWGPNQPLSIEEVDVMPPQAGEVLVRIVATGVCHTDAFTLSGEDPEGIFPAILGHEGGGIVEAVGEGVTSLQVGDHVIPLYTPECGECKFCKSGKTNLCQKIRETQGKGLMPDGTTRFYKDGEPIYHYMGCSTFSEYTVLPEISLARVNKEAPLEEVCLLGCGVTTGMGAVMNTAKVEEGATVAIFGLGGIGLSAVIGATMAKASRILAIDINDSKFELAKQLGATDCINPKEFDKPIQEVIVEMTDGGVDYSFECIGNVDVMRSALECCHKGWGESVIIGVAGAGQEISTRPFQLVTGRVWRGTAFGGVKGRSELPEIVERYMAGEFKLNDFITHTMGLDKINEAFDLMHEGKSIRSVIHYDR

SEQ ID NO: 14141 - protein, 586 aa, Magnaporthe grisea 70-15
MAPSAIVDSAPASPTINGDRPRILVPEKVSPDGLAMLTGLYDVDKRQGLSAEELVEIIPNYHGLIVRSETKVTAQVLSAAAKLRVVARAGVGVDNINVDAATKQGIIVVNSPAGNIVAAAEHTVALLLATARHVGRADSTLKQRKWERSKLVGVEVGRKTLGVIGLGKVGIRVARMATGLGMKVIALDPYASEDLAKQAQVKLVSSLEELLPAVDFLTIHTPLLASTLNLLGEAEFQKMKPTSRVLNVARGGVYNEDALIRALDEGWIAGAGIDVFTSEPPEPESSAARLAAHPKVVATPHLGASTVEAQENVSLDVCAQVLEILRGGLPTAAVNAPLILPEEYRKLQLFVRLVERMGGLYTQHFAGSKGRTTGSRRFELNYQGELASVSNTRPLFAALVKGLVSSISDSGGQDVNIVNAMLIAKDKGIAVNETHTRESSDQAYASLVTLRVSGAGDEDQHVIEGYVSGQNVYISRLGRFNANFTPEGMMLILHNYDEPGKIGNVGSVLGRHSINIRFMQVAGLALHDQQKEQVSSNRDRVGEHENEALMILGVDGEITKEVLNDLSQAEGILNLLLFPRARRYHA

SEQ ID NO: 14142 - protein, 475 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMLCSETAYLGGLQKLRLSTLLQPPPSPWTNPRLDVNVAYVDGRDEPERGNSNQQFTQDLFVPSSGKRKRDDSSAHYQNGGSIPQQDGASDAIPEANFECAALRITYVGDRKIPRDLIGSSSKIPQVDGPMPDPYDEMLSTPNIYSYQGPNEEFNEARTPAPNEIQTSTPVAVPNDIIEDDEELLNEDDDDDELDDLESGEDMNTQHLVLAQFDKVTRTKSRWKCSLKDGIMHINDKDILFNKASSTSDLDTSNASRKVRVLQMSDTDLRVRDMIIYGNMYSGWLVVQKEQIFPAEEGLSTLTCFMSFIFSFTQWKLTFQKLDLTYNYM

SEQ ID NO: 14143 - protein, 502 aa, Lactococcus lactis subsp. lactis Il1403
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFADGADAISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDIKLIVALTESGNTARLISKHRPNADILAITFDEKVERGLMINWGVIPTMTEKPSSTDDMFEVAEKVALASGLVESGDNIIIVAGVPVGTGRTNTMRIRTVK

SEQ ID NO: 14144 - protein, 618 aa, Rhodococcus sp. RHA1
MALEDSSSAFADPSREGAASPEHDLEGHLIEARSEDFFHARELQVDNEWFKTAVFYEVLVRAFFDSSGDGTGDLQGLTSKLDYLSWLGVDCLWLPPFYDSPLRDGGYDIRDFRAVLPEFGTVEDFVQLFDQAHRRGIRVITDLVMNHTSDTHAWFQESRTDPDGPYGDFYVWSDRDEGYPDARIIFVDTETSNWTWDPVRKQYYWHRFFSHQPDLNYDNPDVQDAMIDVLRFWLDLGIDGFRLDAVPYLFEREGTNCENLPETHAFLKKCRAVMDAEYPGRALLAEANQWPSDVVEYFGEPDVGDECHMAFHFPLMPRIFMAVRRQNRFPISEILAQTPPIPSSCQWGIFLRNHDELTLEMVSDEERDYMYSEYAQDPRMKANIGIRRRLAPLLENDRNQLELFTALLLSLPGSPVLYYGDEIGMGDNIWLGDRDSVRTPMQWTPDRNAGFSRADPARMYLPVIMDPTYGYQSVNVEAQMNSTNSLLHWTRRLIQVRKQHPAFGTASFTELGSANPAVLSYVRETPPSQDRPYSDVILCVNNLSRFPQAVILDLTQFAGRIPVELTGSVPFPSIGDGGYMITLPGHGFFWFALQPDPKSDGAVSGHPVSSEAEQAVQQ

SEQ ID NO: 14145 - protein, 278 aa, Ralstonia eutropha JMP134
MRSNMHQGHVARKRFGQNFLVDDSIIHGIVNAINPLADDVLVEIGPGLGALTDPLLERVPQMQVVELDRDLVERLRRRYGDRLQVHAGDALAFDFGRLAVPGRPLRIVGNLPYNISSPLLFHLMDYADHVHDQHFMLQKEVVDRMVAEPGSKAFGRLSIMLQVRYHMEHVLDVPPGSFNPPPKVDSAVVRMIPWPRTESGRLRSPHADCDITVLGDLVTAAFSQRRKVLRNTLSFLRDQIDFEAIGFDLGRRAEEVPVGEYVELARRLGGDASDRSAA

SEQ ID NO: 14146 - protein, 458 aa, Burkholderia pseudomallei K96243
MTQQQRTFDSIVEREKGLRRGLSSAQMAMIAIGGAIGTGLFLGSGFAIGLAGPGVLVSYAIGALIALLLMGALAEMTVAHPTSGSFGAYAEHYVGPLAGFLVRYAYWSAVVFAVGTEVSAIAVFMKYWYPGVPGWYWVVGFSAVLIAVNMTSVTLYGVVEYVFSMLKIAAIVAFIALGAYFVAAAPVSSGIGFANYSAHGGFFPKGFSGVWVAVIVAIFSYMSIETVAIAAGEARDPQRAVSRAFRSTVFRLVLFYLLTLALMLAIVPWTQAGTDESPFVKVMAATHVPYAAGVINFVVLVAALSAMNSQLYVTTRMMFSLSRARLAPAMFGRVGANGVPLAALAVSSSGVAVAAVLVALYPQTAFTLLMAIAMFGALFTWLMIFVTHLRFRARYRGPTPVFRMWLHPAGSLTGAALVGAVLVTTAFTREFRMTMMVGVAFIVLLTLAYRWHYRARHA

SEQ ID NO: 14147 - protein, 339 aa, Mycobacterium avium
MTVRVGINGFGRIGRNFYRALLAQQEQGTADIEVVAVNDITDNSTLAHLLKFDSILGRLPYDVSLEGEDTIVVGPAKIKALEVREGPAALPWGDLGVDVVVESTGLFTNAAKAKGHLDAGAKKVIISAPATDEDITVVLGVNDDKYDGSQNIISNASCTTNCLAPLTKVLDDEFGIVRGLMTTIHAYTQDQNLQDGPHKDLRRARAAALNIVPTSTGAAKAIGLVMPNLKGKLDGYALRVPIPTGSVTDLTAELKKPASVEDINAAFKAAAEGRLKGILKYYDAPIVSSDIVTDPHSSIFDSGLTKVIDNQAKVVSWYDNEWGYSNRLVDLVALVGKSL

SEQ ID NO: 14148 - protein, 544 aa, Vibrio vulnificus YJ016
MLKKCSKITLVLFQGKQGMSPKCRKLLKFDEVITMSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAAFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 14149 - protein, 469 aa, Streptomyces filamentosus
MFQNADEVQKYVADNDVKFIDVRFCDLPGVMQHFTIPAATFDPAEELAFDGSSIRGFQAIHESDMALRADLSTARVDPFRRDKTININFFIHDPITGEQYSRDPRNIAKKAEAYLASTGIADTAYFGPEAEFYVFDNVRFQTSANESFYHIDSEAGAWNTGAVENNRGYKVRYKGGYFPAPPVDHFADLRAEISLELDKNGLQVERQHHEVGTAGQAEINYKFNTLLAAADDLMLFKYIVKNVAWRNGKTATFMPKPIFGDNGSGMHVHQSLWQGGSPLFYDEQGYAGLSDTARYYIGGILKHAPSLLAFTNPTVNSYHRLVPGFEAPVNMVYSQRNRSAAMRIPITGSNPKAKRVEFRAPDPSSNPYLAFSALLMAGLDGVKNKIEPAEPIDKDLYELAPEEHANVQQVPTSLPAVLDALEADNEYLQAGGVFTSDLIETWIDYKRTNEIAPIQLRPHPHEFELYFDI

SEQ ID NO: 14150 - protein, 473 aa, Synechocystis sp. PCC 6803
MARTPQEVLKWIQDENIKIIDLKFIDTPGIWQHCSFYYDQLDENSFTEGIPFDGSSIRGWKAINESDMCMVPDPNTATIDPFCKEPTLSMICSIKEPRTGEWYNRDPRTIAAKAVEYLRGTGIADTVYFGPEAEFFLFDDIRFGQTENSSYYFADSVEGRWNTGREEEGGNLGYKPGYKQGYFPVAPTDTAQDIRTEMLLTMAGLCVPIEKHHHEVASGGQNELGIKFDKLVNSADNLMIYKYVIKNVAKKYGKTVTFMPKPIFNDNGSGMHVHQSLWKDGQPLFAGDKYAGFSQMGLWYIGGILKHAPALLAFTNPTTNSYKRLVPGFEAPVNLAYSQGNRSASVRIPLSGGNPKAKRLEFRCPDATSNPYLAFAAMLCAGIDGIKNQIDPGEPLDVDIYDLSPEELAKIPSTPGSLEAALEALEKDHEFLTGTGVFSPDFVESWIEYKLDNEVNPMRLRPHPYEFSLYYDC

SEQ ID NO: 14151 - protein, 483 aa, Synechocystis sp. PCC 6803
MPALINPVKFMRPLSHRTKIVATIGPASSSVEVIRQMVDAGMNVARLNFSHGSYEDHATMVRLLRSVEQEMDTPITLLQDLQGPKIRIGQLPGGEKQLREGEKVSLVPVEIGDRHPGAVGIDYPHLATEAKVGERILLDDGLLEMKVVSIQDPEVICEVVTGGILKSRKGVNLPGLVLTLPSMTTKDKQDLEFGLSQGIDWVSLSFVRKGEDIHTLKQFLAERGHPDLPVIAKIEKPQAIDNLEEIVAVSNGIMVARGDLGVEVNPEKVPRLQKEIIRRCNVRAIPVITATQMLDSMIQNSRPTRAEASDVANAILDGTDAVMLSGESAVGQYPVKSVQMLRKIAEETEVGLHLVNNPPIENTETHALSEALVVIDGILDLKYIVTFTTSGFTSLLASNQRPSVPVIAFTPSEKVYHSLNLVWGIIPFLINEEFDTFEDLIQQAEVLLRDRKMVEKGDQLLIMAGIPTKIPRGTNFLKIHRIS

SEQ ID NO: 14152 - protein, 453 aa, Methylococcus capsulatus str. Bath
MPFIPHTEAEVRDMLAAIGAGSIDELFAEIPPDLRCGELKDLPEALSEMEVCKLMEERAAENRSALCFAGAGAYEHYIPAAVWEIALRGEFYSAYTPYQAEASQGSLQVFYEYQSMMAGLMAMDVSNASLYDGASALGEAILMALRTNPESRSRKILLPRSLNPVYKRVVRTLTRNQRVELVDLDYDRSLGRIAENALETFEGGEFAAVVIPQPNHFGVLEEVDVLADWAHRHGARSIAVVNPTAMALLKPPGEWGEHGADLACGEGQPLGIPLSAGGPYFGFLCSRQDFVHQLPGRLVGRTVDVDGREGFTLTLQPREQHIRRGKATSNICTNQGLMVTAATLYMALMGPKGLRNVAAACHANASALLERLTRIDGVEPVFPAPFFHEAAIRLPRAADRVLAGLAERGILGGHVLSADYPELGDALLICATETRGPEDMDRYAAALAEVLEC

SEQ ID NO: 14153 - protein, 488 aa, Methylococcus capsulatus str. Bath
MLIFDRSREGRACASLFPQTPADIRGLPGHLLRQTPPPLPEVTELDVVRHYTRLSQKNFSIDTHFYPLGSCTMKYNPKAANVLARQPGFAALHPLGTERFGQGTLSCLYELQEYLKTLTGMTAVSLSPAAGAQGEFCGVAMIRAYHDARNDHERNEILVPDAAHGTNPASAAMCGYQVREIPTNADGDVDLEALKQAVGPKTAGIMLTNPSTLGVFEHRIPEIAALVHEAGGLLYYDGANLNAILGKVRPGDMGFDVIHLNLHKTFSTPHGGGGPGAGPVGVNARLQPFLPLPMVARSGNGYRWLAESDRPQSIGRLSAFAGNVGVLLRAYVYIRLLGYPGLRRVAEYATLNANYLQKRLVEAGFDTAFPARRAAHEFILSVQRQKKEHHVTALDFAKRLLDYGFHAPTVYFPLLIPECLMIEPTETENKETLDAFVDAMAAILKEAAEEPERLGQAPHCTPVRRLDEARAARHPDLAWKPAAPVPPR

SEQ ID NO: 14154 - protein, 1188 aa, Bacillus clausii KSM-K16
MFLKRLEVKGFKSFAEPILVDFVPGVTAVVGPNGSGKSNIADAVRWVLGEQSARSLRGAKMEDIIFAGSDSRKAVNMAEVSLILDNEDGHLAIDYSEVSVTRRLYRSGESEYLINRHSCRLKDIVDLFLDSGLGREAYSIIGQGKIEEILSSKAEERRTIFEEAAGVLKYKTRKNKAVKRLEQTEENLVRVADILNELEEQVEPLREQASIAEEYKLLAEEQRTLDIQVIAQEITELYENWTAESDKLKTLKEQLQARKDSLEKAEEKLASYREEHAAIRQTAADLHKKRLEVSEALEKNEGRRGVLEERKKHALHNEEQLIESIKEREANQKAVQQKLDELFKQYETVKQKDDELKAEFDEATRHLTRSKEDVSSELEDAKGDYIEWLNEQASLRNERRYLEEQLQQKQRNARRAESAAAASKKEAQQLEQEAAERAQVLKAAEQSFAEAKMTHHRHLSEEETVKNRYYKREAKLYEAYGLLQKITSRREVLQEMEAEYAGFFQGVKEILKQRGSSLSGIVGAAAELISVPKKFEAAIELVLGAQAQHVVVDDEAAAREAISFLKQRRLGRATFLPLTTVKARVVPEAVISAIANEPGYLGIAADVVEAKPEHRQAVGFLLGSTILAETLPQANKIAKRSGHRYRVVTLEGDIVNPGGSMTGGSAKQNQSSLLGRKREKEELDAKKTKLEEAIRDLEKQVKQDKERRQELQETIAKVEAQKAQAQETLEEAQRAHQEASIAYERARQEVERIEQQSKEQDAEEAKTQDRFLEIEEAEKKAIAESMRLEEKIKRLEARLASEQQSKEEWQAKLTELRVARAETKQQLQYVDAQRQELTAALEKEQQELLQAKEHLALVTSSADEQAHTSQSLAEQIAAGKQEKQALAAKLAELEEKEAALNDRYKQLEAETKSAQGEHSYLLEESQKLEVRVNRLDVDLDYRLNRLREEYELSYEAAASRYPLSQPLEQAKMRLSLVKRSIDELGTVNLGAIEEYARVRERYEFLREQKSDLLEARVSLDQAIAEMDEEMSKRFGETFANIRAHFQTVFTKLFGGGDADLVLTNKDDLLTTGIEIIARPPGKKRQQLGLLSGGERALTAIALLFAILQVRPVPFCVLDEVEAALDEANVSRFAQYLHDFSQKTQFIVITHRKGTMEGADVLYGVTMEESGVSRLVSVKLEETRQLIGS

SEQ ID NO: 14155 - protein, 372 aa, Zea mays
MGAEAAHPQQQPPSSVRPCREAAAPAVLGLQLSALIDHVARVDWSLLDRVAGDRGGSQQVSIVELNHILNEVNTHILPSHNDLTPITTIAGGSVANTIRGLSAGFGISTGIIGACGDDNQGILFVNNMSFSGVDLTRLRAKKGHTAQCVCLVDASGNRTMRPCLSSAVKIQANEFRKEDFKGSKWLIVRYAQQNMEQIIEAIRIAKQEGLSVSLDLASFEMVRDSRSKLINLLETGNIDLCFANEDEAREVIGGGLESDPEEALAFLGKYCKWAVVTLASKGCMAKHGKQVVQVPAIGESNAVDTTGAGDLFASGFLYGLVKGLPLEECCMVGACSGGSVTRALGGEVRPENWQWMYKQMHARGMLLPELKN

SEQ ID NO: 14156 - protein, 422 aa, uncultured archaeon GZfos11A10
MTTTTQSKKVYEEARKLIPGGVSSPVRAIKPYPFYTASAEGSVITDIDGNRYIDYVMGYGPLILGHAHPAIKDAVAGQLERGWLYGTPIEAELKLASKIAAIYPSIEMMRFVSSGTEATMSALRLARGYTGRNKFLKIEGGFHGAQDAALVKAGSGATTHGTPDSLGVPPDFTKHTLQVPYNDIETMTEAIESNREDLAAVIIEPVLGNIGPILPAPGYLESVRKITEENDVLLILDEIITGFRLAMGGAQECFEIVPDMTTLGKIVGGGFPFGVFGGKKEIMELISPSGGVYQAGTFSGNPVSVTAGLAVLDVLEGEDVHRRLELAGNELRAALQDLVADRKLSYSVAGIASMFKVFFGDAPHNYQEALSCDKEGYLRFFHRMLKSGVFLPPSQFETNFISIAHTGGDLDATIAAYEENLR

SEQ ID NO: 14157 - protein, 201 aa, Triticum aestivum
  misc_feature (114)..(114): Xaa can be any naturally occurring amino acid
  misc_feature (129)..(129): Xaa can be any naturally occurring amino acid
  misc_feature (140)..(140): Xaa can be any naturally occurring amino acid
  unsure (1)..(201): unsure at all Xaa locations
MGSAASPPRALDAATQEDLKRVSAHRAVDMVESGMTLGLGTGSTAAHALDRLGDLLRTGALRAVAGVPTSLKTEAHAARVGIPMLALADAAEIHLSIDGADEVDPDLNLVKGRXGGSLLREKKIEGAGXRFVFIADESKXSVPRLGCTGACSRSRVGPLSGRGQTGFGPLSGKGVSNKNSPGAFPRTRGSKETAQRPQRAR

SEQ ID NO: 14158 - protein, 261 aa, Emericella nidulans
MGHEDAVYLAKLAEQAERYEEMVENMKVVAASDVELTVEERNLLSVAYKNVIGARRASWRIVTSIEQKEESKGNKSQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 14159 - protein, 351 aa, Symbiobacterium thermophilum IAM 14863
MAETMRALRKLEAGPGATLQEVPIPTIGPRDVLVKVRAASICGTDYHIYTWDPWSAGRVKPPLTIGHELAGEVVAVGREVTACKVGDYVSAETHIVCNRCPRCHMGEYHLCENTKILGVDTDGAFAEYVAVPEQNIWVNDKDIPFELQSIQEPLGNAVHTALNGDLTARSVLITGCGPIGIMSVPVAKMAGAEIVMAMDINEYRLQLAGQLGADVLINPTKQDPVEVVRSYTRGYGADVVLEMSGNPTAIRQGLKAARNGARISLLGLPGRPLELDLAADVIMRGLVLQGITGRRMWQTWYQVRSLYRAGLAERLRPLVTHRMPLEQIDAAMELMGSGQSGKIVLVPDLKA

SEQ ID NO: 14160 - protein, 193 aa, Zea mays
MSAVNITNVAVLDNPTAFINPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYGDEQLREEPPAKVLIDRVQRNILADKPRVTKFPINFHPEPSTGTGRQQQQQEPQTASPEKHAGSGEGNGSKPEADQ

SEQ ID NO: 14161 - protein, 505 aa, Agrobacterium tumefaciens str. C58
MRTPKPVVLTILDGWGLNEDTSSNAPVLANTPTMDRLFATCPNATLTTFGPNVGLPTGQMGNSEVGHTNIGAGRIVAMDLGQIDLAIEDGSFFRNAAMLDFAATVKAAGGVAHLMCVVSDGGVHGHILHGQAAVKLMVSHGLKVVVHAITDGRDVAPQSAEDFVAALVASLPQGASIGTVIGRYYAMDRDNRWERVEKAYDAMVLGKGEHARDAVSAVAQSYANKVTDEFILPTVIDGYEGFKAGDGLFCLNFRADRAREILLAIGADDFDGFAREKPVLSALLGMVEYSTRHSDFMTTAYPKRDIVNTLGAWVAKQGLTQFRLAETEKYPHVTFFLNGGKEEPEVGEDRFMPKSPKVATYDLQPEMSAAEVTEKFVEVIGKGYDLIVTNYANPDMVGHTGDLQAAIKACEAVDRGLGAVVAALEKVGGAMLVIADHGNCETMVDPVTGGPHTAHTTNPVPVILFGGPEGAKVHDGILADVAPTLLQLMNVPLPPEMTGKSLIDL

SEQ ID NO: 14162 - protein, 476 aa, Agrobacterium tumefaciens str. C58
MDIWTRDFAMQTFVENFENSDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRFNGNAQHQAGHGLVMADMPGLSESIRKP

SEQ ID NO: 14163 - protein, 533 aa, Gibberella zeae PH-1
MGVVEALLEQVTLKTTLVILFVSYCIYSIICRIDEHRRIRRLGHYGPHMKTYAPWGLGIVARFVVSTVKHQNLATWRDDMFGAENSWTVETRLLGVRTIFTADPANLKAILATQFVDYGKGKPFHAEWKDFLGDSIFTTDGAPWHASRQLIRPQFTRDRVSDLHCFEAHMQTLFKAIANRGPLHGEDQPVPTEGLDGKVLDISDLFFRYTLDVATEFLLGWDVKSLTTPRQEFAEAFNDVQRIQNIVARTGKLRHIIPRYKFWKGLKTVNHFINFYIERALRLSPEELNSKTKDDHSYTFLHALAGFTRDRKVLRDQIIAVLLAGRDTTAATLSWTLYELGRYPNAVKRLRSEILSTLGSERTPTYDDLKSMSYLKAVLNETLRLYPAVPFNVRLALKDTTLPRGGGPDGSEPLPVLKDSPVGYSTLVMQRRSDLYPPISDTFADPQIFSPERWAHWHPKPHDYIPFNAGPRICIGQQFALTEMSYVLCRLFQKYERVESRMKDIDGGEPLLKADIVLSPGQGVNVAFWEAKK

SEQ ID NO: 14164 - protein, 536 aa, Neurospora terricola
MTLLALKEDRPTPKAVYNWRVYTCAAIASFASCMIGYDSAFIGTTLALPSFKKEFDFASYTPGALALLQSNIVSVYQAGAFFGSLFAFATSYFLGRRKSLIAFSVVFIIGAAIMLAADGQGRGIAPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLFANGKREEAMKVLCWMRNLEPTDRYIVEEVSYIDADLERYAREVGKGFWKPFLSLKQRKVQWRFFLGGMLFLWQNGSGINAINYYSPTVFRSIGITGTNTGFLTTGIFGVVKMVLTIVWLLWLVDLVGRRRMLFIGATGGSLCMWFIGAYIKIAGPGSTKAEDAKLTSGGIAAIFFFYLWTAFYTPSWNGTPWVINSEMFDQNTRSLGQASAAANNWFWNFIISRFTPQMFIKMEYGVYFFFASLMLLSIVFIYFFIPETKSIPLEAMDRLFEIKPVHNANKILMAELNFDRNPEREESSLDEKDRVTQTENAV

SEQ ID NO: 14165 - protein, 228 aa, Malus x domestica
MGTTRMVYIVTMLFSLIVLILSSSTVGYDYFQFTQQYQPAACNSNPTPCKDPPDKLFTVHGLWPSNMNRSELFNCSSSNVTYAKIQNIRTQLEMIWPNVFNRKNHLGFWNREWNKHGACGYPTIRNDLHYFQTVIKMYITQKQNVSDILSKAKIEPDGNIRTQKEIVDAIRKGIHGKEPNLKCQKNTQMTELVEVTLCSDGNLKQFIDCPHHFPNGSRHNCPTNHILY

SEQ ID NO: 14166 - protein, 283 aa, Bacillus clausii KSM-K16
MTHQTTVAILGAGSMAEALIGGIAKTNGGKAPHITVLNANNRKRLNQLHAAYGVHAAQSYEEAVKGKDVIVLAIKPHNVQEVADSLVSLLDPQKQLVISVAAGIKLETLESWLPADTAVIRAMPNTSARVLASATTLSIGTYATEWQLAFAKTLFSSIGTVTVVDEQQMDAATGIAGSGPAYIYYVAEAMLNAAIAEGLSPAEARALINQTIGGAAKQLSNSSKSPKDLYKEIMSPNGTTEAAIAHLDHSSAQELFQQAIHQAVKRSAAIGASFERDPIHKHQ

SEQ ID NO: 14167 - protein, 248 aa, Arabidopsis thaliana
MLAIFDKNVAKTPEALQGQEGGSVCALKDRFLPNHFSSVYPGAVTINLGSSGFIACSLEKQNPLLPRLFAVVDDMFCIFQGHIENVPILKQQYGLTKTATEVTIVIEAYRTLRDRGPYSAEQVVRDFQGKFGFMLYDCSTQNVFLAGDVDGSVPLYWGTDAEGHLVVSDDVETVKKGCGKSFAPFPKGCFFTSSGGLRSYEHPSNELKPVPRVDSSGEVCGVTFKVDSEAKKEAMPRVGSVQNWSKQI

SEQ ID NO: 14168 - protein, 228 aa, Malus x domestica
MGITGMIYMVTMVFSLIVLILSSSAVKFDYFQFTQQYQPAVCSSNPTPCKDPPDKLFTVHGLWPSNVNGSDPKKCKTTILNPQTITNLTAQLEIIWPNVLNRKAHARFWRKQWRKHGTCGYPTIADDMHYFSTVIEMYITKKQNVSEILSKAKIKPEKKFRTRDDIVNAISQSIDYKKPKLKCKNNNQITELVEVGLCSDNNLTQFIDCPRPFPQGSPFFCPTNNIQY

SEQ ID NO: 14169 - protein, 238 aa, Anabaena variabilis ATCC 29413
MSTTKKIAVVTGGNRGLGFEASRQLAKKGYLVVLTSRDEAKGKTAAGKLQAEGLDVVAYPLDVTSEKSSQQLTEFIRQEFGKVDILINNAAIYIDSQTGNNSIFHTKIETLQQTIDTNVYGVLRVTQALIPLMQEQNYGRIVNVSSGAGQLTDMGSGIPTYRISKTALNALTRIFANELKGTNILVNSVCPGWVKTDMGGQDAPRTPEEGVDTIVWLATLPDGGASGGFFRDRQSIDW

SEQ ID NO: 14170 - protein, 196 aa, Triticum aestivum
MNGLFFEPFEGFNALDDPKAIFCLKYMLLCKIMVNQADDVAGVISSKAGLKYVGPDVDAMKAVADAYSKRSLKYFETALGDYKAQLEEDPIVHRHLSSLYDTLLEQNLCRLIEAYSRVDIAHVAEMIELPIEHVEKKLSQMILDKKFAGTLDQGAGCLIIFEDAKTEAIFPATLETISNVGKVVESLYMRSAKIMA

SEQ ID NO: 14171 - protein, 685 aa, Saccharomyces cerevisiae
MSLTPTNEILFHYKSSVKVGELERYVITYHLYDGEEIPPDLNLNSLWLKVRNMNPLSYRAAYLMGPFMLYCDVKTAQYHHSQKIVASVDYPKFEPNVQTQQDFVAELSVHNIRQKYVWIADVMSQILFTTNTNVTYEVTIGTSKESVENPHDLPSHLGSYSPKLTVNRLTTLDLWNLPVQITTPQKKKHLVVLTHGLHSNVSTDLVYIMEQIYKAQKNYPHEQIVVKGYRGNVCQTEKGVKYLGTRLAEYIIQDLYDESIRKISFVGHSLGGLIQAFAIAYIYEVYPWFFKKVNPINFITLASPLLGIVTDNPAYIKVLLSFGVIGKTGQDLGLENDVEVGKPLLYLLSGLPLIEILRRFKRRTVYANAINDGIVPLYTASLLFLDYNDILEQLQKLKENSKKSPLINDASTPVNQDFFNKTFISPLTKMLSILAPQKFPTENGSEIPKVSFFESASSILLPPLPERAYIMDPDSRDPVIIHDKIYNEDDIPQSEFDIEDGFFGKKNILLQAFFAGKKERAKYRNLEETIARRWHEGMAWRKVVVALKPDAHNNIIVRRKFANAYGWPVIDHLIDVHFNGDDDDDNDENDDINSTQVVEPIQSVTEGKKKYRKAENIPQEYGWLNKVETNGVFDEGPTGMISTVGEIVEALAKRGFSAVIDRRNASEDPNDEVLRFEEMNSDLVQ

SEQ ID NO: 14172 - protein, 181 aa, Lycopersicon peruvianum
PASFCDSNNCKRIAPKNFTIHGLWPDKEGTVLQKCKPKPNYVNFKDKMLNDLDKNWIQLKFDEDYGRDKQPLWVYQYLKHGSCCQKMYNQNTYFSLALRLKDRFDLLRTLEMHKIFPGSSYTFQEIFDAVKTATQMDPDLKCTKGAPELYEIGICFTKKADALIPCRPSNTCDRTGNIFFR

SEQ ID NO: 14173 - protein, 333 aa, uncultured marine gamma proteobacterium EBAC31A08
MKYDISALGNALVDTQYKVSHEFLSSVGLVADSMTLSSSEEQAPIISKLIEMGAESISDCGGSATNSLVAAANYGSNCHHVCRVSDDEDGRNYLDSLRSAGVKHIGVSSENTDQPTGKCLILVTPDAKRTMSSMLGVSAYLGKSDIDFDVVENSKIFYIEGYMVTSDDNFNAVISVLEHLKDKDVKKALSLSDAGIVHGFKEKFDLIESYGIDMIFCNDDEAVAFSGKESLDDAVSFYKEKPYMTAITKGADGSVVIDKGVEKHAQAEEITPIDTNGAGDMFAGSFMHAYLQGNNIEACAKFANYASSKVVETFGPRLSSDGYLKVLNKLKND

SEQ ID NO: 14174 - protein, 233 aa, Bacteroides fragilis NCTC 9343
MKWESSLVEHLQWSDTITNRESKEQLARMIAMRVQEGEIIGAGSGSTVYLALLAIAERIRTENLHVTVIPASMEISMECVRLGIPQTTLWMCRPDWTFDGADEVDPDHNLIKGRGGALFKEKLLICSSNRTFILVDESKQVSFLGSRFPVPIEVFPMALPYVEREVLTMGALRTELRLAKGKDGPVITENGNLILDAWFGNIHSSLEKEIKSITGVVENGLFMGYDVEVMVAK

SEQ ID NO: 14175 - protein, 260 aa, Kineococcus radiotolerans SRS30216
MAGGVPHPHHPRPHHAGERPGGHHGQPRGRRAGQVRGTAQRVRPRGRGVGVSAPAVPAGTAVAAALDALRAGRPVLVSDAADRENEGDVVLSAQLATAEWVGWAVRHTSGMLCAPMPAERADALGLPRMVERNEDSYRTDYTVSCDAASGVTTGISAADRARTARVLAEPSSGPGDLIRPGHVFPLRARPGGVLERPGHTEAAVDLCRLAGLAPVGLISELVEDDGSMSRWDQIVALGEQYDLPVLTIADLRTHLSAAAD

SEQ ID NO: 14176 - protein, 172 aa, Oryza sativa
MAAAVSACSSRCLRLILGRPPRARLASVVEVVEKRRRGGLVAVAATEGSAKSSGEADEQVPSWARPGSDEPPPWAREGGGGGGQQEPGAVELPFFAYLLASAITAIAAIGSIFEYANQRPVFGVVSPDSALYAPLLGFFVFTGIPTSGFLWFKAVQTANKEAEEQDRRDGFS

SEQ ID NO: 14177 - protein, 293 aa, Xylella fastidiosa Ann-1
MIASFSSIAMPHVTLLPSPSPIAFIGGGNMARSLIAGMIRQGAPSTSICVIEPIAALRDALMADFNIKAVTTATEAATDTSTWVLAVKPQVMPDVCATLPLPVQPNTPLVISIAAGITTCKLKHWLGDTCAIVRAMPNTPALLGAGVTGLFATSQTTGTQRTLAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQALVAKAIDAATLRARALGKINDTDPT

SEQ ID NO: 14178 - protein, 434 aa, Streptococcus pneumoniae TIGR4
MNEKVFRDPVHNYIHVNNQIIYDLINTKEFQRLRRIKQLGTSSYTFHGGEHSRFSHCLGVYEIARRITEIFEEKYPEEWNPAESLLTMTAALLHDLGHGAYSHTFEHLFDTDHEAITQEIIQNPETEIHQVLLQVAPDFPEKVASVIDHTYPNKQVVQLISSQIDADRMDYLLRDSYFTGASYGEFDLTRILRVIRPIENGIAFQRNGMHAIEDYVLSRYQMYMQVYFHPATRAMEVLLQNLLKRAKELYPEDKDFFARTSPHLLPFFEKNVTLTDYLALDDGVMNTYFQLWMTSPDKILADLSHRFVNRKVFKSITFSQEDQDQLTSMRKLVEDIGFDPDYYTAIHKNFDLPYDIYRPESENPRTQIEILQKNGELAELSSLSPIVQSLAGSRHGDNRFYFPKEMLDQNSIFASITQQFLHLIENDHFTPNKN

SEQ ID NO: 14179 - protein, 304 aa, Schizosaccharomyces pombe
MGRAEAGTPKAISNALKSKGLQRLRWYCSACQKQMRDENGFKCHTQSEGHIRQMNVIAMNPGKRIQDFSNQFLRDFISLLRTAHGEKKIHFNQFYQEYIRDKNHVHMNATRWHTLSEFCKFLGRQGMCRVEENEKGFFISYIDKNPANILRNEANKKRERQEKSDEEQRLRLLDEQIKRAYESAQNNEDNKDGSSREQPVLHEIDLSKKGNPIQLNLSSSSDSHSAQNEFFQTRNTPTFSFSSSSSQTSLKHKPKNVFAELNKSRKKNNKDSLDQGQNVKRPRSAVEDIIAQETMREKRRNIKL

SEQ ID NO: 14180 - protein, 180 aa, Petunia x hybrida
MASSVISSAAVATRTNVAQASMVAPFNGLKSAVSFPVSSKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGF

SEQ ID NO: 14181 - protein, 964 aa, Oceanobacter sp. RED65
MSTRATLTELENRDEFVNRHISNDQSDLQDMLNTVGAESLDDLTQQIVPPSILREPFLEMGEALPEHEALANLRAIANKNKVYKSYIGMGYHDTRLPNVILRNVLENPGWYTAYTPYQPEIAQGRLEALLNYQQMVIDLTGMELANASLLDEATAAAEAMALIKRQVRKNKSNVFFVDELCLPQTIDVLKTRADGFGWELHIGPAETATDVECFGALLQYPAVDGNIDDFEELIAQMHEKNAMVAMATDLMALTLLKSPGELGADVALGNSQRFGVPMGFGGPHAAFFATKDAFKRAIPGRLIGVSIDSNGNRALRMALQTREQHIRREKATSNICTAQVLLSNLASFYAVYHGRDGIKRIANRIHRMTEIMAAAITDADIEDLVIVNQSAFDTLTIEVPNKAEVLARADEAQVNLRTQSQVDFDNVVGFSIGETTSRADLETLYYVITGRRDIDIEMLDQEVESSIPESLKRTSDFLTHPVFNSYQTEHEMLRYMKRLESKDLAMNHSMITLGSCTMKLNATAEMIPVTWPEIGGIHPFAPKEQTPGYEELIQNLDTWLRDITGFDAICMQPNSGAQGEYAGLMAIKHYHESRGEGHRNVCLIPASAHGTNPASAQMAGMRVVLTKCDEQGNIDFDDLKAKAEELSESLSCLMMTYPSTHGVYEDGAKAICELIHEHGGQVYMDGANLNAQVGITSPGYIGADVSHMNLHKTFAIPHGGGGPGMGPIGVAKHLAPFVANHSLRPIEDASKGQSAVSAAPYGSASILPISYMYIHMMGAKGLRKATQMALLNGNYLAKKLGEHYPILYAGQNGRVAHECIVDLRPIKAETGITEVDIAKRLMDYGFHAPTMSFPVAGTFMIEPTESEAKAELDRFIEAMVSIKAEINAVKAGELDETNNPLTNAPHTVKDITGNWDRPYDREQGAFPVAAVYENKFWPSVNRIDDVYGDRNLICSCPAIEEYQD

SEQ ID NO: 14182 - protein, 180 aa, Petunia x hybrida
MASSVMSSAAVATSTNAAQASMVAPFTGLKSAASFPVSRKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGY

SEQ ID NO: 14183 - protein, 149 aa, Glycine max
MDEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVESANKEIALWFPEGPANCQSSQHSWIYE

SEQ ID NO: 14184 - protein, 138 aa, Lycopersicon peruvianum
IHGVWPDNHSRQLNYCDRQATFVDVPLGKKLDDLDKRWPQLKHNKEYGEKHQPHWREEFMKHGTCCKNLYNEEQYFDLAINFIDRFDILRILRYHGIIPGKSYIVQKVQDAIRTVTHKLPKLQCLENSVGLELSEVGI

SEQ ID NO: 14185 - protein, 310 aa, Zygosaccharomyces rouxii
MVTLQNSTSTLKLNTGQTIPQVGLGTWRSKENEGYKAVIEALKAGYRHIDGAAVYGNEGEVGKAIQDSGVPRNEIFLTTKLWCTQQRNPQEALDQSLQRLGLDYVDLYLIHWPVPLRTENIKDGNLFQFAEKPDGSKDVDLEWNFIKTWELMQKLLESGKTKAIGVSNFSVNNLKDLLAAPTTKVTPAVNQVELHPLLPQEDLIKFGKENGIVIEAYSPLGGENAPILSDPTVQEIAKANGVEAGHVVISWAVQKGLVTLPKSVTPSRIVGNLKVLTLSDSDVAKVDGLLKAKGERRTCYQDFSPFPIFQ

SEQ ID NO: 14186 - protein, 710 aa, Saccharomyces cerevisiae
MGNSGSKQHTKHNSKKDDHDGDRKKTLDLPPLTKSDTTHSLKSSRSLRSLRSKRSEASLASNVQAQTQPLSRRSSTLGNGNRNHRRSNNAPITPPNNHYLTSHPSSSRRLSSSSRRSSMGNNNNSELPPSMIQMEPKSPILKNSTSMHSTSSFNSYENALTDDDDDRGDDGGESPSMAKVTRINTSSSADRGSKRTPLRRHNSLQPEKGVTGFSSTSSKLRRRSDNTLPASYPLNAEAGGNGSDYFSNRSNSHASSRKSSFGSTGNTAYSTPLHSPALRKMSSRDNDDSGDNVNGRGTSPIPNLNIDKPSPSASSASKREYLSAYPTLAHRDSSSSLSPRGKGQRSSSSSSSSQRIYVSPPSPTGDFVHGSCADGDNGSRTNTMVEMKRKKPVRPVDIDEIIQRLLDAGYAAKRTKNVCLKNSEIIQICHKARELFLAQPALLELSPSVKIVGDVHGQYADLLRLFTKCGFPPMANYLFLGDYVDRGKQSLETILLLLCYKIKYPENFFLLRGNHECANVTRVYGFYDECKRRCNIKIWKTFVDTFNTLPLAAIVTGKIFCVHGGLSPVLNSMDEIRHVSRPTDVPDFGLINDLLWSDPTDSSNEWEDNERGVSFCYNKVAINKFLNKFGFDLVCRAHMVVEDGYEFFNDRSLVTVFSAPNYCGEFDNWGAVMTVSEGLLCSFELLDPLDSTALKQVMKKGRQERKLANR

SEQ ID NO: 14187 - protein, 140 aa, Lycopersicon peruvianum
IHGVWPDHTDYIMYDCNPNKEFKKIYDKHLLNKLESRWPQLTSNEYAGLNDQTFWKYEYEKHGLCCEKVYDRSQYFDIAMKLKDSIDLLNILTTNRIVPGFQYSYTGDQIRSAIKRVTQKDPNPKCTYSKGGLELLEIGI

SEQ ID NO: 14188 - protein, 476 aa, Campylobacter upsaliensis RM3195
MGKFVNNIEEFFTYCKENEVVFVDFRFTDIIGTWHHITYNFHSINEETFELGIPFDGSSLKGWQPVNKSDMILKPDAPSAFLDPFTADQTIIVFCDVYDIYKGQMYEKCPRSIAKKALQFLQESGVADMAYFGPENEFFIFDSVKIVDNANCSKYEVDTEEGEWNDNKEFVDSYNTGHRPRNKGGYFPVAPIDSLVDIRAEMVQTLEKVGIKTFVHHHEVAQGQAEIGVHFGTLVEAADNVQIYKYIVKMVAHLNGKTATFMPKPLYGDNGSGMHVHMSLWKNGVNLFYDKEGYGELSQDAIHYIGGILKNARSVAAFTNPSSNSYKRIVPGFEAPCILTYSCQNRSASCRIPYGMGKNSARVEIRFPDSTANPYLAFVSLLMAGLDGIKNKHIPVGPMEENLFDLTLDEVREKGIEQLPHTLRGSLEALIRYNSFLKPVMSDLFIDDYQHLKFATQVWPVEARPTAYEFKTCYSC

SEQ ID NO: 14189 - protein, 296 aa, Arabidopsis thaliana
MAEETPRYAVVTGANRGIGFEICRQLASEGIRVVLTSRDENRGLEAVETLKKELEISDQSLLFHQLDVADPASITSLAEFVKTQFGKLDILVNNAGIGGIITDAEALRAGAGKEGFKWDEIITETYELTEECIKINYYGPKRMCEAFIPLLKLSDSPRIVNVSSSMGQLKNVLNEWAKGILSDAENLTEERIDQVINQLLNDFKEGTVKEKNWAKFMSAYVVSKASLNGYTRVLAKKHPEFRVNAVCPGFVKTDMNFKTGVLSVEEGASSPVRLALLPHQETPSGCFFSRKQVSEF

SEQ ID NO: 14190 - protein, 140 aa, Lycopersicon peruvianum
IHGVWPDHTDYIMYDCNPNKEFKKIYDKHLLNKLESRWPQLTSNEYAGLNDQTFWKYEYEKHGLCCEKVYDQSQYFDIAMKLKDSIDLLNILTTNRIVPGFQYSYTGDQISSAIKRVTQKDPNPKCTYSKGGLELKEIGI

SEQ ID NO: 14191 - protein, 126 aa, Arabidopsis thaliana
MTVKKVEIKVDINCGKCNSAIMEAVTEIEGVNHISLDEGNSILTVVGTMDPVCVATRLKKIKQKPVIISVGPPPKPPEPPKPPEPEKPKTPPAPEPPKHVCKPPYCNSCDVVSVTTYESGSGCTIL

SEQ ID NO: 14192 - protein, 421 aa, Shigella flexneri 2a str. 2457T
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 14193 - protein, 376 aa, Desulfitobacterium hafniense DCB-2
MKAIVYEGIRDVKVKNVGDPGIQKPDDIIVKVTSTAICGSDLHLIHGMVPGMPEGFVLGHETMGIVEEVGGDVYNIKKGDRVIVPFPIACGHCWYCEHDLWSQCDNANPEAEVGAYFGYSNTFGGYDGGQAEYLRVPYANVGPKVVPEELTDEQVLFLTDILPTSYWGVEIGGVKKDDTVVVLGCGPVGLLTIKWAIFQGAKRVIAVDHISYRLDHAYRYYGVEVINFEDHDNTGEYIKEITHGGADVVIDCVGMDGKASTLEKIETLLKLQGGSKSAIEIATQAVRKGGTVALVGVYGSKYNLFPLGDFFSRNITLKMGQCPAHSYVEPIMELIKTGRFDATDIITHRLSLDKGEHAYEVFDEKKDNCIKVVLKP

SEQ ID NO: 14194 - protein, 417 aa, Legionella pneumophila str. Paris
MIELKNYTLNFGPQHPAAHGVLRLVLELEGETIVRADPHIGLLHRATEKLAETKPYIQSIGYMDRLDYVSMMCNEHAYVMAIEKLLGIEPPLRAKYIRTMFDEVTRILNHLLWLGATALDIGAMTVFLYCFREREDLFDCYEAVSGARMHATYYRPGGVARDLPDTMPQYKPSRWHNEREIEKKNHNRQGSLLDFLWAFTERFPRCVDEYETLLTDNRIWKQRTVDIGIVSPENALQWGFTGPMLRGSGIAWDLRKKQSYAAYDRVDFDIPVGKTGDCYDRYLVRVEELRQSNRIIRQCIEWLRKHPGPVKVDDYKVTPPRRVVMKHDMEALIHHFKLFTEGFCLPRGEVYSSVEAPKGEFGIYMVSDGANKPYRLKIRAPGFAHLSSFDDMVRGHMLADGVAILASQDIVFGEIDR

SEQ ID NO: 14195 - protein, 143 aa, Triticum aestivum
MKTESPRHLRNPLLVLLFLAAAAAAASAAPVVQIAMAAEPEQAPAAQEAAVHIVYVDRPEDADPEEFHIRTLAPVLGSEEKARGAVLYHYKHAASGFSAKLTTEQVEDLKKQPGVLQVVPSQTYQLHGNEGGHASTTRTMGLM

SEQ ID NO: 14196 - protein, 279 aa, Agrobacterium tumefaciens str. C58
MSAHAKQKRLTTASIRQMKGEARIVCLTAYTTPIARLLDPHCDLLLVGDSLGMVLYGMETTVGVTLDMMIAHGRAVMRGVEHACVIVDLPFGTYQESKEQAFRNAVRLMQETGCDGVKLEGGEEMAETIAFLVARGIPVFGHVGLMPQLVHTAGGFRSLGHSDAETQKIWRDGIAVDQAGAFAIVVEGTVEPLARELTEKLAAPTVGIGASPACDGQVLVSDDMLGLFSDFKPKFVKRYADLGTAATQAAAAYADEVRSGAFPGPEHTFQVRKPSPSGK

SEQ ID NO: 14197 - protein, 249 aa, Legionella pneumophila str. Paris
MRQKIVAGNWKMNGQIQQVTELVSQIEELIGFDCAAQVAVMPPSIYIPKVRDCLKTGKVVVGAQNVYPKDYGAYTGELSAPMLKDFDCRYVLVGHSERRQFFHEDENFVAQKFHHVKDHGMIPILCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 14198 - protein, 481 aa, Rhodococcus sp. RHA1
MDGPTTRVQRALSDMSAGRPVVLTGSSPTSDAHILIPAEKATVESIAFLVRHSSGLVCAAMVGADCDRLGLPNMVGADRDHAGTEFTVSIDAIGPGTGISASDRADTLRLLADSASTPDAFTRPGHVLPARSVPGGVLEFRGPAEAAVDLMSVAGLHRTCAYSALVSELDPTAIADSAEAETFARAHELGHLSIDDVATYRRMAEPHMLTQFTFERDSVHGPVRCVGYRSDVTGSEYLTYSIGPAVAGTTPLVCFQQESDPAPHLCQDGPIGVALAQVAEHGYGAVVVARYAPNNYISADTHGDLAEVVRECGYHSPSLSNFPPESRTMMWHIGLSISAGGSASLARGNAPAPFGFENPSIVGTVVHGDQRGRELGFRTANLELEDSNSVADGVWAGRCTLPDGSTAIAAISIGRRPTFYGRSGVRLLEAHLLDFDGDLYDATLEVSLHQWMRGQVTFASKEELVAALAADVVRTRSLIAG

SEQ ID NO: 14199 - protein, 590 aa, Zymomonas mobilis subsp. mobilis ZM4
MNSSLFSDSLVILGAAGLIIPAFARFRISPVIGFILAGAVLGPKALGSLVTEYPWLKHITISDPDGIEPFADFGIVLMLFSIGIELSFKRLWAMRQAVFGLGTGKLLGCGFLIGAGLYALGENWAGAIGMGLALSVSSTALVLPLVGTTGPVGKNAFAILLFEDLALVPIIFALGAMAPYGQDNRWDGLIATIWQGGATVIAILVLGRFALPTLFAQAARTKSAEVFLSISLLVVILASVATSAMGLSPIVGALTAGLLIAETDYHVEVEMVILPFQRLALGVFLLTVGMSLDLRLIMANWQALALGVAGVVLVKTLVTSTLLRLSHVRLATAVESGLLMSAPSETTLVILATARQAQLIMPSTAAFWEIVTAIGLTITPLLAKIGHKVSLKLTLREHNLTLPSNEEPIEDIENHTIVAGIGRVGKVIADVLTSEKKPYLAIDSDIDLVINAKRDGYHATFGDISNPVFIQQLGNKINAVVLAINDPVSMVNVVHRLHTIYPDLTIIARASDSRHAAQLFRAGATDIVAETLESSLRLAEATLISLGVSTGHAVAAIHDKRASMRENVLKAAEEGNMQAIRHTPSIMPEA

SEQ ID NO: 14200 - protein, 873 aa, Solibacter usitatus Ellin6076
MFMAPLWILKFATLVSACLAAYGILTPLTAPGRRGHLRGRLLFQLLTRMGPASIKIGQILSTQGGLFSAGVIAGLSKLLDDVPPCGRRYVQKTIETDIGKPMSTIFESFDWQAVASASIAQVHRGVLASGQCVAVKVIRRGVPGELKISLGVFGFAVRLAHHLLPSLRQRNLPAHFAKIERLLLLQADLRNEANNQTRIRRNFEGHPFVRVPRPYAEYSGGNVLVMEFMDGLRGLEFAGVELAPPLLACRLQEAFYTMAYLHGVFHADLHPGNIMFTKCGEIILLDFGVVGILDENEKWGLCAFYYAATRGDWKLAVERFTRYFVIGADSIADTTGCGSALEKVLRKHFELQTNKWSTIGFAEEANLVLRDFGARFTTNFSNLVLAFVSGEGFVARVDPDIDIWNNARRFTDRASPYMSQEVRKRFDSSLAPFMPRSVDWRARAARSLVAPTHLDPYMLPSEYPIFVRRAQGCEVEDFDGNTYIDLACGFGPHLLGYGNPVLREALTAAVDVGVNAIGHAAEVELAEELTAAFPGADKVIFANSGTEAVLQALRLTRAFRKRRRIAKFEGHYHGHSDQGVVSSWFRFAGTESEPEPFIDLPGVDQRAVGDMLILQYGDPLSLRRLRTAADELACVICEPMPSTLGCYDREFLLQLRAICSESGVPLIFDEIVTGFRVAFGGIQTLLGIEPDVSCLGKIIGGGLPCAAVVGHREIIDLARGSNDPFIDSESKVFVGGTFSGNAYSCTAGLAILRYLRQRPEIYVRLDDQTRTLVAELKAAADSRHVAVQVSGTRSILTLTFDHQNASHFRGKQTGTNHRANLALSYYMRRHRVHLPELHTMLLNAALEDVHISTIIAAFDQSLAEMVEDGFFLS

SEQ ID NO: 14201 - protein, 251 aa, Neisseria meningitidis serogroup B
MWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 14202 - protein, 324 aa, Candida tropicalis
MSTTPTIPTIKLNSGYEMPLVGFGCWKVTNATAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKLIADKHGKSPAQVLLRWATQRNIAVIPKSNNPERLAQNLSVVDFDLTKDDLDNIAKLDIGLRFNDPWDWDNIPIFV

SEQ ID NO: 14203 - protein, 430 aa, Ralstonia metallidurans CH34
MSRNQQLFDRAQQTIPGGVNSPVRAFRSVGGTPRFITRAEGAYMWDADGQRYIDYIGSWGPMIVGHAHPDVVRAVQETATQSFSFGAPTEAEIDMAEEICKLVPSIEQVRLVSSGTEATMSALRLARGFTGRDLIIKFEGCYHGHADSLLVKAGSGLLTFADTTQNAPSSAGVPADVTRHTMVLEYNNVTQLEEAFARHKGEIAAVIVEPVAGNMNLVRASEAFLTAMRNLCSEHGSVLIFDEVMTGFRVALGGAQAHYGIKPDMTCLGKVIGGGMPAAAFGGRRDIMAKLAPLGGVYQAGTLSGNPLAVAAGLTTLRLIQAPGFYDRLATQTRKLADGLTKAAREAGVPFCADAIGGMFGIYFTNEVPGSFAEVTKADVGRFNRFFHAMLAEGVYLAPSAFEAGFVSAKHDDAIIEATVAAAAKAFKAG

SEQ ID NO: 14204 - protein, 283 aa, Bacteroides thetaiotaomicron VPI-5482
MSEEKWAIITGADGGMGTEITRAVAEAGYHIIMACYRPSKAEPIRQRLVNETGNANMEVMAVDLSSMASTASFADRIVERHLPVSLLMNNAGTMETGLHITDDGFERTVSVNYLGPYLLTRKLLPALTCGARIVNMVSCTYAIGHLDFPDFFRQGRKGSFWRIPVYSNTKLALMLFTIELSERLREKGITVNAADPGIVSTDIITMHQWFDPLTDIFFRPFIRTPKKGASTAVGLLLDEAVAGVSGQLYASSHRKQLSEKYLCHVQQKQLWQETEQALERWLK

SEQ ID NO: 14205 - protein, 258 aa, Triticum aestivum
PYAYLGDLQHRGVQKSSLVPVRNSRDIVDPRVRHSTALAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKALNRLTHHGPQYKPICSFCQLLKLAFGVFPFPQFGPSLTWFPKKILW

SEQ ID NO: 14206 - protein, 79 aa, Triticum aestivum
  misc_feature (61)..(61): Xaa can be any naturally occurring amino acid
  unsure (1)..(79): unsure at all Xaa locations
VRRERISERLKVLQDLVPNGTKVDMVTMLEKAITYVKFLQLQVKVLATDEFWPVQGGKAPXLSQVKTALDAILSSQQQP

SEQ ID NO: 14207 - protein, 138 aa, Lycopersicon peruvianum
IHGVWPDHTSFIMYDCDPLKKYKTIDDTDILTKLDARWPQLTSIKSIGLKSQSFWDYEYRKHGTCCADVFNQSVYFDISMKLTDSIDLLKILRTKRIIPGYTYTGDQISRAIKSVTQNNPNPKCTYIGRSLELKEIGI

SEQ ID NO: 14208 - protein, 214 aa, Lycopersicon peruvianum
MFKTQHTLAFFILLCALSDVYGTFNQLQLVLRWPASFCKGKKCERTPNNFTIHGLWPDIKGTILNNCNPDAKYASVTGGKFVKRNKHWPDLILTEAASLNSQGFWAYQFKKHGTCCSDLFNQEKYFDLALILKDKFDLLTTFRNKGIIPKSTCTINKIQKTIRTVTGVVPNLSCTPTMELLEVGICFNRDASKLIDCDQPKTCDTSGNTEIFFP

SEQ ID NO: 14209 - protein, 107 aa, Zea mays
THRRRGGEEAMGVTKEDVEAAITSALSPSNLVVTDTSGGCGASYEIEVVSEKFEGKRLLERHRMVNTALASHMAEIHAVSIKKALTPAQAQPQPQPQPEPAADKPQA

SEQ ID NO: 14210 - protein, 139 aa, Lycopersicon peruvianum
IHGLWPDNKSIMLNNCDSDVKYNRITNPDMLIQLEYHWPDLTSTVGDTRKLQDFWRYEFNKHGTCSINRYNQVQYFDLALKLKNQLDLLKTLRSHGIIPGKDCTVKDVEDAIKAVSAHVPNLNCIGRSSHTMELQEIGI

SEQ ID NO: 14211 - protein, 476 aa, Idiomarina loihiensis L2TR
MLRRTKIVTTLGPATDSEETLRELIKAGANVVRLNFSHGNGDDHKQRASMVRKIARELNAHIAILGDLQGPKIRVARFQQKQITLAVGDKFILDAALGKDSGNQERVGLDYKDLPTDVSPGDLLLLDDGRIQLKVEEIDGSQVKTEVTVGGVLSNNKGINRQGGGLSAAALTEKDLADIKLAAEINVDYLAVSFPRSGDDINQARHLLREAGGQGVLCAKIERAEAVASEHALDDIIRASDAVMVARGDLGVEIGDAQLVGKQKQIISRARQLNRVVITATQMMESMIENPMPTRAEVMDVANAVLDGTDAVMLSAETAAGKHPVATVKAMAEICLGAETHPTAQLRHQDLEEMFSSITEATAMSAMYAATHLNGVKAIIALTESGFTAKLMSRITSHLPIFALSRHPQSRDKSALYRGVYPIDFDSTSVSNPITEAIEVVKKSGHIKAGDLIILTHGDVMETVGSSNTCKMIEVR

SEQ ID NO: 14212 - protein, 406 aa, Oryza sativa (japonica cultivar-group)
MPSAIAACFRCAPSAAAAASAASGPAGPSLATSVYETHLGLAALSWTRTSLGLSLRAVLRLSSPATAASVGTCFDEDADEETLAFRVRPWLLWRRRGTRRFRAAGDRRVDLAWDLTRARFPGSGSPEPSSGFFVAVVVDGEMVLAAGDLSDAAYRRTRARRPAGPRPVLLSRREHVAMRDAGRGGRGHRSWVTVRGKEREISVDLVSRGRGRDTGSSGSSSREKDRADVGLSVSIDGERVLHVRRLRWKFRGSERVDLGGGDRVQLSWDLHNWLFPQREPPTTDAAAHAHAHAVFVFRFDLGGGGEEASEHAKALCDKAPRRDAAGILRGYFARWGQKDWSETGSERRKRGRGRRLAKASSSSSASVASSTASWASGSTVMDWASPEEAEMQRGDGFSLLIYAWKS

SEQ ID NO: 14213 - protein, 295 aa, Lycopersicon esculentum
MLAIFKNGVVDPPKELQSPASLQASIKAANPEETMKNSAREKMLAIFKNGVVDPPKELQSPASLQASIKAANPEETMKNFLSANQNNGFSIGFMNKAFWHILILQLHTILCQGCFCGMNDIYCIFLGNLSNLCALNKHYGLSKCANEAMLVSEAYRTLRDRGPYPAHQVLKELEGSFGFVIYDHKADTVFVALGGDEKVKLFWGIAFDGSVMISDNVDHIKASCIKSFAPFPSGCMYHSETGLKSYEHPSYKMKAMPRVDSEGSMCGAYFKVDVYSKVNSMPRVGSSANWATWGQ

SEQ ID NO: 14214 - protein, 209 aa, Lycopersicon peruvianum
LTAALFIVLFYLSPAYGDFDSLQLVLTWPASFCNLNNCKRIVPRNFTIHGLWPDKQGTLLQNCKPKLKYVNFKDMMFNDLDKNWIQLKFDEDYGKDEQPLWQYQYLKHGSCCQKMYNQNAYFSLALRLKDRFDILRTLQLHQIFPGSSYTFKEIFDAVKTATQMDPDLKCTKGAPELYEIGICFTPKADALIPCRPSNTCAKTGKIFFR

SEQ ID NO: 14215 - protein, 349 aa, Bacteroides fragilis NCTC 9343
MNNHVVIMAGGIGSRFWPMSTPECPKQFIDILGCGKTLIQLTVERFGNVCPQENMWVVTSEKYIDTIREQLPGIPESNILAEPCPRNTAPCIAYACWKIKKKYPEANIVVTPSDQVVIDTTEFRRVIEKALLFTDKSSAIITLGIKPARPETGYGYIAAGEPITRDKEIFHVEAFKEKPDKETAEKYLAAGNYFWNAGIFVWNVRTITAVMRVYAPGIAQIFDRIYPDFYTEREEESVKKLFPTAESISIDYAVMEKAEEIYVLPAQMGWSDLGTWGALHTLLPKDKEGNATVGPDIRMYESRNCMVHASQEKRVVIQGLNDYIIAEKDNILLICQLSEEQRIKDFSKE

SEQ ID NO: 14216 - protein, 821 aa, Arabidopsis thaliana
  misc_feature (249)..(249): Xaa can be any naturally occurring amino acid
  misc_feature (510)..(510): Xaa can be any naturally occurring amino acid
  unsure (1)..(821): unsure at all Xaa locations
MGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMKGSSVYKKSGPWAKTGFTGVPLMDESYTSPFSLSQDVGNGTGLFSYXLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNVGPTWAFFNNSQDSWKNGLEPQEITGLTFFEMNTIRAATNNFNVSXKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGLSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLAHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 14217 - protein, 220 aa, Lycopersicon peruvianum
MSVLFTLLFSLAPVLGYFEYLQLVLQWPTTFCHTKPCPTWPPPNNFTIHGLWPDSKGKMLNDCGSGDDYDDIPDAHMRKQLESDWPNLTSRAGEIKKYQEFWGYEFNKHGTCSMDRYNQDQYFELALKLKNQFDLLNILRNHGIIPGKTCTVKDVEDAIKAVTAHVPNLNCIVRSSQRSSHIMELLEIGICFDREATQMIDCRRRWKSHPDINQPITLPR

SEQ ID NO: 14218 - protein, 340 aa, Prosthecochloris aestuarii DSM 271
MDSQTLSSVAKAIVAPGKGVLAADESTPTIRKRFDSIQVESTEENRQQYREILFTAQNIERSIGGVILFDETLRQSAKDGTPFPTLLSKRGIVPGIKVDKGAKALALYAGEKITEGLDGLRERLLEYKELGAQFAKWRAVIGIDERDIPSPFGIRANAHALARYAALCQELDIVPIVEPEVLMDGSHDIERCEVVTSQVLEAVFAELDAHHVLFEGMLLKPNMVIAGMQCSRQAGVEEVAEATMRCMTRYVPAAVPGIVFLSGGQSAEKATAHLNAMNATGPYPWEVSFSYGRALQAPVLAAWKGEENNAFAAQHALSKRCRLNGLARDGAYAQEMEQEA

SEQ ID NO: 14219 - protein, 120 aa, Glycine max
  misc_feature (37)..(37): Xaa can be any naturally occurring amino acid
  misc_feature (63)..(63): Xaa can be any naturally occurring amino acid
  misc_feature (97)..(97): Xaa can be any naturally occurring amino acid
  unsure (1)..(120): unsure at all Xaa locations
AISMIFTPAATTVNRAGAGMVAPFTGLKSMDGFPTKXTNNDITSIASNGGRVQCVHVWPSVGXKKSETLYYLPYLDDAQLAKEVEYLLTKGWIPCLXLQWEHGYLYRDHNRSPRYYRWTL

SEQ ID NO: 14220 - protein, 359 aa, Neurospora crassa
MSGRTLPTLTIDEVESHNSAKSCYVTVGRNVYDVTDFLDSHPGGADLVLDWAGKDIGAILKDEASHTHSEAAYEVLDESLVGYLASGNGAAANGTTKDGENGTEQQWVHPRTGMSCEEDLSKDTDYNADYKTHKFLDLNKPLFMQIWNGGFSKEFYLDQVHRPRHYKGGESAPLFGNFLEPLSKTPWWLIPLVWWPPISYGVSVAFQGFGSVAPVAGYFGFGLAFWTLIDYLPDNRVGITAHFLLHGIHHYLPMDRYRLVMPPTLFVVLAAPFWKFAHAILFYNWYAATAAFCGGVFGYTLYDMTHYFLHHQNLPAYYKELKKYHLAHHFLDYENGFGVTSAFWDKIFGTELVYNPKTN

SEQ ID NO: 14221 - protein, 283 aa, Clostridium acetobutylicum ATCC 824
MMIESINWFPGHMAKTTREIRENLKLVDAVIEIRDARIVYSSSNPDINSICKDKPRIILLNKFDLAEKSITDNWVKALSSESIRAIPVNALEGRGLNSIKPALNELLKPKLDNMAAKGIQNYIIRVMVVGIPNVGKSSFINKMAKNKVAKVGNKPGVTKSKQWIKTNIGIELMDTPGVLWPKFQDQKVGLNLAFTGAIKDEIMDIEELALKLVQFLQKNYPEKLMERYKLEDINEDPLINMNNIAAKRGALLKGGEIDYNRVSIIIVDEFRSGKIGKISLERP

SEQ ID NO: 14222 - protein, 474 aa, Arabidopsis thaliana
MSATLTGSGTALGFSCSSKISKRVSSSPASNRCCIKMSVSVDEKKKSFSLQKSEEAFNAAKNLMPGGVNSPVRAFKSVGGQPVLIDSVKGSKMWDIDGNEYIDYVGSWGPAIIGHADDEVLAALAETMKKGTSFGAPCLLENVLAEMVISAVPSIEMVRFVNSGTEACMGVLRLARAFTNKEKFIKFEGCYHGHANAFLVKAGSGVATLGLPDSPGVPKAATSDTLTAPYNDLEAVEKLFAAHKGEISAVILEPVVGNSGFIPPTPEFINGLRQLTKDNGVLLIFDEVMTGFRLAYGGAQEYFGITPDLTTLGKIIGGGLPVGAYGGRRDIMEMVAPAGPMYQAGTLSGNPLAMTAGIHTLKRLKQAGTYEYLDKITKELTNGILEAGKKTGHPMCGGYISGMFGFFFAEGPVYNFADSKKSDTEKFGRFFRGMLEEGVYFAPSQFEAGFTSLAHTPEDIQLTIAAAERVLSRI

SEQ ID NO: 14223 - protein, 346 aa, Lactobacillus sakei subsp. sakei 23K
MKAATFIEPGKMVITEAPKPTIEKKTDAVIRIIRACVCGSDLWWYRGLSKRESGSLVGHEAIGVVESVGEAVTDIKAGDFVIVPFTHGCGHCAACLAGFDGDCTNQEGGGNGGYQGEFLRYTNANWGLVKIPGQPADYSDEMLNNLLTLSDVMATGYHAAVSAEVKPGDTVVVMGDGAVGLCGVIGAKLLGAEQIIAMSRHEDRQKLALEFGATDIVAERGDEAVAKVMALTDNAGANAVLECVGTEQSVATAVAVAGAGAVIGRVGIPQKAEMNTNVLFRKNIGLRGGIAAVTTHDKARLLDAVLKGEINPGKVFTQRFNLDDIQAAYEAMDQRQAIKSLLVISD

SEQ ID NO: 14224 - protein, 375 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSAHYQNGGSIPQQDGASDAIPEANFECAALRITYVGDRKIPRDLIGSSSKIPQVDGPMPDPYDEMLSTPNIYSYQGPNEEFNEARTPAPNEIQTSTPVAVPNDIIEDDEELLNEDDDDDELDDLESGEDMNTQHLVLAQFDKVTRTKSRWKCSLKDGIMHINDKDILFNKATGEFDF

SEQ ID NO: 14225 - protein, 395 aa, Clostridium acetobutylicum ATCC 824
MYFIGGIKMESSKISKGANSIQISGIRKFYNKVIKVQGAISLTLGQPDFPVPDKVKRAMVRAIEDNKTVYTSNAGIDELRNEISKYLKRFNINYSKDEICITAGGTEGILDIFQALLNKGDKVLVPDPSFPAYASCTKLLEGEVITYGLYGSEFSIDFNELENKIKNEKPKFMVLSYPSNPTGTVISKEDNEKLHKIIKDNDIIAVTDEMYSALCYEDDYYSVSQYEDIREKVIVVSGFSKTFSMTGLRIGYVCAESSFMSSILKVHQYTTTCAPSISQYGALEGLKNCDEDVQYMKNEFKKRRDYVYKRLKDMGFEVRLPKGAFYIFPDISRFGMTSEQFCEKLLNEAKVAIVPGSAFGEKGEGFARISYAYSKKELEECMNRIEKWVEVQNNL

SEQ ID NO: 14226 - protein, 561 aa, Bacillus subtilis subsp. subtilis str. 168
MKTEQTPWWKKAVVYQIYPKSFNDTTGNGVGDLNGIIEKLDYLKTLQVDVLWLTPIYDSPQHDNGYDIRDYYSIYPEYGTMEDFERLVSEAHKRDLKVVMDLVVNHTSTEHKWFREAISSIDSPYRDFYIWKKPQENGSVPTNWESKFGGSAWELDEASGQYYLHLFDVTQADLNWENEEVRKHVYDMMHFWFEKGIDGFRLDVINLISKDQRFPNAEEGDGRSFYTDGPRVHEFLHEMNEKVFSHYDSMTVGEMSSTTVDHCIRYTNPDNKELDMTFSFHHLKVDYPNGEKWALAPFDFLKLKEILSDWQTGMHAGGGWNALFWCNHDQPRVVSRYGDDGAYRVKSAKMLATAIHMMQGTPYIYQGEELGMTNPKFTDISSYRDVESLNMYHAFKEKGMADQDITAILQAKSRDNSRTPVQWDATENGGFTTGTPWIPVAGNYREINAEAALRDQNSVFYHYQKLIQIRKMYDIVTEGTYEIIAKDDPNIFAYLRHGSNEKLLVINNFYGTEAAFTLPDSLAPDEWKAEVLLTNDEAREGLQNMTLRPYESIVYRLTKPC

SEQ ID NO: 14227 - protein, 85 aa, Narcissus pseudonarcissus
TQLEELYMSKADITDYGIALLASARHLNLRILSFSGCSKVTPRSLPLFGNIGPTLVGLNLQQCDLIKAHGTAAIEEKMWWCDIIA

SEQ ID NO: 14228 - protein, 255 aa, Gibberella zeae PH-1
MTAFELHLYRGLEPTEPNFIMGHEFTGTVVELGSAVKSVEIGDKIVSPFTASCGLCYYCENGGSARCVNSQPLGSPNLDGAQAEYVRVPFADGTVAKASADIHDQALILMADIFPTGYFGVKSGVEMMPNLDVHDSTIVVIGCGPVGLCAVVAAAALKPKHLFAVDSVSSRLDQAAKLGAEPLNFMSDKTGMHDRIKAATNGRGADIVVEVVGLSPALRTAFDLVRPFGAISSIGVHNAEIPWSGNDAYKWGDAQ

SEQ ID NO: 14229 - protein, 514 aa, Oryza sativa
LSRGYLSKAEGAMAAAAAAASYSSTSWRVRPGLTPFRSPLQPHPQGRLQRIAIFATRIRIATPSAAMQSSSTRHRLEAVNHDHETIPERLAVVTGGNRGIGLEVCRQLALQGVTVILTARDEKRGKDAVESLCHESNLSNIIFHQLDILDGNSRASLARYINSRFGKLDILVNNAGVGGVAVDQDGLRALNIDPRVWLSGKAVNLIQSVIVQTYDEAVKCLNTNYYGLKWITEALLPLLKQSPSGARIVNTTSLRSELKRIPNEKLRDELRNIDIWDEARIEAMLNEFLLDLKNERLEEAGWPTMLPAYSMSKTVVNLYTRILAKRHPEMRINCVHPGFVNTEINWNTGIIPPEEGAREALPYDEQETTNLAVQCAIMSSTQEKRGEQMARAREAAREITPEGTERARVVGEEEAGPEHHRAGILEAAQRGAWSLVSAVGRTLGVVRDTAAQTKPSEYGDAAEAKDTTVEKARETKDASKQQNEELKATDSVAGERGGDAATSGRGQVAGKEED

SEQ ID NO: 14230 - protein, 404 aa, Triticum aestivum
  misc_feature (66)..(66): Xaa can be any naturally occurring amino acid
  misc_feature (371)..(371): Xaa can be any naturally occurring amino acid
  unsure (1)..(404): unsure at all Xaa locations
MASGNVSTVYISVIDDVVAKVREDFITYGVGDAVLNELQALWEMKMLHCGAISGNIDRNRAPPASXGGAPGAGATPPVHDLNVPYEATSEEYATPTADMLFPPTPLQTPIQTPLPGIDTGMYNIPTGPSDYAPSPISDMRNGMGMNGSDPKTGRPSPYMQPPSPWMNQRPLGVDVNVAYEESREDPDRMMQPQPLTKDFLMMSSGKRKRDEYPDQLPSGSFVPQQDGCADQVAEFVGSKDNAQQVWNSIMNKQESVTKTLSIEESTIPPLLPQQDGIQDDYNDQFFFPGVPTEDYNTPGESSEYRTPTPAVATPKPRNDTAGGDDDDDDEPPLNEDDDDDDEIDDLQDGDEEPNTQHLVLAQFDKVTRTKXRWKCTLKDGIMHLNGRDVLLNKASGEFDFWISW

SEQ ID NO: 14231 - protein, 525 aa, Solibacter usitatus Ellin6076
MNILIAEPLAAAGIELFQSQPGWNVIVSSPKEYAQHLATADALLVRSVVQVNQSVLEKGPKLRVIGRAGVGVDNVDLEAATAAGVLVMNTPGGNAISVAEHTLALMLAMARHIPQATASTCGGKWEKKKFMGNELRGKTLGVVGLGSIGREVVKRARAFEMRIVAHDPYVTSAIAHDLGVELVDLAQLFRQSDYLTLHVAATPETQGMLSREAFAQMKDGVRIVNCARGELVDEAALAEALASGKVADASLDVFSVEPPPAGFPLFALNGVLATPHIGGSTEEAQEIVGVRIAEQVVEYLTHGMATNAVNMPPMSPEQFKALSPYATLADRLGNFAAHMATGHPHTVRLHYFGKIADNATSLLRNAGLAGVLSRSTSRKANLINALQIAEQRGWDVVERHDKRSVHTDSIRIDVETDLGVTTVEGAVVLDKPRLLQVDGIYCEAALCGFLIVMKNQDVPGVIGHVGTVLGKNCINIANFSLGRREGTPEAVALVSTDGLVPESVLLQLKEHAAVKFARSVEFHGC

SEQ ID NO: 14232 - protein, 383 aa, Triticum aestivum
  misc_feature (141)..(141): Xaa can be any naturally occurring amino acid
  misc_feature (172)..(172): Xaa can be any naturally occurring amino acid
  misc_feature (293)..(293): Xaa can be any naturally occurring amino acid
  misc_feature (311)..(311): Xaa can be any naturally occurring amino acid
  misc_feature (323)..(323): Xaa can be any naturally occurring amino acid
  misc_feature (331)..(331): Xaa can be any naturally occurring amino acid
  misc_feature (344)..(344): Xaa can be any naturally occurring amino acid
  unsure (1)..(383): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFXAKWRAVLKIGATEPSQLSIDQNAQGLARYAXIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWXLSFSFGRALQQSTLKAWXPGKTENEEKARXAFLVRCKXNPRHLGTYKGDAXLGEGASETPLKDYKLLIYLPSELWPFWAPAYNTCLVSES

SEQ ID NO: 14233 - protein, 684 aa, Oryza sativa (japonica cultivar-group)
MAAMSSAADGLLAMAEEAERRRDLGADARCHGGGAGPSRRPPPTHPPRLKLLAHSLLATAYGVLGAVPSQKNVLRRGLGLLASASASGLLARGPALLGTCNFQTQLASALAVDGDAASALSTLSAGASAAAELGSPQLELFFAATGLHVHLLCWEDNAAVEAAVTRASGLWEALPADQKEQWTGLFFYTELLQTFYLLRTCDYKAASQHVERLDTAAKDEMQKGQRVQELAAELGTVERTLAQPGLKERERSALTHKQRQLKYQLQTLCGYDKLNDVLDYGDKLLLAPPPMHGEWLPRAAVFVLVDLMVVMVSRPKGIFKECGKRIHSGLELIRGELSKLGIVDGVTEANLEHSTIWTAGLYLMLLLQFLENKVAVELTRSEFVEAQEALAQMINWFTRFPTILRGCENTIEMLRGQYAHSVGCFDEAAFHFLEAARLTDSRSMQSMCQVYASVSYICMGDAESTSQALELVGPAYRTMDSFVGVREKTCIIFVYGLLLMRQQNPQEARLRLAGGLRIAHQQLGNIQLVSQYLTILGTLALQLHDCGQAREILKSSLTLAKTLYDIPTQIWILSVFTELYRELKERENEMENSEYERKKEDDLQRRLSEAHSSPFHQELVEKTRIQVQQLHNFSREQQGMPGPTTAKADLDIPESVGLYAAQPSSVKRLIEPSSVRRSSRRRLS

SEQ ID NO: 14234 - protein, 503 aa, Burkholderia vietnamiensis G4
MKHVSERAPAKAGGAQPRDAERDAMFASHEAGYEQKLKPRHVQMIAMGGAIGTGLFLGAGGRLQSAGPALALVYLVCGAFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLALFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGVPYGGILVTVAVNALGVPLNYIVPAQAFEIVLNMASLGIITTWGFIVMCQILFRRAVDRGELSPVSFRMPGAPFTSWLTLGFLVSVLVLMAFDYPGGTWTVAMIPVVVLALVVGWKLAKRGAARDAAAAAAAQAASPIAADPAGSV

SEQ ID NO: 14235 - protein, 167 aa, Candida albicans SC5314
MSSVSSQSEQSRASDPLFQNVEDLYLESYAFTTAAAIVGSVDRKIFVLLKDGRNLFGILRTFDQFANLVLQDTLERIYLGEEGEAPTRFSETYRGVFMVRGENVVMLGEMDIDTEDDHLEKLEQVPFEVAQRELKEQQAKKIREQKVKTKQLLQKGLINDFHITDLY

SEQ ID NO: 14236 - protein, 442 aa, Silicibacter pomeroyi DSS-3
MTIDLAKFAKDKGVKYFMISFTDLFGGQRAKLVPAQAIADMQEDGAGFAGFATWLDMTPAHPDMLAVPDPSSVIQLPWKPEVAWVAGNCVMEGADVAQAPRNVLRRLIAEAAAEGMHVKTGIEAEFFLLTPEGDQISDPFDTAAKPCYDQQAVMRRYDVVREICDYMLELGWGPYQNDHEDANGQFEMNWEFDDALSTADKHSFFKFMTKSVAEKHGFRATFMPKPIEGLTGNGCHAHISVWDAPGAASKVNVFAGAGDGPTGEVGLSERGKHFLGGIMKHASALAAITNPTVNSYKRINAPRTMSGATWAPNTVTWTGNNRTHMVRVPGPGRFELRLPDGAVNPYLLQAVIIAAGLSGIHSKADPGKRWDIDMYAEGHKVRGAPKLPLNMLDAIREFDRDKELKKSMGDEFSASYIKMKMQEWNSFVTHFSRWEKENTLDI

SEQ ID NO: 14237 - protein, 130 aa, Vibrio vulnificus YJ016
MEAILNKNMKILIVDDFSTMRRIVKNLLRDLGFNNTQEADDGLTALPMLKKGDFDFVVTDWNMPGMQGIDLLKNIRADAELKHLPVLMITAEAKREQIIEAAQAGVNGYIVKPFTAATLKEKLDKIFERL

SEQ ID NO: 14238 - protein, 158 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKTTKSPKKTTKA

SEQ ID NO: 14239 - protein, 264 aa, Moorella thermoacetica ATCC 39073
MDVKIGFLGAGAMAEALIRGIIQARLVQPERLWAYDIRAARLKELEQRFGLVAAASREELAAAADIIILAVKPQNVEAALTGLQVKGDKLVISIIAGVTLSRLAGYLGDVPLVRVVPNTPALVGAGVSALAAGARVGQEDLEKALAIFRSVGEAMVLPEEQLNAVTGLSGSGPAYVYMIIEALADGGVRQGLARPVALELAARTLLGGAQMVLATGEHPGVLKDRVTSPAGTTIAGLAVLEDRGVRGALIRAVEAATLRAGELE

SEQ ID NO: 14240 - protein, 342 aa, Brassica napus
  misc_feature (93)..(93): Xaa can be any naturally occurring amino acid
  misc_feature (117)..(117): Xaa can be any naturally occurring amino acid
  misc_feature (200)..(200): Xaa can be any naturally occurring amino acid
  unsure (1)..(342): unsure at all Xaa locations
MAGGKIKIGINGFGRIGRLVARVVLQRDDVELVAVNDPFITTEYMTYMFKYDSVHGQWKHHELKVKDEKTLLFGEKPVTVFGIRNPEDIPWGXELELDFVVESTGVFTDKDKAAAHXLKGGAKKVVISAPSKDAPMFVVGVNEHDYKSDLDIVSNASCTTNCLAPLAKVINDRFGIVEGLMTTVHSITATHKTADGPSMXDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDSRSSIFDAKAGIALSDNFVKLVSWYANEWGSSTRVVDLIVPMSNRWL

SEQ ID NO: 14241 - protein, 336 aa, Phaeodactylum tricornutum
MSINVGINGFGRIGRLVMRAAQKNPNIKIVAVNDPFIPVEYMEYMYKYDTVHGRADSVVKANKEAGTITVGENEIKVFGEMDPSKIQWGSAGADYVVESTGVFTTTEKASAHMVGGAKKVVISAPSGDAPMFVMGVNQEKYESSMDVVSNASCTTNCLAPLAKVVNDEFGLKEGLMTTVHAVTATQQTVDGPSQKDWRGGRAACYNIIPSSTGAAKAVGKVIPALNGKLTGMSFRVPTANVSVVDLTCRLDKGAPYATICAAIKAASEGPMKGILGYTDEDVVSSDFISDTHSSIFDQKAGIALTDDFVKLVSWYDNEAGYSTRVLDLIAHMESQK

SEQ ID NO: 14242 - protein, 320 aa, Triticum aestivum
FRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVVLAEKLGRLAVQLVAGGGGIKSVKVTYASARAPDDLDTRLLRAMITKGVIEPISDVFVNLVNADFTAKQRGIRVSEEKIVMDGSPETPLEYIQVQIANVESKFPSAICDSGLVTVEGRVKDGIPHLTKVGAFEVDVSMEGSLILCRQVDQPGMIGSVGSVLGEENVNVSFMSVGRIAPRKTAVMAIGVDEEPSKATLTKIGEIPAIEEFVFLKL

SEQ ID NO: 14243 - protein, 391 aa, Streptococcus agalactiae A909
MTLEKRFNKYLDRIEVSLIRQFDQSISDIPGMVKLTLGEPDFTTPDHVKEAAKSAIDANQSYYTGMSGLLALRQAAADFAKDKYNLTYNPDSEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFTAQIIKSHQYMVTAASTISQFAGVEALSVGKNDTLPMRQEYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 14244 - protein, 969 aa, Prochlorococcus marinus str. MIT 9312
MKSTVNSDLFINRHLGLSDVDEQKMLSKIGFNNIDQFINQVIPEDIQLNDKSSEILPQGCSEIEALNELEEIANKNTKMRSLIGLGYYDNHMPKVIQKHVLENPRWYTSYTPYQAEIAQGRLEALFNFQTIVCELTGFPIANASLLDEGTAAAEAMAMSFAARKNKSSKLYLVESNVFDHTFNVLQTRAKPLGISLKRFNQSNLPNHDDVFGILLQLPGKNGELFDPTFLISQAHRSEIIVTGCIDPLAQVLIKPISEFGVDVAVGSMQRFGVPLGFGGPHAAFFACSEKYKRLIPGRIVGQTLSKNGEKSLRLALQTREQHIRREKATSNICTAQSLLAIISSFYAIYHGPTGLTQIAKRLVQLRINLESCLADLGFDIPDGIRFDSVDVYSEHSQKIHNEALNNGYNLRILPLGSTIENSTGFGISLDEMSNEKEIEDILTFIANVIEKKEDLDNIKFDQGFQLESLALRSTEWMQQDIFTTYQSETELMRYIFRLAEKDFSLVDGMMPLGSCTMKLNSAAELNPVSWANLSSIHPFSPPNQTKGYSKIISDLEKWISDIVGLKSVSFQPNAGSQGEFAGLLAINSYFVSKGELSRKKCLIPKSAHGTNPASAVMAGFDVLTVECDEEGNIDFQDLSIKVTKFDTQIGALMLTYPSTHGVFELQIRKICDLIHSIGGFVYLDGANLNAQVGLCKPGNYGVDICHLNLHKTFCIPHGGGGPGVGPVAASETLSPFLPTHSLKDNNLSNSSNYVSSAKHGSASILPISWMYIKMAGLCGLRKATSHAILSANYIAHTLKHKFKILYKGKNNFVAHECILDFRDLKSKTGLSVNDLAKRLIDYSFHAPTISWPVPETIMIEPTESESLAELDRFCEAMLLIGEEISEIENNIELNNNNVISNAPHTLKELIADTWNYPYSKEKASFPYGTQTAIKFWSAVSRINNAYGDRNLICSCNVNQEETLDEKKCA

SEQ ID NO: 14245 - protein, 486 aa, Symbiobacterium thermophilum IAM 14863
MALVPLLFEKSTPGKRAVTFPAPDVPTVELSEAIPADLIRQTPAALPELSEVEVVRHFTQLSRLNHGVDVDFYPLGSCTMKYNPKVNEEAARIPGFALTHPLQPEETVQGNLQLLHTLEGWLCEVTGMDRMTFQPAAGAHGELTGILLIRAYHESRGDTERNEVIVPDSAHGTNPATAAMAGYRVVPVKSRPDGSIDVDALRQIVGPKTAALMMTNPSTLGLFDPHVREITEIVHQAGGLCYYDGANLNAIMGYARPGDMGFDVVHLNLHKTFSTPHGGGGPGSGPVGVKSHLVPFLPVPVVEKQGDRYALDWDRPQSIGKIHGFWGNFGVIVRAYAYVLAHGPALKEVSEHAVLNANYVLARLKPYYEPYVDRYCMHECVLSARTLKQETGVRTLDVAKRLLDEGVHPPTIYFPLIVEEALMIEPTETEDKATLDRFIEAMIRIHDEARSNPEYVKSAPHKTPVGRLDEALAARRPNLRYRANPS

SEQ ID NO: 14246 - protein, 458 aa, Symbiobacterium thermophilum IAM 14863
MRYVPITQADKAAMLREIGVSSTEELFAANIPAEVRLNRPLNLPPALTEMELLAHLRELAAQNAHTGEYACFLGGGAYDHYVPAAVDAVIRRGEFLTAYTPYQPEISQGVLQAIYEYQSLMCELTGMDLSNASMYDGASALAEAAGMVVNQTGRSKLLVARSVSPLYRRVVQTYMHGIGVELIEVPLDGVTLDLNRLEALMTEEVGGLLLQTPNYLGYLEKVREIEALVHAKNGLFVVAVDPISLGLLEAPGSYGADIVVAEGQGLGVPLSYGGPYLGVLATRDRFARRMPGRIAGATVDNRGQRGFVLTMQAREQHIRREKATSNICTNQALIALAATVYLALVGKEGLREVANLSLQKAHYAAQQIARLPGWRLAGDAPFFKEFTVLAPAAAAEVSRRLVDRKILGGLDVGADYPELLGGAAGSAGGPAAALSFAVTEKRTRAEIDRLVAALGEVK

SEQ ID NO: 14247 - protein, 273 aa, Parvularcula bermudensis HTCC2503
MSAQKKTKRQTAASITARKGGEPIVGLTAYDAPTAALLDPHCDLILVGDSVGMVVHGLPSTVGVTMEMMILHGQAVMRGAAQSLVVVDMPFGSYESDPRQAFANASRLLIETGAGAVKIEAGTYTAEIISFLTERGIPVMGHVGLRPQSSNVTGGFKAVGRSDEEWRQVLAEAEAADRAGAFALVVEGVDELLARNITESVEAPTIGIGASSACDGQILVTPDMLGLFDWTPKFVRKFGNLRSDITSAVEAYAEAVRDRRFPGDEEVYRLRRN

SEQ ID NO: 14248 - protein, 268 aa, Oryza sativa
MAVAAVARGDMSADRTECADQLVGLAPCLQYVQGEAKAPAPDCCGGLRQVLGKSPKCLCVLVKDKDDPNLGIKINATLALALPSACGATHANVSHCPQLLHIPPNSKDAAIFSPGGDKGSPAAPDHVVLQITDHDPYYIVEFTAVTNLPIETKNTGLDGARSISGRLYWTMPATFMLPRKRSKDIEKKEGVRGFGELNSKPHLMDTQVKLAVVVKVMGRTGSRGQVTQVRVKFLDDQNRLIMRNVKGPVREGDILTLLESEREARRLR

SEQ ID NO: 14249 - protein, 336 aa, Odontella sinensis
MSINIGINGFGRIGRLVMRAAKGRSDINVVAVNDPFIPVNYMEYMYKYDTVHGKCGQEVSHDAEANTLTIDGKDVKVFGEMDPSKIQWGSAGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDEDIVSSDFIGDTHSSIFDEKAGIALTDDFVKLVSWYDNECGYSNRVLDLIKHIESDS

SEQ ID NO: 14250 - protein, 371 aa, Oceanobacter sp. RED65
MSLNSIEEIIQDISDGKMVILMDDEDRENEGDIIVAAEKVTPEIINFMASKARGLICLTLTPERCDFLGLPSMVSGNGSKFSTPFTVSIEAAEGVTTGISAADRAVTVRAAVNPMGKPDDIVQPGHIFPLRAQAAGVLSRAGHTEAGCDLARLAGLQPSSCIVEIMNEDGTMARRPELEEFAKEHDIKIGTIADLIQYRMANEQTIEKISSDTLQTVYGDFLLHVYRDTINQDTHLAITKGDVEACEAPLIRVQAAETLRDLLGAVMPNSHSWSMANSLQAIGDSDAGALVMLNAGEKEDVATAIETFYGRQKPQRTTDVDSSGAYVTIGTGSQILRDLGVSKMRLLSSPMKFAGISGFNLEVVEYIPCEK

SEQ ID NO: 14251 - protein, 665 aa, Phaeodactylum tricornutum
MGRDRRLITISRFFSSGMDSRQHDGTRLQPARHQAFPLKFSKFLSTSPLSQGDKKVSLIVGIGTNCATTKAFTIMNLSLLALTFALGHAFVPPSFLASPSSRKVLSSSRSASVAANAADVLAKTTSSSSTPSSLMPKETTVAAVPKVAQRWRKSTKQVVTLGPASSNKEMIEKLFLAGADVFRLNFSHGSQEQKKELLIMIREVEEKYSHPIGILGDLQGPKLRVGEFSKPEGEFLELGQSFRLDLDNAKGDNKRVQLPHPEIIKASELGHALLVDDGKVKLVVTAKGDDYLECRVDVAGMIKDRKGVNTPDSVLEISPLTPKDRSDLEYMLGIGVDWVALSFVQTPADMVEIHALIDEKLPSGQFKPAVMAKIEKPSCFYDDNLQRIVGLCNGIMVARGDLGVECPPEDVPLLQKEIIDECRNQGRPVIVATQMLESMIEVPTPTRAEASDVATAIYDGADAIMLSAESAAGKFPEESVAMQQRIINRVEGDKHYRSYLKQNEPDPENTPTDAIITAARQVAKTIGAKSIVCFSLRGSTVLRASKSRPGVPILALCPFKETSRQLALSWGVYSDLPKAGSYGYTVSEEDMFNYDRPMVEKSTDDFDLVLKNACRAALKKGLVSDPDDLLVVTAGLPFGTPGAANIIRVVPAAGPSCWDGVCRVD

SEQ ID NO: 14252 - protein, 475 aa, Escherichia coli
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 14253 - protein, 513 aa, Phaeodactylum tricornutum
MTASQTKITASGPELRGANITLDTIMKKTDVSTRQTKIVCTLGPACWEVEQLESLIDAGLSIARFNFSHGDHEGHKACLDRLRQAADHKKKHVAVMLDTKGPEIRSGFFADGAKKISLVKGETIVLTSDYSFKGDKHKLACSYPVLAKSVTPGQQILVADGSLVLTVLSCDEAAGEVSCRVENNAGIGERKNMNLPGVIVDLPTLTDKDIDDIQNWGIVNDIDFIAASFVRKASDVHKIREVLGEKGKGIKIICKIENQEGMDNYDEILEATDAIMVARGDLGMEIPPEKVFLAQKMMIRQANIAGKPVVTATQMLESMITNPRPTRAECSDVANAVLDGTDCVMLSGETANGEYPTAAVTIMSETCCEAEGAQNTNMLYQAVRNSTLSQYGILSTSESIASSAAKTAIDVGAKAIIVCSESGMTATQVAKFRPGRPIHVLTHDVRVARQCSGYLRGASVEVISSMDQMDPAIDAYIERCKANGKAVAGDAFVVVTGTVAQRGATNLMRVMYA

SEQ ID NO: 14254 - protein, 543 aa, Phaeodactylum tricornutum
MSLSQSSDVPILAGGFITLDTVKHPTNTINRRTKIVCTIGPACWNVDQLEILIESGMNVARFNFSHGDHAGHGAVLERVRQAAQNKGRNIAILLDTKGPEIRTGFFANGASKIELVKGETIVLTSDYKFKGDQHKLACSYPALAQSVTQGQQILVADGSLVLTVLQTDEAAGEVSCRIDNNASMGERKNMNLPGVKVDLPTFTEKDVDDIVNFGIKHKVDFIAASFVRKQSDVANLRQLLAENGGQQIKICCKIENQEGLENYDAILQATDSIMVARGDLGMEIPPAKVFLAQKMMIREANIAGKPVITATQMLESMINNPRPTRAECSDVANAVLDGTDCVMLSGETANGPYFEEAVKVMARTCCEAENSRNYNSLYSAVRSSVMAKYGSVPPEESLASSAVKTAIDVNARLILVLSESGMTAGYVSKFRPGRAIVCLTPSDAVARQTGGILKGVHSYVVDNLDNTEELIAETGVEAVKAGIASVGDLMVVVSGTLYGIGKNNQVRVSVIEAPEGTVKETPAAMKRLVSFVYAADEIPGNAD

SEQ ID NO: 14255 - protein, 539 aa, Phaeodactylum tricornutum
MGTYPAGVCYAVVYLNGRYRSYLVLTITGARLDHSLLPTMFQGPACWSEEGLGQLMDAGMNVARFNFSHGDHEGHGKVLERLRKVAKEKKRNIAVLLDTKGPEIRTGFFADGIDKINLSKGDTIVLTTDYDFKGDSKRLACSYPTLAKSVTQGQAILIADGSLVLTVLSIDTANNEVQCRVENNASIGERKNMNLPGVVVDLPTFTERDVNDIVNFGIKNKVDFIAASFVRKGSDVTNLRKLLADNGGPQIKIICKIENQEGLENYGDILEHTDAIMVARGDLGMEIPSSKVFLAQKYMIREANVAGKPVVTATQMLESMVTNPRPTRAECSDVANAVYDGTDAVMLSGETANGPHFEKAVLVMARTCCEAESSRNYNLLFQSVRNSIVIARGGLSTGESMASSAVKSALDIEAKLIVVMSETGKMGNYVAKFRPGLSVLCMTPNETAARQASGLLLGMHTVVVDSLEKSEELVEELNYELVQSNFLKPGDKMVVIAGRMAGMKEQLRIVTLDEGKSYGHIVSGTSFFFERTRLLDFND

SEQ ID NO: 14256 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNAKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPLQAYQKSPRGR

SEQ ID NO: 14257 - protein, 357 aa, Glycine max
CFEVVEKTGNDLHCKCIDAGLFLPGAKLSFWRDGKLVRGNNKLPTLSTKDWADIDFGIAEGVDFFALSFVNHADSVKDLKNYLSSKSTKSIKVLAKIESSESLHKLEEIVRASDGIMVARGDLGVEIPLEQIPTVQEDIIYVCRQLNKPVIVASQLLESMVEYPTPTRAEVADVSEAVRQYADALMLSGESAIGSYAQKALAVLDMASSRMESWSREENRQNLVNYHQLGASLPECITEQICNCAVEMANNLGVDAIFVYTKYGHMASLLSRNRPNPPIFAFTNDDSTRMALTLQWGVVPLLVDLSDDAESNISKSVQLMKSRGLISQGDVVLVVSDVAPTRATPMAFQSIQVKTII

SEQ ID NO: 14258 - protein, 720 aa, Aspergillus nidulans FGSC A4
MVGPSLLQLPWVALAYARPKHRQDPNWTYRQAFTNSLLKAFLRNWVALHLKWRLSLKPRSESDRFIQIPPANPALYTGIVIDEKIRPETIGATWYPAPYPSPDSSQTALPEGQHVVLHLHGGSYILGDGRTSSCNFLATTLLEHTPSSYILCPQYRLAGNRNGNFPAQLQDTIASYAYLIHTIGIPASQIIISGDSAGADLALALLRYTIEFDNLSILPAPKCCWLWSPWCDVPPAVDPGRWNHSANYRTDYIPGSFPARGAKLFLKNVDVTKYVERYVSPVLHPFAVPSPVLIITGDREVLFEDHKKLSQGLKELAHKDEQIELFVTRGVPHDVLMIAWIMGFQKEARESAIKAGEFLHSSFFSTRYRHLSLHCNLFLPFWGFNITIMGLFQPKVMPLPHGIDLTGKTAVVTGATAGLGLETARQILRLNVSTLVLAVRNTEKAQSCVADLFRDADIQARLTRPDIHVLECNMEQYSSVKSFSAKLKESIPRVDILILNAGIHSFVYEKTSDGHEKALQVNYLSNVLLLAELLPFLESTAEQTGSAVRITWLGSRTYYLSNSLEKSDILTYGGGILQYMDSEKASASAGMNQYSDRKLLCALFVYELASRLNRDKVTLNLVCPGMVKTDLGSNGPLWIRTLIEIVKILRARPVEVGGWLVLNAAVVAGKESHGSLIGDKEVTEPTKFIKSSAGQELQKRLWKETVEEMATLTELLSAFV

SEQ ID NO: 14259 - protein, 509 aa, Salinibacter ruber DSM 13855
MPFQRRLSPNTRPPLALFVAVDSVMPDPTADSSSEANEEVLTGNVLKIVLLSLSAALGGFLFGFDSGVINGTVEAIQSDFGAGEVVTGFNVASMLLGSAVGAFFAGNLADKVGRRPTLILTALAFMVSAWGSGAAGGSVPFVAARLIGGLAVGAASILAPAYISEIAPSSIRGSLATLQQLMIVVGLFVAFLNNYLIAQAAGSAANAFWMGFDAWQWMYWMELIPASVFFLSLLAIPESPRYLVAANREEEAASVLDSLGTATNVKEKLADIRSTLNDERRPRLTDVIQEHTGRIHPLLWAGIGLAALQQLTGINVVFYYGGTLWQAAGFTEASALLTNVVNGSVNVVFTFVAIALIDRVGRRPLLLVGSIGQALMLGVMAYVFATAAQGGAGGIEMQGNQGVVALVAANAYIAFFAFSWGPVMWVMLGEMFPNRFRGAALSICGLVQWLSNFLVTWTFPILLGSIGLGISYGIYAAFGVVAFVFVKLFIDETKGRSLEDMSREADAAA

SEQ ID NO: 14260 - protein, 503 aa, Arabidopsis thaliana
MMSEKFPDVFTWIQNIPQITKWRTTSLPFCICPSTSDFPNSTLNLTAQKSPSPKVVTFSIIVQSNNHSPLYLWTTKQELSINPNSPNPFDELTIISLLFNFVETILTYTSNSSNYSTIKIPNSDSSKIGGLKDIVNTVILTLSFVVCVYEAPLYLRENCLNTLKNHLITCHTRRATISLMKLLGSNLEEQWMRTVNLAFTNWIIEQRRSQSTKITTTPLFSYAVSAYGLWKVQLYCPVEAMEVERSSNPTADSRLLFSLKFNQLEGVMQFNHKVVVRDNWIDVIVKIDNIRYDVIKLVNEKLMSRRGAGEHEKHFPSRISLQLTPTLQTDFISVSVSKSSNNPGREFEVERSIEGSFDPPNSLGLRVAGREASTMTMTPWKLEQSVLGYTANLNWILYDSSVGGREVFSTKPSRFSIMSPRSWFKDRYARAYRSFTRRGGVIFAGDEYGESVVWKIGKGALGGTMEWEIKGFIWLTYWPNKYKTFYHETRRLEFTQLLNLTIA

SEQ ID NO: 14261 - protein, 466 aa, Bacillus subtilis subsp. subtilis str. 168
MNQQKKQAPVELKVGQTFPLTIKRLGINGEGVGYFKKKVVFVPGALPGEEVVVQATKVQPKFSEGRIKKIRKASEHRVAPPCPVYEQCGGCQLQHLAYSQQLREKRDIVIQSLERHTKFKVENMEIKETIGMDNPWNYRNKSQFQIGRSQSGSIIAGLYGLDSHDIVPIKDCIVQHPATNKTTGIVRRILEDFNVSVYNERKRKGDVRTIVTRVGFETGEVQVVLVTAKETLPHKEEIVKAIQKRLPEVKSIIQNVNGAKTSVIFGEKTKQLAGKTVIQEVLGDVSFELSARAFFQLNPEQTVKLYDEVKKAAQLTGKEKVVDAYCGVGTIGMWVADGAKEVRGMDVIKESIDDAKKNAKKHGMANATYVTGTAEHWLPKWTKEGFRPDVVIVDPPRTGCDSTFLDTIKKVKPKRFVYVSCNPSTLAKDLQTLSKDYRVDYIQPVDMFPQTAHVEAVARLVLKSSN

SEQ ID NO: 14262 - protein, 278 aa, Silicibacter pomeroyi DSS-3
MTGEGHIVDMSDIARRGLVLLGCGKMGSAMLAGWLDGGLPAGSVWVIDPYPSDWVKAQGVHVNAELPGDPAIALIAVKPQMMGDALPQMQALGNGTTLFVSVAAGTSIATYEQILGADTPIVRAMPNTPAAIGRGITALIGNARASAADLDLAEALLKAVGQTVRLEREEQMDAVTGVSGSGPAYVFHLIETLAAAGTAQGLPADLAMQLAKATVAGAGALAEAAEEDPAQLRVNVTSPNGTTQAALEVLMEPETGFPGLLNRAVAAATNRSRELSRG

SEQ ID NO: 14263 - protein, 152 aa, Triticum aestivum
  misc_feature (66)..(66): Xaa can be any naturally occurring amino acid
  misc_feature (77)..(77): Xaa can be any naturally occurring amino acid
  unsure (1)..(152): unsure at all Xaa locations
MSAYCGKYKDELIQNAAYIGTPGKGILAADESTGTIGKRFASINVENVEDNRRALRELLFCTPGCXSKYLSGVILFXKETLYQEHQGWQAFVDILKAGNSSPDQGGQGYIDSLGQRETHQGLMTGKRCAKYTSWCRSQVGESGASIVSSTKR

SEQ ID NO: 14264 - protein, 478 aa, Ralstonia eutropha JMP134
MTRSTKIVATIGPASSSLEVLTRMIAAGVDVVRLNFSHGTAQDHIDRATLVREAAQACGREVAIMADLQGPKIRVGKFESGKVTLKPGDPFVLDSSCQLGNQERVGLDYQDLPRDVGPGDLLLLNDGLIVLVVDRVLGTEIFTTVRIGGDLSNNKGINRQGGGLSAPALTAKDMDDIKTAMALGADYVAVSFPKNATDMEMARQLAAVAGQPYGRKARMIAKIERAEAINPGVLEEILQASDGIMVARGDLAVEVGNAAVPALQKRMIKLAREANKLTITATQMMESMIVNPVPTRAEVSDVANAVLDGTDAVMLSAETAAGRYPVETVEAMAAVCIEAEKSEVVQLDTDFLNQTFSRIDQSVAMGALFTAYHLQVKAIAALTDSGATALWMSRHRIHVPIYAMTPNVASQRKMQLYRNVVPLPLDASTDRDTALEQAEELLLAQGVVQRGDFIVLTIGEPMGQPGGTNTLKIVRVGS

SEQ ID NO: 14265 - protein, 276 aa, Carboxydothermus hydrogenoformans Z-2901
MDRVTVSSLKEMKEAGQKIAMITAYDYPSALFAEEAGAEVLLVGDSLGMVVLGYDSTVPVTMEEMLHHVKAVVRGSKRSMVVADMPFMSYQASYTDALYNAGRFLKEGGAQAVKLEGGGEIAELVAKLVTAGIPVMGHIGLTPQSVNALGGYKVQGKDLKTAQKLLDDAKALADAGAFAIVLECVPAALAAKITESIPIPTIGIGSGVNCDGQVLVYHDVLGMYPRMLPKFVKRYADLSSLIKEAIRQYVQEVKEQQFPEEKHSFTMAPEILERIY

SEQ ID NO: 14266 - protein, 141 aa, Burkholderia xenovorans LB400
MAIERTLSIIKPDAVAKNVIGQIYTRFENAGLKIVASRMVHLSRADAEKFYAVHAARPFFKDLVDFMISGPVVVQALEGENAILKHRDLMGATDPKKAEKGTIRADFADSIDANAVHGSDAPETAAVEIAFFFPQVNVYSR

SEQ ID NO: 14267 - protein, 162 aa, Triticum aestivum
  misc_feature (58)..(58): Xaa can be any naturally occurring amino acid
  misc_feature (78)..(78): Xaa can be any naturally occurring amino acid
  misc_feature (81)..(81): Xaa can be any naturally occurring amino acid
  misc_feature (94)..(94): Xaa can be any naturally occurring amino acid
  misc_feature (100)..(101): Xaa can be any naturally occurring amino acid
  misc_feature (124)..(124): Xaa can be any naturally occurring amino acid
  misc_feature (136)..(137): Xaa can be any naturally occurring amino acid
  misc_feature (141)..(141): Xaa can be any naturally occurring amino acid
  unsure (1)..(162): unsure at all Xaa locations
MAPTVMASSATSVAPFQGLKSTAGLPISRRSSSAGLSSVSNGGRIRCMQVWPIEGIKXFETLSYLPPLSTGGLLKQVXDYXIRSKWVPCLRFSXVGFVLXXEHNTPPGYYDVHTGKCWELPMFXGCTDAHKCQQVXXVKKXYLTLFPLIFTAPSACLRLHRF

SEQ ID NO: 14268 - protein, 200 aa, Magnetospirillum magnetotacticum MS-1
MLASTAAQADQCGPVRGRTGNFDYYLLSLSWSPSYCATTSGKQNPRQCGAEQRYGMVVHGLWPQHSDGTWPQCCQPVSAVKSSAATSQASKVMIGSSLLQHEWSKHGSCVTDQQDLYFGKINSAVSSLGLAPNLPGSRLERIKVSDLKRNWAVPADAITVHCKGKRLSEVHICLDKALAPIACPAAEVKNDNCPGTVRLD

SEQ ID NO: 14269 - protein, 1370 aa, Frankia sp. EAN1pec
MTTKVALDRVRTVCAYCGVGCGIVLEVDRSGDSPRVVRSTGDPDHPANRGRLCTKGATTAELLNAPGRLTTALARAGHDEEPAPIDVDTALDLAAARLAALRDEHGPDAIGIYTSGQLSIEAQYLITKLAKGFLRTQYQECNSRLCMASAASGYKLSLGADAPPGSYDDFDHADVFLVIGANMADCHPILFLRMMDRVKAGAKLIVVDPRRTATADKADLFLQLRPGTDIALLNGLLHLLHASGAVDESFVAAHTEGWAAMPDLLAGYDPATVADITGVPEDDLRAAAALIAAAGSWMSCWTMGLNQSTHGTWNTNALINLHLATGAICRTGSGPFSLTGQPNAMGGREMGYMGPGLPGQRSLLDPADRAHIEQLWGLPADTIRADHGNGTIGMFEQMSAGAIKAAWIICTNPVATVANRRTVIEGLETAEFVLVHEAFTETETTGYADVVLPAAVWAETDGVMVNSERNLTLTRPAADPPGQARADWQLIAGIATRLGYADHFTYNSAQEVFDELRQAWNPVTGWDLRGITHGRLRDGPMQWPAPPGAGARNPIRYMTDDGPRFPTPSGRAKFWPRPHVDPQEIPDEKYPYLLNTGRLQHQWHTLTKTGRVGRLNKLNPAPFIEIHPDDAAALGISEGDQVEVSSRRGRAVLPAAVTDRVQPGNCFAPFHWNDMFGEYLAVNATTSDAVDPVSLQPGFKASAVALTRVHTPTPAQPPPTLVDDVLHADAVASAAPIASLLGLGGTAAPPALNDDESVYLAGFVAGLGLDLARGALTSVPTLPPSAPVTARTALWVNGALAGLWSRLPAEGREILPGRGVSPREDPPGTGGRRVLLGWASQTGNAERVAEQAEARLTESGTVVTTLPLNEIDHIAPHTDLVVVTSTFGDGESPDNGSEFLARLRARSMPLDDVRFSVIALGDSSYSDFCGHGRRIDELLAELGGLRLADRVDCEPDFDEAARAWLDRVLAARAGASPTRPEPVPVPVPPVSRLPGASSGPRVSETHRVILAGNRLLSGVGSAKEVREFLIDLEDSDLTYETGDVLVVRPSNRAELVDEWLSTTGLRGDTIVELLQFGRTELAVALRDHLEIAKPSRAFLAFVAERSGSRHLQRLLRGDRADLDGWLWGRQTVDVITETGTHASAQEWCELLKPLRERRYSISSSAEVSPRQIRTLVSVVRYNAPSGAARTGVASAFLADAPAGTPLKVAVARSSGFAPPSDPETPTIMIGPGTGLAPFLAFLDTRRARGHTGRNWLFFGEQRRATDFYYSDELAEFARSGLLTRLDTAFSRDQRAKIYVQDRMRERGAPLWQWLREGAAVYVCGDAARMARDVDTALRDVVAKHGDLNAAQAGDYVRQLITDGRYLRDVY

SEQ ID NO: 14270 - protein, 533 aa, Zea mays
  misc_feature (156)..(156): Xaa can be any naturally occurring amino acid
  unsure (1)..(533): unsure at all Xaa locations
MASGGNPNPTGAPTQPRPMHQQQQQPQTGGSPATPMTHLRPPSLAGSPFQGLFHTPPTHNPAFQIHMGASSSPQTPLMAATAGSAKRPPQKPPVRPLAPGSTSSAAAASAAAAYKAAAAAAAVANSGGVDLTPAARRSKKRKLPEKQLPDRVAALXPESALYTQLLEFEARVDAALARKKVDIQEALKTPPSLQRTLRIYVFNTFANQGPRTIPPPKNADPPTWSLKIIGRVLEDGAELDPASVVPKHNPVYPKFSQFFKRVTIALDPSLYPENPLIIWENARAAAQQEGFEVKRKGDKEFVANIRLEMNYSPEKFKLSQPLMEVLGVEVDTRARVIAALWQYIKAKKLQNPNDPSFFMCDPQLKKVFGEDKLKFAMLSQKISQHLSAPPPINLEHKIKLSGNGAHSSACYDVLVDVPFPLQKEMMAFLANTEKHKDIEACDEVISASIKKIHEHRRRRAFFLGFSQSPVEFINALIASQSKDLKLVAGEANRNIEKERRADFYNQPWVEDAVIRYLNRKPANEGPGGGAGGS

SEQ ID NO: 14271 - protein, 517 aa, Achlya bisexualis
MLARSLRSRAVRSFARGLSNKPSKNDAFSMTKIVGTVGPVSENAKTTQELTNAGLKIMRINFSHATYDEAHLRMSHLRASKGVHAKHTGKEFNVRAVLLDTQGPEIRGGAFPEKKINLTKGDMITLTTDVQYKEASTKDMLYVTYEQLPATVKVGDTVLLDDGLISLTVKSIDVASGQVRCLIENSEVLGSRKGVNLPGLVVDLPALTAKDKQDVEFGVEHDMDFIAVSFVRKPEDVNDVKDFVNSVMPKYWPAGHPAPLIISKIENYEGVSNFDRILEVSDGIMVARGDLGVEIPMQEVLTCQKDMVSKCNAAGKPVIVATQMLESMIRNPRPTRAEILDVGNAVLDGADAVMLSGEVAQGKWPVESVKTMMSVIKEADAYVKREQYKKEALSQKEAVACAVATTAKSLHAAMIVVMTASGEVARLVSKHKPSVPVMCYTTSQKVGRQLQIHRGLYPIVAPTPCKMNLQEAISTAKKLGWLHNGDQVVMLSSETPTGVVGQQYIMRVATVGEDIAH

SEQ ID NO: 14272 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 14273 - protein, 506 aa, Achlya bisexualis
MAGAINLHKQGVELEAIMGDNEGQTRRSKIFCTIGPACWSVEKLTELIDAGMNVARFNFSHGDHKTHSEVLNRLRTAIASRPHRHVAIMLDTKGPEIRTGFLATEDKKVHIEKDSIIEFTTDYEFLGDETKLACSYEDLPTSVKVGGPILVADGSLVLEVTEILETGVKARALNSATLGERKNMNLPGAKVTLPTLTERDEDDLINWGLVQGVDFIAASFVRCGQDIDNIRAVLGPRGRAIKIIAKIENQEGLENFDDILEKTDGIMVARGDLGMEIAPEKVFLAQKMMIRKANIAGKPVVTATQMLESMIHNPRPTRAECTDVANAVLDGSDAVMLSGETANGDYPVEAVRMMHKTCLQAEGAIHYDELYQALRNSVLETNGKMSTQEAIASSAVKTAIDMGAKMIVVLTETGTTARLIAKYRPACPILVLTALGETARQCEGFLKGSYCRVMGSMIGTDSILYRATDLGKQFGWIKKGDAVVAIHGMMEARSGSTNMLKVLVCD

SEQ ID NO: 14274 - protein, 399 aa, Desulfovibrio vulgaris subsp. vulgaris str. Hildenborough
MSDVFRVSRRVQQIRISATKLMPMLAARVGGCVSLGQGVPSFRTPEHIVEAVCRALRDKADAGRYTLQPGMPALREAIAADLAARKGYMVNPDSEVGVTVGAMEALLMALLTVVDRGDEVIIPSPGYASHAEQVLMAEGVPVHVPLRADDWGLDVDAIRAAVTPRTRAVIVCNPGNPTGTVYDDADVRALCELALERNIMLISDETYDYMVYGGGEPLSPASLPEMRRHVIVVNSFSKKYALTGWRVGYCAADAAWMGELLKVHDAAAICAPAVSQYAALAALTGPQDCVDDMRAALSARRNLACARLDAMAPHFDYVQPRGAFYIMARYTFTDAPSDMVARRLLEEGRVITVPGASFGPTGERHLRLSFGMEEAELDEAFDRMAAWTQRVVASGGLGG

SEQ ID NO: 14275 - protein, 962 aa, Idiomarina baltica OS145
MTSTTLTQLEHHDEFIGRHIGPSHDEQQAMLKELGVDTLEALTKDTVPGSILRDPFLKVGEPKTEREALAELKAIAKKNQIFTSYIGMGYYDTVTPNVILRNVLENPGWYTAYTPYQPEIAQGRLEALLNFQQMTMDLTGLDLASASLLDEATAAAEAMAMAKRVSKNKKSNAFYIADNVYTQTIDVVKTRAEYFGFDIIVGPAREASDHDVFGALLQYPDKTGELHNIEQLIGELQEKKAIVSVASDLMSLLMLKSPGEMGADIVFGNAQRFGVPMGYGGPHAAFFATRDKFKRSLPGRIIGVSKDSRGRPALRMAMQTREQHIRREKANSNICTAQVLLANMASFYAVYHGPQGLRRIANRIHRLTDIVALGMQDKGVQISNAHWFDTLTFEMKENATDVLARAKAAGINLRNDGEAVFGISMDEAKTRADVEVLFNVLFGDDHGLDVEVLDSRVASKEVESIPAQLVRESDYLTHPVFNEYHSETEMLRYIKKLENKDLALNHSMISLGSCTMKLNATAEMIPVTWPEFAQLHPFCPVEQAQGYAEMISSLSEWLVDITGYDALSMQPNSGAQGEYAGLLAIQKYHESRGEGHRNICLIPSSAHGTNPASAQMMNMKVVVVDCDKNGNVDMADLKAKAEEAGDHLSCIMVTYPSTHGVYEEGIREICELVHEFGGQVYMDGANMNAQVGVTSPGYIGSDVSHLNLHKTFCIPHGGGGPGMGPIGVKEHLKPFLPNHSIINLKTTELGNGAVSAAPYGSASILPISWMYIAMMGGRGLREASETAILNANYVAEKLSKHFKILYRGRNNRVAHECIIDLRQMKEDAGIAEIDVAKRLQDYGFHSPTMSFPVAGTIMVEPTESESKAELDRFIEALVCIKQEADKIAAGEWPQDNNPLVNAPHTLADITDAEWDRPYDRHTATYPVEAVSYDKFWPTVNRIDDVYGDRNLMCSCPSIEEYR

SEQ ID NO: 14276 - protein, 404 aa, Medicago truncatula
MLLRPIYKQVAENQNAEIFSANTLLVILGTSLLTARAGLSMALGAFLAGLLLAETEFSLQVESDIAPYRGLLLGLFFMTVGMSIDPKLFVSNFPVVTGTLALLICGKTLLVSLMGRIFGISVISALRAGLLLAPGGEFAFVAFGEAVNQGIMSSQLSSLLFLVVGISMAITPWLAAGGQLIASRFEQNDVRSLLPVESETDDLQDHIIICGFGRVGQIIAQLLSERLIPFVALDVRSERVAVGRALDLPVYFGDAGSREVLHKIGAERACAAAITLDTPGANYRTVWALSKYFPNVKTFVRAHDVDHGVNLEKAGATAVVPETLEPSLQLAAAVLAQAKLPASEISATINEFRCRHLAELSELCEASGSSLGYGFTRIMSKTKSQSPDALDLDDAQVSEGTLAV

SEQ ID NO: 14277 - protein, 350 aa, Aspergillus nidulans FGSC A4
MQAVVFKGPLKVALEQRPIPTIQDPTDAIVKVRYTALCGSELHVFRGHQPSGTDFIMGHEFTGEIASVGSSVSKFKPGDKVVSPFTVSCGDCFYCSHNTSSRCAKCQLYGSVVLDGAQADYVRVPLADSTLVSAPEKIDEKKLVMMADILPTGFFAAKNAFSGLDESIIKESTVILFGCGPVGIFALISALEYKPKHLIAIDSVPSRLELAKSLGAEPWNFATDSEGLKNRVKELTDGRGADVAIEVVGHSDALRMAFDMIRPWGKISSVGVHNGEIPWTGNEAYGKNLQLQMGRCPVRSIFEDALKLLEKKQDSIEFMVQDIRPLSQALQAYDDFNQMRSQKVIFEAGK

SEQ ID NO: 14278 - protein, 440 aa, Listeria monocytogenes str. 1/2a F6854
MSYLTEKLREEKVFKDPVHGYVHVSDKIVWDLIATKEFQRLRRIHQLGTTSLTFHGAEHSRFNHSLGVYEIVRQIIDVTFANEPQLNSEERMVALCAALLHDLGHGPFSHAFEKVFGTDHEAYTQEIIIGDTEVSEVLMRAGEEFPLKVAAIIKKNYPNQTLVKLISSQIDADRMDYLLRDAYYTGVSYGKFDLERILRVLRPSPDGNGVIVKYSGMHAVEDYIMSRYQMYQQVYFHPVSRSGEVLLWKILERAKKLYCAGYEFQVTPVQVLPFFLNEVSLKDYIVLDDIVLMYYFSIWQEEEDPILSDLCSRFLNRRLLRYINYDPKEDAELYAELKGLLEKADIDPSYYLVIDSSSDLPYDYYLPGVGSGKDPIKLLMGNGELRELSTESPVVEAIGRERRTDIKLYYPLDFIESGDVDQAITERMIALIHAHSLKEK

SEQ ID NO: 14279 - protein, 436 aa, Rubrivivax gelatinosus PM1
MADSRNASLFERARRSIPGGVNSPVRAFRAVGGTPRFIARADGAYLWDADGKRYIDYIGSWGPMILGHGHPAVLEAVQKAATEGFSFGAPTEREVELAEEILKLVPSAEQVRLVSSGTEAAMSALRLARGATGRSKIVKFEGCYHGHADALLVKAGSGLATFGHPTSAGVPTEVVQHTLVLTYNDVTGLEAAFSAHGAEIACVMIEPIAGNMNFVRAGLPFMKRLRELCTQHGALLVFDEVMTGFRVALGGAQSLYAKAIPGFKPDLSVFGKVIGGGMPLAAFAGPRAIMEQLAPLGPVYQAGTLSGNPVATACGLATLREIQKPGFFESLAAGTRDLLDGLLHAATAAGVPMVGDCEGGMFGFFFPKTAQAALPQNYVEVMATDGERFNRYFHGMLDRGVYLAPALYEAGFVSAAHTPADIEATLAAARATLAAA

SEQ ID NO: 14280 - protein, 457 aa, Legionella pneumophila str. Paris
MLNPREVRTIEDAKRIVEERQLTHVKVGLFDIDGVMLGKYMRRNKFFSALEHGFAFCDVILGWDSKDKLYDNVKYTGWHTGYPDASVRIIPSTCREILFEENQLLFMAEFSQAAEAICPRGILRRVINKSAGMGYDVYAALEYEFFVFDETPDSVRAKGFRNLKPITPDNFGYSIIRNTVHAEFYHQILTMAEKMDFPIEGLHTETGPGVLEAAIAVDDAEAAGDKAALFKTFMKILAQRNNKMATFMAKWSGDYPGQSGHIHLSLRDRDGGKSAFYESGREYNMSKIQRHFLAGQQKLMPEFLAMLSPTVNSYSRLIPGYWAPTEATWGVENRTTALRVIPGSDKSQRIEYRLGSADANPYLALAAAIGSGLYGIENELEPEAEVKGNSYEQDHSPELALPRTLWESAQNLKNSSAAYELFGQEFVEHFAASREWEEREFRKHITDWELDRYFEII

SEQ ID NO: 14281 - protein, 389 aa, Nocardia farcinica IFM 10152
MRALCWNGVNDLAVETVEDPRLVNPHDVIVRVRLTTTCGSDLHFIDGYLPGMRAGDVFGHEFMGEIVEVGREVRDRKVGDRVVVPSFIGCGTCFYCTRDMYSLCDTTNPNAELQQPVFGYPTGGIYGYTHPFGGYQGSHAEYVRVPFGDVNSFVVPEGITDEQALFVSDAVPTGLMGADFCDIAPGDTVAVWGSGGVGLMAGHTARLLGAGRVVVIDRIPERLALARKHFDAETIDYTAVDSVQEALREMTGGRGPDACIDAVGMEGHGTGLQQIYDRAKQLLRLETDRATPLREAILACRKGGVVAVLGIYGLTDKFPMGVVTNKGLTIRTAQQHGQRYVPRMFDHILQGDLDPSYLVTHDLSLEDGPRGYEVFKNKDEGCVRAVFRP

SEQ ID NO: 14282 - protein, 142 aa, Salinibacter ruber DSM 13855
MATERTLAILKPDCVRKEKVGEVLRRIQDAGFQLCAMKMITMSKAEAEGFYAVHEDKPFFDDLTDFMSSGPCVPVVLEKENAIADFRELIGATDPDEAAEGTIRSDFAGSIQENIVHGSDSPSNGQKEAGYFFPEHEIVANT

SEQ ID NO: 14283 - protein, 323 aa, Oryza sativa (japonica cultivar-group)
MAAAAAAAEAKHRKEEEEDEEEMTLEDGDIEESPRRSFDDDYEDGGSGDDDRDDDGEGLGSPRSFQSRQWPQSYRETTDTYTIAASPSFGYLGPSTSKYSILDGGRSSLGSDLKLPLLSDKLDGKQDSVKSLRKTLGSAIDRKSSLLTQHTGEVYIAQGCSVTQTVFNGVNVLAGVGLLSTPFTIHEAGWVGLAVLAMFAIVCCYTGVLMKHCFESKDGISTYPDIGEAAFGRIGRLLISIILYTELYSYCVEFIILEGDNMTSIFSHIGFDWLGVHIDGKHFFGVLTALIVLPTVWLRDLRVLSYLSGLNTLNLKYFSHCDH

SEQ ID NO: 14284 - protein, 461 aa, Glycine max
MSMSLSLLRIFSSPHLSTSLFFPTPTLSSLCPSFLSKLPNAPSPLIVLCHRDASASKQGHLGVPESAERDSGSEEDDDAVEQPMRASYDDDEDEEEGALSSLVFPERWDVLGLGQAMVDFSGMVDDNFLKNLGLEKGTRKVVNHEERGRVLQAMDGCSYKAAAGGSLSNTLVALARLGSRSEKVPAINVAMTGSVGSDLLGGFYREKLRRANVQFLSAPIKDGTTGTVIVLTTPDAQRTMLAYQGTSSTVNYDASLANAVSKTNILVVEGYLFELPDTIKTITKACEKARSNGALVAITASDVSCIERHFDDFWEIIGNCVDLVFANGNEARALCNFEAKESAASAARYLSHFVPLVSVTDGPTGSYIGVKGEAVYIPPSPCVPVDTCGAGDAYASGILYGLLRGISDLRSIGSLAAKVAATVVGQQGTRLRISDAVKLAESFEFQLDSSSVGTDHNISSV

SEQ ID NO: 14285 - protein, 227 aa, Chlamydophila caviae
MAFLILLRHGKSVWNEKNLFTGWVDIPLSQQGIDEAIHAGQVIKDLPIDCIFTSSLVRSLMTALLAMTHHSSKKIPYIIHDDEQQKLMSRIYSDEEKSMIPLYRSSALNERMYGELQGKNKKETAEEFGEEQVKLWRRSYKISPPGGESLYDTGLRTVPYFQETIFPLLKNSKNVFISAHGNSLRSLIMDIEKLSEEEVLSLELPTGKPIVYLWTGHTFERHPEPLG

SEQ ID NO: 14286 - protein, 2505 aa, Oryza sativa
MVSSSSPVVNVYPLANYTFGTKEPKMEKDTSVADRFARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMWASGSPPTSPVSGVRRGACRRAPRKPLPPIAAHVPPFPAPTSTAIAMGKPKQQVLSRFFSPKPRPSAPATADDPPPPPRPPAEPPVAAVVSFSPAKRARALSVSPKTTAKRAKPSPPPSDYVRRRLLEPPRPPPPAAVNPSGKAYTPLEQQVVDLKARHPDVLLMVEVGYRFRFFGEDAAVAASVLGIIAHPDHSFLTASIPTFRLGFHVRRLVAAGHKVGVVRQTETAAIKAAHGGGAAGTPFARGLSAVYTRATIEAAAGELEGGGAPDEGSRYLVCVVDKEVDAMGTEGFEVKIGVVAIEVSTGEVVHGEFMDGVSRNGLEAVLLGLAPVEVILGTPISSATEKLMVAYAGPTSNVRVERTSRLCFSEGGALAELLSLFEKSGVDAPTVENGRHLMEMNEENNNPRGIEVPLSSSELTVIAPYDWVSICSLGIMAMPELVIHALALSVRYLKGFGMDRIICFGSSFQPFTANTEMSLSANTLQQLELTHPLCDRNQICTRHDAVSEISESIGSQQYSTNNLQDEVDMSCSSSVRSDLSTILSSVLRMLAGTLDIQRGITRIFHCKATAKEGTSNDTPFGLIILVVLDKDEFVGVVQAILTAGKQLQKLVLEDTDTMSSQHRTVHSPLLRRLINTASSCTVLANAATLVSCLNKDAADQGDMLNLFIASVDQFPEVAEGHATVEMAKQKLELLITEYRKQLGLPVDRKVPSSWMKVNSTKKTIRYHTPEVSKNLENLLLAKEKLAVICRTTWNNFLMDFGRYYAQFQATVKSLATLDCLYSLATLAKQNKYVRPNFVRENEASQIHIKDGRHPVLESLLGVNFVPNDTELHANSEYCQIVTGPNMGGKSCYIRQVALITLMAQVGSFVPASSATLHAVDGIYTRMGASDSIQHGTSTFYEELSEASNILHNCSSRSLVIIDELGRGTSTHDGVAIAYATLHYLLKEKKCMVIFVTHYPKILNILREFEGSVGAYHVSYLATRKLLEVADRQMVINNTETKDLGEITFLYKLVAGASDRSFGLNVALLAQLPSSCIERASVMAAKLQQELSEREKNKFCRLMDVPRESSPKELCAQPYQGLAEACHRILFNVTSAQSNDELTDTLSSLREAREIALKAIKGWGRVGMDLSRFTAPRPGLQIGAAGNGFRACSLRRLRYRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLTVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEITTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLEDISAYHFLPAAFCGKAKLNEEVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTIFFLVQHRGFYYLLWNDDKSLILPVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 14287 - protein, 103 aa, Erwinia amylovora
  misc_feature (83)..(83): Xaa can be any naturally occurring amino acid
  unsure (1)..(103): unsure at all Xaa locations
MKKTKIVCTIGPKTESEEMLTNLLDAGMNVMRLNFSHGDYQEHGKRISNLRNVMNKSGHQAAILLDTKGPEIRTMKLEGGQDXSLKAGQTFTFTTDQSVIGNA

SEQ ID NO: 14288 - protein, 809 aa, Corynebacterium glutamicum ATCC 13032
MGFIFRHFPLNSSAMTENQPLPADLVGSHVRAAAGTPADLATDRKFWTGLSRAVQERIADDWERTREAYGAARQQHYFSAEFLMGRALLNNLTNLGLVDEAAAATRELGHEITDILEIENDAALGNGGLGRLAACFLDSAVTQDYPVTGYGLLYRFGLFRQSFNEGFQVEKPDPWREEEYPFTIRRASNQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQGHLAHHKDLSNFAEFHSVQLNDTHPVLAIPELMRLLMDEHDMGWEESWAIVSKTFAYTNHTVLTEALEQWDQQIFQQLFWRVWEIITEIDRRFRLERAADGLDEETIDRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 14289 - protein, 378 aa, Oryza sativa (japonica cultivar-group)
MATAVASQVAVSAPAGSDRGLRSSGIQGSNNISFSNKSWVGTTLAWESKATRPRHANKVLCMSVQQASESKVAVKPLDLESANEPPLNTYKPKEPYTATIVSVERIVGPKAPGETCHIVIDHGGNVPYWEGQSYGIIPPGENPKKPGAPHNVRLYSIASTRYGDSFDGRTTSLCVRRAVYYDPETGKEDPSKNGVCSNFLCNSKPGDKVKVTGPSGKIMLLPEEDPNATHIMIATGTGVAPFRGYLRRMFMEDVPKYRFGGLAWLFLGVANTDSLLYDEEFTSYLKQYPDNFRYDKALSREQKNKNAGKMYVQDKIEEYSDEIFKLLDGGAHIYFCGLKGMMPGIQDTLKKVAEQRGESWEQKLSQLKKNKQWHVEVY

SEQ ID NO: 14290 - protein, 139 aa, Candida albicans
MRFTPILRQIPKLKLSEVLVKAGDGVPTGLAGIYKHPNPRPALVTLYNETLKTLKENFPADSVYRQSTEALTQNRLKIVESEEIVENIENQIGGGLIEEIVIQAADELSLASQLGGLKVWEELEEKPLDDQWVYFGKKI

SEQ ID NO: 14291 - protein, 512 aa, Geobacter metallireducens GS-15
MTRPLMLMILDGWGINPSAEHNAVAQARTPNLDTLLATYPTTEIQTSGMAVGLPDGQMGNSEVGHLNIGAGRVVYQDLTRITKAIQDGDFFTNPVLLECIAKTKAAGGRLHLAGLLSDGGVHSHNTHLYALLELARRQGLTDVFIHAILDGRDTPPKSGADYLAQLEAEIARIGVGAIATVMGRYWAMDRDNRWERVERAYNAMVQGEGVQRASSAEAIEASYAADVTDEFVEPSVMVRDGAPVGQLRDGDGFIFLNFRSDRAREITRALALPDCEGFARQARPNLASYVCMTEYDATFGLPIAFGPEELKNILGDVLAHAGIRQLRIAETEKYAHVTFFFNGGVEEPFPLEERCLIPSPKDVATYDQKPEMSAYPVTDELLKRIDSDAYDVVIVNFANADMVGHTGILEAAARAVEAVDSCVGRIVAKVREKGGAVIITADHGNAEKMVDETGGPHTAHTSEPVHLVLVDDSRKGIRLRAGTLADIAPTMLEILGLSQPAEITGKSLIAQS

SEQ ID NO: 14292 - protein, 390 aa, Moorella thermoacetica ATCC 39073
MQEARRIRELPPYLFARIEKKIAEARERGVDIISLGIGDPDMPTPSHVIDKLVAEAHNPENHRYPTSEGLLAFRQAVADWYQRLYGVDLDPRREVVTLIGSKEGIAHISLCYVDPGDINLVPDPGYPVYNIGTLLAGGESYFMPLTAANGFLPDLGAIPSDVARRAKLMFINYPNNPTGAVADLKFFQEVVEFARSYDLIVCHDAAYSEITYDGYRAPSFLQAPGAKEVGIEFNSVSKPYNMTGWRLGWACGRADVIEALARIKSNIDSGAFQAVQYAGIAALTGPQEGLAEVRRVYQERRDIIVEGFNSLGWHLEKPKATFYVWAPVPRGYTSASFAEMVLEKAGVIITPGNGYGNYGEGYFRIALTISKERMQEAIERLRRVLGKVEF

SEQ ID NO: 14293 - protein, 127 aa, Triticum aestivum
  misc_feature (58)..(58): Xaa can be any naturally occurring amino acid
  misc_feature (75)..(75): Xaa can be any naturally occurring amino acid
  misc_feature (82)..(82): Xaa can be any naturally occurring amino acid
  misc_feature (86)..(86): Xaa can be any naturally occurring amino acid
  misc_feature (92)..(93): Xaa can be any naturally occurring amino acid
  misc_feature (96)..(96): Xaa can be any naturally occurring amino acid
  misc_feature (105)..(105): Xaa can be any naturally occurring amino acid
  misc_feature (114)..(114): Xaa can be any naturally occurring amino acid
  unsure (1)..(127): unsure at all Xaa locations
MAPTVMASSATSVAPFQGLKSTAGLPVSRRSNGASLGSVSNGGRIRCMQVWPIEGIKXFETLSYLPPLSTEASLXVDYLIPXKLVXFLQLTXXGSXSLEHNASPXYYDGRYWAXWNFLFSGCTDAPY

SEQ ID NO: 14294 - protein, 92 aa, Arabidopsis thaliana
MAFFMLSSDPVDTWADQATMVAPFTGLKSSAAFPVTRKTNMDMTSIVSNWGRVSCMNVWPPIVKKNVETLYYLPDRRDGELANEVDYSFLNK

SEQ ID NO: 14295 - protein, 444 aa, Carboxydothermus hydrogenoformans Z-2901
MKYTPHTPDEVREMLSSLGLSSIEELFSDIPEEVKLKRPLNLPSGMSELEVKKHLANLAAKNGSADKYTVFLGAGVYDHYVPAVVNHILLRSEFYTAYTPYQAEMSQGVLQSIFEYQTMICELTGLDITNASMYDGGSALAEAALMAVSQTRRDKVLVLATVHPEYRSVVKTYTWGPEIEVVEVPYKSGTVDLEKLEELIDDKTAAVLVQHPNFFGQLEPVEEISRLIHAQKGLLVVAVDPISLGILKPPAEYGADIAVGDGQALGNGLAFGGPHLGFFAARKDLARRMPGRLVGLTTDKEGNRGFVLTLQAREQHIRREKATSNICSNQALNALAATVYLATVGKKGLKEIALQSLQKAHYAFERLIGEGYEPLFSGPFFKEFVVKVKNEEEITQKLLKHHILAGPGISRFYPELAPALMIAVTEKRTREEIDNLVEVLGGDR

SEQ ID NO: 14296 - protein, 208 aa, Saccharomyces cerevisiae
MFTPIDQAIEHFKQNKFVIVMDDAGRENEGDLICAAENVSTEQMAFLVRHSSGYVCAPMTNAIADKLDLPLLRTGMKFESNDDDRHGTAYTITVDVAQGTTTGISAHDRSMTCRALADSSSTPKSFLKPGHICPLRAADGGVLQRRGHTEAGVDLCKLSGLSPVAVIGELVNDDEQGTMMRLNDCQAFGKKHGIPLISIEELAQYLKK

SEQ ID NO: 14297 - protein, 368 aa, Mesorhizobium sp. BNC1
MLRTETYMPYDQKHVVEALRAFERGEIVVVMDDDGRENEGDLIVSAVHCTPEKMAFIVRHTSGIVCAPMPREEARRLNLAPMVAENDAPHQTAFTVSVDFRHGTTTGISAEDRTLTVRNLANPNVGAQDFVRPGHIFPLVAREGGVLMRSGHTEAAVDLCRLAGLPPVGVICELVNDDGTVMRGPQVTAFAEKHGLKQVSVADLIAYRQRKETLVERVASFPVSTAAGQATAYAYTLPWEVMQHLAIVFGDIRDGQDVPVRLHTENVVQDVFGMERRLQQIMERMGSRGVLVYLRAGSVGVAHQQRRLAGGEDHEEAVRRENEWREIGLGAQILKDLGITSIRLLASRERHYVGLEGFGIEIASTEIL

SEQ ID NO: 14298 - protein, 792 aa, Arabidopsis thaliana
MGKKRIVLLLFISFSYAEITKESPLSIGQTLSSSNGVYELGFFSFNNSQNQYVGIWFKGIIPRVVVWVANREKPVTDSAANLVISSSGSLLLINGKHDVVWSTGEISASKGSHAELSDYGNLMVKDNVTGRTLWESFEHLGNTLLPLSTMMYNLVTGEKRGLSSWKSYTDPSPGDFWVQITPQVPSQGFVMRGSTPYYRTGPWAKTRYTGIPQMDESYTSPFSLHQDVNGSGYFSYFERDYKLSRIMLTSEGSMKVLRYNGLDWKSSYEGPANSCDIYGVCGPFGFCVISDPPKCKCFKGFVPKSIEEWKRGNWTSGCARRTELHCQGNSTGKDANVFHTVPNIKPPDFYEYANSVDAEGCYQSCLHNCSCLAFAYIPGIGCLMWSKDLMDTMQFSAGGEILSIRLAHSELDVHKRKMTIVASTVSLTLFVILGFATFGFWRNRVKHHDAWRNDLQSQDVPGLEFFEMNTIQTATSNFSLSNKLGHGGFGSVYKGKLQDGREIAVKRLSSSSEQGKQEFMNEIVLISKLQHRNLVRVLGCCVEGKEKLLIYEFMKNKSLDTFVFGSRKRLELDWPKRFDIIQGIVRGLLYLHRDSRLRVIHRDLKVSNILLDEKMNPKISDFGLARLFQGSQYQDKTRRVVGTLGYMSPEYAWTGVFSEKSDIYSFGVLLLEIISGEKISRFSYGEEGKALLAYVWECWCETRGVNLLDQALDDSSHPAEVGRCVQIGLLCVQHQPADRPNTLELLSMLTTTSDLPLPKQPTFAVHTRNDEPPSNDLMITVNEMTESVILGR

SEQ ID NO: 14299 - protein, 252 aa, Bacteroides fragilis NCTC 9343
MKIRILGSGTSTGVPEIGCTCAVCTSKDPRDCRLRTSALVYTDDATILLDCGPDFREQMLRVPFGKIDAVLISHEHYDHVGGLDDLRPFCRFGEVPIYAETYTAERLRSRMPYCFVEHSYPGVPNIPLREIEPNRPFLVNHTEVLPLRVMHGKLPILGYRIGKLGYITDMLTMPDESFEQLQGIEVLVMNALRIAPHNTHQSLSEALEAVKRIGAKETWLIHMSHHIGLQADVEKQLPPHVHFAFDGLELEC

SEQ ID NO: 14300 - protein, 519 aa, Aspergillus nidulans FGSC A4
MSLASTLPRASFETLLQHTNFMDGIKFVFFAFVVYSCFTIAVGWVVYEWKRKAHGCGKIPRYPHRDPFFGFDIVFGMAKSLRNDYFLVWLNKVHENLPKTFLVNFVGTRFIYTIEPENMKSMSAINWQDFAVGPMRRNNKATAPFADKGVNTVDGHEWEFSRFLIKPFFKRETFTDTSRLTLHVDRVLEQLPADGETVNIQPLIQRWFLDVTTASLFGESIESLVYPERAPICWAMVDVLRGLRLRLQWYKYLWLFRHQAWLDAVEVVHRYLNAHIDRTYKELDEYKRQGKNPEAADRNDLLWYMASNLQDKEALRSQICLIFVPNNDTTSIFISHILWNLARHPGIYEKCRQEVLALGDAELSFSVLRNMKYLNAVLNETHRLFPNGVTQVRKCIRDTTLPVGGGPDGKQPIFVRKGDVVQVNKNVIHRDHDIWGPDAEDFRPERWENLRPYWNFVPFGGGPRRCPAQMLVTAEASYFLARLMRVYKRIEARDPNPYVGVMRVGPSNKTGVHIALFKE

SEQ ID NO: 14301 - protein, 222 aa, Idiomarina baltica OS145
MSASDKLKQQAAQAAIKYVEKGAIVGVGTGSTVNFFIDELAKIKDDIEGAVSSSDASTERLKQHGIEVFELNNAPEVPVYIDGADEIDEHGQMIKGGGAALTREKIVAAVAKKFVCIADESKLVGRLGTFPLPVEVIPMARSYVAREIVKLGGDPVWRQGVTTDNGNWILDVHNFDILNAVELEEQLNNVVGVVTNGLFAARSADVALLATSEGVKELTWGN

SEQ ID NO: 14302 - protein, 409 aa, Idiomarina baltica OS145
MAVTSLAKDKIKVLLLEGVHDSAIELLKQQGYDQLEILKGSLDEDELCEKIKDVHMIGIRSRTQLTEKVFAAAEKLIAVGCFCIGTNQVDLKAAQKHGVVVFNAPFSNTRSVAELVLAETIMLLRGIPQKNAQAHKGGWLKSANHAYEVRGKILGIVGYGHIGSQLSVLAEQLGMQVIYYDVETKLPMGNARSSKRLDDLLAKADVVTLHVPETPSTRWMIGSAQLAKMKPNSLLINASRGTVVDIEALAEALTSGHLAGAAIDVFPVEPQSNQDLFESPLCGIENCLLTPHIGGSTVEAQENIGIEVAGKLVHYSDNGSTLSAVNFPEVSLPQHATARRLLHIHKNQPGMMNAINSILSDFEINVAGQYLQTDENVGYVVMDIDTDNGTELLDKMKAIPGTIRARQLF

SEQ ID NO: 14303 - protein, 333 aa, Chlorobium tepidum TLS
MNPVTATILQRLAGDGGFVSGGDLCNELQISRSAVWKHIVALRKAGYAIEATSGKGYRLESLTGSPVAEEVAPLLATESFGRNFIYLESIDSTNLRARASAREGAVEGTVVVADSQTEGRGRMRRAWVSPAGVNLYCSIVLRPPVPSIRVPEIPLVAAAAIHEAVTQECPGLAAFIKWPNDIITGGRKLCGILCEMESEPDCTHFVVVGFGLNVNLDPVPEELRKIATSIAIETGLRMSRARLLAAVLNRFEQLYRDWLEKENLAFILPYLEAHSWLKGRELKIEQFNTVLTGTEAGLSPQGHLLLRTVDGALLSVTSGEAHLLPVNHEPRSA

SEQ ID NO: 14304 - protein, 360 aa, Thermoanaerobacter tengcongensis MB4
MSEKSTIPFGPQHPVLPEPIHLKLIVEDEKVVEAYPAFGYVHRGLELLVKKRDFNQMVYVVDHICGICSAIHGETYCQAVEKLIGIDVPERAKFLRVIWAEIHRIHSHLLWFGLLADAFGFENLFMLSWRIREKVMDILEATAGNRVVISVNIVGGVRRDIDSEQAKWVLAQLKEVEEGLKEIEKIVRDNYTLKKRTVGIGVLSKEEAYMLGAVGPTLRGSGVPIDTRTLGYAAYKYLDFEPVVEKDGDTYARTLVRLREMFQSIDLVRQAISKMPEGEINVKVKPNLPAGEVIERAEQPRGEVFYYIKSNGGKYLDRLRIRTPTFANLAALLHMLPGCTLADVPVLVLTIDPCISCTER

SEQ ID NO: 14305 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNTKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPFQAYQKSPRGR

SEQ ID NO: 14306 - protein, 1098 aa, Kluyveromyces lactis NRRL Y-1140
MPTKRQLESDVDDLEQLKRLADESEDVQPRKRRFHDVQPMTQYPTQNGESQANNQDMLQRAGFIKEIKLTNFMCHSNFSLRLGPRLNFIVGNNGSGKSAILTAITIGLGAKATTTNRGTSLKDLIKQGCNTSKIVIVLCNEGLNSFEPGVYGKEIRIERTIRREGYSGSFSIRSEANKEVSDKKRDLEVILDYFSIPVTNPMCFLSQDAARSFLTASSPQEKYLHFMRGTLLEETKQNLESAENTMLLSRDRLSLLEETIKLLYKDFEHAQTILTELASKNDWITRRRLLQGKHMWMVCQTNNEKLKAIKTRENTLSAKKQEYVNRIADMKNKVERYLIQKEEALLDLGRKLTDRQNIEAERSSITIEIERFKSKHAQLIQQKQVTMEDLKSAEKARSKTQHELSDVENRLQTQLGEDEADTKRKLSDTRRKIKDIESLRPELLRKQSELDDKMNALIVDTERPLKEFQKNISEKKQELREMNSSEDILASGFDRRMPDVRRKIHERRTDFTSLPIGPIGYHISVKTEYEHFAFLIQTHINPTLEAFVVKDVGDAVLLKEIFESCQLRKIPGVITHDLQPFNYIRGKATSGLTVADALTFDIPELEYLLVDVNRMEKTILANSKKEADHILRERNSENVKLVLALNNSDSGLHMALTAGSMRLNNFQFANNLRLKVGTNNSSFLEKEILRQEEELKAREEHFSRKKKEIKEEKDNITRESRTSLQQLKTLERHAEELEDKLNRQTNFSHIDALKESLAEENEQIEQLKANLSSIEQKIVDLGLQLQPVKERYDDVTRRYRDACSSYETARHLEQSISHKIDKSSASILETQRKISASNEKIYMCEAELTSLQSKCEQQREQAMKFCTEDELLNSELPSSEEHILREIRKIDESVRASERQLGMTQDEIAKLFENSKRKYETAIGKYNELDASLQKVHTALTLRRAALDLSIKGTRSDADIDFRISMKTRSGYSGSLSFTDSGQLNVMVKTTNDHHARNVDTLSGGEKSFSQIALLLATWLTMRSRIIALDEFDVFMDQVNRKIGTNLIIRRLGKDVKSDTQTIIITPQDIGKMANIDDKYFNIHKMKNPERHNNVNSL

SEQ ID NO: 14307 - protein, 505 aa, Staphylococcus aureus subsp. aureus Mu50
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDTVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 14308 - protein, 250 aa, Flavobacteria bacterium BBFL7
MRKNIVAGNWKMNCDLSLTQNLIGDLKKGLKADYNCELMIAPSFPCLYPAFNSTLDTPIEVVAQNVCEQDKGAYTGEVSIDMLQSVGVKTVIIGHSERRDIYSETDELLAAKTIAAVENGMRVIFCCGEHLEQRKAGNHVSTVTAQIEKGLFQLNASQMEQIVIAYEPVWAIGTGETASPEQAQDMHADIRSFIQAKYGDMTARHTSILYGGSVKPSNAAEIFAKPDVDGGLVGGASLDAKSFLAIADAF

SEQ ID NO: 14309 - protein, 486 aa, Carboxydothermus hydrogenoformans Z-2901
MGSYPLIFELSKEGRTGFELPELDVPAKDINNLIPEEMQRKTEPDLPEVAEVDVVRHYVGLSRRNFGVDNGFYPLGSCTMKYNPKINEDTSRLAGFAELHPYVPEELAQGALELLYDAEQYLKEITGMDRFTFQPAAGAHGEFTGLMIIKAYLEKKGEKRTKVIVPDSAHGTNPATAAMCGFNVISIKSNERGLVDPEELAKVLDKEVAALMLTNPNTLGLFEEEIVKIAKMVHDVGGLLYYDGANLNAIMGVTRPGDMGFDVMHINLHKTFSTPHGGGGPGSGPVGVKAHLAEFLPVPVVEKDGDRYYFNYNLPNSIGKVRTFYGNFLVVVKAYTYLKALGGEGLTDVSQKAVLNANYLREKLKKYFYLPYDRLCKHEFVLSGKWQKEKGVRTLDIAKRLLDYGVHPPTIYFPLIVDEALMIEPTETESKETLDRFIEVMIAISREVEENPELLHEAPHVTPVKRLDEVGAARNPILRWSKDWQK

SEQ ID NO: 14310 - protein, 174 aa, Glycine max
  misc_feature (140)..(140): Xaa can be any naturally occurring amino acid
  misc_feature (154)..(154): Xaa can be any naturally occurring amino acid
  unsure (1)..(174): unsure at all Xaa locations
MICSLAVTTANRAGAGMVAPFTGLNSMAGLPTTKTNTDITFIACIGGIEQCMQVWPPLGKKKLETLSYLPYLDDAQLAKEVKYLLRKGWIPCLEFNLDHSSVYREHNTSPRYYDRRYCTMSNLTMLGCTDASHVLNELHXAKTAYPNGSVRIIXFDNATQVQCITFIVYNTPAY

SEQ ID NO: 14311 - protein, 428 aa, Methylobacillus flagellatus KT
MSRNQQLFEQSQTLIPGGVNSPVRAFGSVGGTPVFFKRGLGARLWDEDGKEYIDYVGSWGPMILGHAQPDVIAAVQATAANSLSFGAPTALELEMAQLITQLVPSMEQVRLVSSGTEATMSAIRLARGFTSRSKILKFEGCYHGHADSLLVKAGSGALTFGQPSSAGVPPELAAHTLTLPYNDVQALEHLFEELGKEIACVILEPVAGNMNLVRPTPEFLGALRSLCTHSGTLLIFDEVMTGFRVALGGAQQLFGIKPDLTTLGKVIGGGLPVGAFGGRADVMAFLAPLGPVYQAGTLSGNPVAVAAGLATLKQLQRPGFHEELALKTRQLTDGLARAARDAGVTFSAQSVGGMFGLYFSAECPASFAEVMQSDKQAFNRFFHGMLEAGVYLAPSAFEAGFVSIAHSEADISQTIVSAQGVFSRINDQ

SEQ ID NO: 14312 - protein, 166 aa, Triticum aestivum
  misc_feature (55)..(55): Xaa can be any naturally occurring amino acid
  misc_feature (72)..(72): Xaa can be any naturally occurring amino acid
  misc_feature (88)..(88): Xaa can be any naturally occurring amino acid
  misc_feature (92)..(93): Xaa can be any naturally occurring amino acid
  misc_feature (97)..(97): Xaa can be any naturally occurring amino acid
  misc_feature (100)..(100): Xaa can be any naturally occurring amino acid
  misc_feature (102)..(102): Xaa can be any naturally occurring amino acid
  misc_feature (105)..(105): Xaa can be any naturally occurring amino acid
  misc_feature (111)..(111): Xaa can be any naturally occurring amino acid
  misc_feature (120)..(120): Xaa can be any naturally occurring amino acid
  misc_feature (122)..(122): Xaa can be any naturally occurring amino acid
  unsure (1)..(166): unsure at all Xaa locations
IGATEPSQLSIDQNAQGLARYAIICQENGLVPIVEPEILVDGPHDIDRCAYVTEXVLAACYKALNDQHVLLXGHLPETQYGHPGFDAXKVAXXVIAXYTXRXLQXDLPAAXPPLSLSGGXSXEEAPEPEMNNSKTRTLELSFSSGVPQQNTSRLVRQDNKRGKTSG

SEQ ID NO: 14313 - protein, 840 aa, Xanthomonas oryzae pv. oryzae KACC10331
MASAPSGTIDTGRPLARPFAAIVLRNAGGELFGSAGHFHPQLHVIGHPLRIQQVGLDCRAHRTAWLGDMRAIVEAALRRQRLHIRKTAFGQILFAGRLELAHAGRVDQTRTGRQRNQRAVRGGVTAARIVFAHPIGLHLLGAQQGVGQGRFARTGRAHQYRRTAIAQPRPQRSHAGRILGIDRAQRNVLRLQLFQHRQRILGMFGLIGLGQHHHRLRTAAAHQQQIALDATRIEVRIQPAHDEHRIDIGRDHLLVVMRAGRPPLDRSAPRQQRHDALALHQHPIAHRRPLMAGEARPLPLRQRLGLEAGLRRIGHHIAGAVLLHHPRRQRLRMRGEDCLPGRLFRRPRPGPADGLEGGVIGGDVAHGAILAGWPQRLVQSGPAGRLTRHLTSLPMQACPLVIFPIPCQVSRLQPARRMSTAPQKPLAIRERLSEVRYEIRGELARRARELEAQGRKLIKLNIGNPGAFGFRAPEHLQRAIADDMGRTDPYTHQQGLLEAREAVAKAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRALLERIVAIATKHNLLLLVDEIYDQVLYDGAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNKEGVLVVPGSSFNVPYRHHFRVTLMPEASVMRDVFARIDRALARRAEAVTKVVPLKSRSVA

SEQ ID NO: 14314 - protein, 476 aa, Campylobacter jejuni subsp. jejuni NCTC 11168
MGKFVNNIDDFFKFCKQNEVLFVDFRFTDMIGTWHHITYNLHAINEETFQTGIPFDGSSIHGWQPIEKSDMILKPDAQSAFLDPFTADPTIIVFCDVYDIYKGQMYEKCPRSIAKKAIEHLKNSGIADTAYFGPENEFFVFDSVKIVDTTHCSKYEVDTEEGEWNDDREFTDSYNTGHRPRNKGGYFPVQPIDSLVDIRSEMVQTLEKVGLKTFVHHHEVAQGQAEIGVNFGTLVEAADNVQIYKYVVKMVAHLNGKTATFMPKPLYGDNGNGMHVHMSLWKNGVNLFYDKDGYSGLSQTAINYIGGILKNARSVAAFTNPSSNSYKRIVPGFEAPCILTYSCQNRSASCRVPYGIGKNSARIEIRFPDSTANPYLAFVSLLMAGLDGIKNKTIPVGPMDENLFDLTLDEIREKGIEQLPHTLRGSLEALIRHNSYLKPVMSDIFIDDYQHLKFETQVWPVEARPTAYEFKTCYSC

SEQ ID NO: 14315 - protein, 247 aa, Prosthecochloris aestuarii DSM 271
MIKLVLLRHGESQWNRENRFTGWRDIDLSEKGLAEAANAGVLMKEEGLTFDIAYTSVLKRAIRTLWNALDTMDLLWVPVEKTWRLNERHYGSLQGLNKTETAQLHGEEQVLVWRRSYDTPPPPLEKTDERYPGNDPRYASLSSEEIPVAECLKDTVARFLPYWHETIAPQIKAGKKVLIVAHGNSLRALVKYLDNISEEDIVGINIPTGIPLVYELDDDLKPIRHYYLGDQEAAAKAAAAVANQAKG

SEQ ID NO: 14316 - protein, 275 aa, Bacillus cereus ATCC 14579
MHIPTTTLHNGVKMPMIGLGVYKAKEGDEVKQAVKTALEVGYRSIDTATVYENESGVGEAIRESGIPREDIFITTKVWNDDQGYEETLEAFEKSLKKLQMDYVDLYLIHWPVRGKYVDTYRALEKLYEEGKVRAIGVSNFHKHHLELLLPNCKVKPMVNQVELHPMLTQFELRNYCQDEQIQMEAWSPLMRGGEVFQHPIIQAIANKYEKTPAQVILRWDIQSGIVTIPKSVTPSRIKENFTIFDFALTEEEIRQINTLNRDLHVGTNPDKYDTL

SEQ ID NO: 14317 - protein, 452 aa, Erwinia carotovora subsp. atroseptica SCRI1043
MDNQQTDGTLKRGLKNRHIQLIALGGAVGTGLFLGIAQTIKMAGPSVLLGYAIGGLIAFLIMRQLGEMVVEEPVAGSFSHFAYKYWGDFAGFASGWNYWVLYVLVAMAELSAVGIYVQYWWPDIPTWVSAAVFFLLINAINLANVKVYGEMEFWFAIIKVAAIIGMIAFGGWLLISGTGGPEATVTNLWAQGGFFPNGGLGLVMAMAVIMFSFGGLELVGITAAEADDPEKSIPRATNQVIYRILIFYIGSLAILLSLYPWGKVVEGGSPFVMIFHELNSNVVATILNVVVLTAALSVYNSCVYCNSRMLFGLAKQGNGPKVLETIDSRGVPVVAIGISALATALCVLINYLIPGKAFELLMALVVSALVINWAMISLAHLKFRAQKDKEGTVTKFKALLYPLGNYICLLFLAGILVIMFLTPGIQISVMLIPVWLIILGVGYFIKKKNQAK

SEQ ID NO: 14318 - protein, 179 aa, Triticum aestivum
  misc_feature (119)..(119): Xaa can be any naturally occurring amino acid
  misc_feature (134)..(134): Xaa can be any naturally occurring amino acid
  misc_feature (156)..(156): Xaa can be any naturally occurring amino acid
  misc_feature (163)..(163): Xaa can be any naturally occurring amino acid
  misc_feature (173)..(173): Xaa can be any naturally occurring amino acid
  unsure (1)..(179): unsure at all Xaa locations
MAPTVMASSATSVAPFQGLKSTAGLPVSRRSNGASLGSVSNGGRIRCMQVWPIEGIKNFETLSYLPPLSTEALLTQVDYLIRSKWVPCLEFSKVGFIFREHNASPGYYDGRYWTMWKLXPMFGCTDATQVINEXVQEVKNEYPDAYVRIIGFDNMXRQVQGVXPFIAFKPPGXKESGKA

SEQ ID NO: 14319 - protein, 227 aa, Thermus thermophilus
  misc_feature (24)..(24): Xaa can be any naturally occurring amino acid
  misc_feature (101)..(101): Xaa can be any naturally occurring amino acid
  misc_feature (163)..(163): Xaa can be any naturally occurring amino acid
  misc_feature (210)..(210): Xaa can be any naturally occurring amino acid
  unsure (1)..(227): unsure at all Xaa locations
MERPLESYKKEAAHAAIAYVQDGXVVGLGTGSTARYAVLELARRLREGELKGVVGVPTSRATEELAKREGIPLVDLPPEGVDLAIDGADEIAPGLALIKGXGGALLREKIVERVAKEFIVIADHTKKVPVLGRGPVPVEIVPFGYRATLKAIADLGGEPELRXDGDEFYFTDGGHLIADCRFGPIGDPLGLHRALLEIPGVVETGLFVGXATRALVAGPFGVEELLP

SEQ ID NO: 14320 - protein, 176 aa, Glycine max
VSSMISSPAVTTVNRAGAGMVAPFTGLKSMVGFPTRKTNNDITSIASNGGRVQCMQVWPPIGKKKLETLSYLPDLDDAQLAKDVDYLPRNGWISCLQSELDHGFVYREHNRSPGYYDGRYWTMWKLPMVGCSEALQVMNELLAVKTVYPTGFILLIVSDNVRQVLCIIFIYYNSAS

SEQ ID NO: 14321 - protein, 338 aa, Xanthomonas campestris pv. campestris str. ATCC 33913
MSRPSLTRFLIEEQHAGRIDPELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQADMRVPEDTAEFAINMSNQRHWEPAMQAYVGDLLAGKDGARGKDFNMRWIASMVADVHRILTRGGIFIYPWDKKDAAKPGKLRLMYEANPMGMLVEQAGGAATTGRERILDIQPTQLHQRVPVFLGSKNEVAEATRYHVEFDKAQG

SEQ ID NO: 14322 - protein, 657 aa, Medicago truncatula
MITTSSKQIWSYVVSILYLTLLATEASPTYLGSYCNDNTTYTPNSTLSTNLNVLLNSLSTNSSQQQDGYYMTIMGFGTTNAVNGIFLCRGDVNTTTCQNCVTDAATQIKRRCTNQTEAIIWYEECLLRYTNKFFRYYSIEPRLNPKNGKNVSGVDFERFNETVFGLLNELVVTAANSRTAKKFGTGEVEVTRSMKVYGSGQCSTDLTSSQCEICLRNAIGTLPKCCSGREGASALLASCIVRYQLYPFYNLYGSSSSSSGRNGVGTKAIVIIISLAIVPVLLFFIGCYYKRRRSRQRRRTMLRENFGDELKTLDSLQFKFSTIEAATNKFSSENEIGKGGFGIVYKGVLSDGQQIAVKKLSRSSGQGSIEFQNEILLIAKLQHRNLVTLLGFCLEEREKMLIYEYVPNKSLDYFLFDSKKHRVLHWFERYKIIGGIARGILYLHEYSRLKVIHRDLKPSNVLLDDKMNPKISDFGLARIVAIDQEQGSSTNRIVGTYGYMSPEYAMHGQFSEKSDVFSFGVIILEIVSGKRNSRPIQSHDFEDILRTAWRLWRNQTPLEMLDPILKDMFSHSEVIKCIQLGLLCVQENPDDRPTMAQAVSYLSSLLVELPLPLEPAFSMDRDMKLNIPTTESSSGQFISNSTASSINDLTKSQFFPR

SEQ ID NO: 14323 - protein, 475 aa, Burkholderia sp. 383
MSTQPQIVPTILCGGAGSRLWPVSRESHPKPFIRLEDGESLLQKAFKRGTQLPGVTEVVTVTNRELYFKTSDEFSTVNTGHLSTSFILEPFGRNTAVAIAAAALRVAATLGENAILLVLPADHLVTDDAAFATAVQEAAALALKGALVTFGITPTFAETAYGYIEADGTRVKRFVEKPTVDVARQYVESGSFLWNSGMFCFTAAFLLAEMAKHCPDVLEATRACIAQSRQSEGGGVSLVELNGDLLNRSPDISIDYALMERSDKVAVVRCDIGWSDIGSWNALGDLLKPDDHGNRVDGEALLHDVSNCYIRSDNRLVGAVGVKDLLVVDTPDALLIADRNRAQDVRHVYAALKSQGHETFRVHRTVGRPWGMYTVLEESTRFKIKRIEVKPGASLSLQLHHHRSEHWIVVSGMALVVNNDEEFYLRTNESTYIPAGHKHRLTNPGVVDLVMIEVQSGDYLGEDDIVRFDDNYGRS

SEQ ID NO: 14324 - protein, 420 aa, Rhodococcus sp. RHA1
MTLVSNPDHGHHRKPHRKLEQSTKLQNVLYEIRGPVHAHAARLEAEGHRILKLNIGNPAPFGFDAPDVIMRDMIAALPYAQGYSESKGILSARRAIVTRYELVAGFPELDVDDIYLGNGVSELITMTMQALLDNGDEVLIPAPDYPLWTAMTSLAGGTPVHYLCDEGNDWNPDIADIESKITDKTKALLVINPNNPTGAVYSMEVLQQLVDLARKHQLLLLADEIYDKILYDDAKHISLATLAPDLLCLTFNGLSKAYRVAGYRSGWVAITGPKEHAAGFLEGLDLLASTRLCPNVPGQHAIQVALGGHQSIEDLILPGGRLLEQRDVAWERLNMIPGVSCVKPKGALYAFPRLDPNVYEIYDDEKLVQDLLLQEKILMVQGTGFNWPDHDHLRIVTLPWARDLAVAIERFGNFLTSYKQ

SEQ ID NO: 14325 - protein, 413 aa, Xylella fastidiosa Ann-1
MPPTKTSFPKQDIRILLLEGVSHSGIETFRAAGYSQIKIHTTSLPEEALQAEIAEAHIIGIRSRTQLNAAVLGHAKRLMAIGCFCIGTNQVDLDTAELSGIPVFNAPYSNTRSVAELIIAEAILLLRRIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSHHNVNIDGQFLRTDATLGYVVIDISASQTQALALKEALTQVPGTLRTRLLY

SEQ ID NO: 14326 - protein, 202 aa, Triticum aestivum
  misc_feature (143)..(143): Xaa can be any naturally occurring amino acid
  unsure (1)..(202): unsure at all Xaa locations
MHPTRWELSHMVDLQAAALVISVVAAEVQAIYLHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFKQGWGSSSVKHNASXPGYYDGRYWTMVESCLCSGCTDATPSYTSGGKVKKGVTLTPNVRINRIRKKCVKVNCVK

SEQ ID NO: 14327 - protein, 137 aa, Streptomyces coelicolor
MTQRSLVLLKPDAVRRGLTGEIISRIERKAGWQITALELRTLDTETLEQHYGEHKGKPFYEPLVEFMASGPVVAMVVEGERVIEGVRALAGPTDPIAAAPGSIRGDYGVIVRENLIHASDSEESAERELKIFFPGRV

SEQ ID NO: 14328 - protein, 270 aa, Schizosaccharomyces pombe
MSNSRENSVYLAKLAEQAERYEEMVENMKKVACSNDKLSVEERNLLSVAYKNIIGARRASWRIISSIEQKEESRGNTRQAALIKEYRKKIEDELSDICHDVLSVLEKHLIPAATTGESKVFYYKMKGDYYRYLAEFTVGEVCKEAADSSLEAYKAASDIAVAELPPTDPMRLGLALNFSVFYYEILDSPESACHLAKQVFDEAISELDSLSEESYKDSTLIMQLLRDNLTLWTSDAEYNQSAKEEAPAAAAASENEHPEPKESTTDTVKA

SEQ ID NO: 14329 - protein, 235 aa, Antirrhinum hispanicum
MATVQKSQHSHFFLLVGCIVHLSNFCSTTTAQFDYFKLVLQWPNSYCSLKTTHCPRTRLPSQFTIHGLWPDNKSWPLSNCRDTSADVLKITDKGLIQDLAVHWPDLTRRQRKVPGQKFWVTQWKKHGACALPMYSFNDYFVKALELKKRNNVLDMLSRKSLTPGDQRVDVSDVNGAITKVTGGIAILKCPEGYLTEVIICFDPSGFPVIDCPGPFPCKDDPLEFQVLSRRKFQDL

SEQ ID NO: 14330 - protein, 284 aa, Corynebacterium jeikeium
MSAYGHGRHEHGQNFFTNHKIIKSIIDLVKQTSGPIIEIGPGSGALTHPMAHLGRAITAVEVDAKLAAKITQETSSAAVEVVHDDFLNFRLPATPCVIVGNIPFHLTTAILRKLLHAPAWTDAVLLMQWEVARRRAGVGASTMMTAQWSPWFTFHLGSRVPRSAFRPQPNVDGGILVIRRVGDPKIPIEQRKAFQAMVHTVFTARGRGIGEILRRAGLFSSRSETQSWLRSRGIDPATLPPRLHTNDWIDLFQVTGSSLPHHRPISPSGSSQRPPQRKNRSRRR

SEQ ID NO: 14331 - protein, 233 aa, Antirrhinum hispanicum
MAMIKKNRKVNPLSLLVVCVVPLNCCSTIIAKCDYLKLVLQWPKSFCLINSRKCQRNPLPSNFTIHGLWPDNYTRQAPQSCTTNNFQRFTDTDIEQRMEESWPDLKQQSIAGLSYNFWQDQWRKHGSCCFPPHESEIYFLKALELKDRLDVLTILENNNFNPGTPQPFSVLRVFNTISRAIGKTPILKCAQSYLKEVVICVDNNGASVVHCPRSRPRPRPRRDPCPFSDVKFP

SEQ ID NO: 14332 - protein, 546 aa, Dechloromonas aromatica RCB
MLPKLSSFPGVQGPVVIIVMDGYGLPKTDVGSAIAAARKPTLDRLFASYPNVRLRAHGTAVGMPSDDDMGNSEVGHNAIGAGQVYSQGASLVSNAIASGAIWQGEAWQQIVAGAKAGRGVVHFMGLFSDGNVHSHIDHLKAMVVQAKAEGIKTVRIHALLDGRDVPETSALDYVVPFEAFLAEISSDGFDARIASGGGRQYITMDRYDANWAMVDKGWQTHVLGRGTQFANATAAVNGLREQNPGTIDQDLPEFVVAENGKAIGTIEDGDSVVFFNFRGDRAIEITRAFEEAAFDKFDRVRFPKVTYAGMLQYDGDLKLPARFLVAPPAIKDTTGEWFAKSGIAQFACSETQKFGHVTYFWNGNRSGKFDGETWQEVPSDVVPFEQRPWMKAAEIADAMIAALQSGQYRTLRCNFANGDMVGHTGNFSAATLAVEAVDLSLARVLQAIDAAGGVALITADHGNADEMFELDKKTKQPAMNKDGSFKAKTAHTLNPVPLILYDNVSGGKLGLKQTETAGLSNIAATVANLLGLEKHAAWDESLLEIR

SEQ ID NO: 14333 - protein, 229 aa, Oryza sativa
  misc_feature (41)..(41): Xaa can be any naturally occurring amino acid
  unsure (1)..(229): unsure at all Xaa locations
VKEDDDVDKLEIKINTSKRSRRTYPSPSPEVALKISRSLRXLFTKHMKIIHQDPKLHAQRVAAIKKTKGTAAARKHASETQKAFFSNPENRLKRSIAMKGVKFFCSKCGQEGHRSFYCPTVREISGRAHFRCRLCGGKGHNSRTCGKPKSENECQRQPRHCSQCGERGHNRRNCPRSTTVEVEVGASGYIVKQDNVHSSGIYSCSFCSAKGHNRRTCPKRKASIGQQKD

SEQ ID NO: 14334 - protein, 233 aa, Antirrhinum hispanicum
MVAKKSHDHGQFSFLVLFVILLSSYCFTANAKYFEILKLVLQWPNSYCSLKTSTCRRNPLPLKFTIHGLWPDNYSWPLSDCGYDFTLPDITDKSLLKRLDRNWPDLTKRKNIRKPDKTFWLTQWEKHGTCALSVYTFDDYFRETLNMKRRFNILDMLQRKSMRPGDRVDPQEVARAISKVTNHEPEVKCREGFLTEIIICFDTGRDASVIDCPGPLCTDPMVDFPRSVVRTIR

SEQ ID NO: 14335 - protein, 150 aa, Synechococcus elongatus PCC 6301
MVSSSIGLRQCCPGSQRARGLPGADYAGQSAMKVGDRDQRPWGQFEILAQGSGYQVKRLEVLPGQQLSLQRHQQRQEHWLVVQGLARVQLGDRQFSLRVGQSLDIAIGEWHRLQNPGDELLALIEVQMGAYLGEDDIERRADDYGRCPTS

SEQ ID NO: 14336 - protein, 426 aa, Bordetella parapertussis
MPGLRQDFARRRCRISRRPGFCQNCRNIAATAKPRAMELLTILLIAAVLCVPLAQRLGLGAIPGYLLAGGVIGPSGLGLVTDVPDIMRVSEWGVVMMLFVIGLELAPKRLWAMRREVFGAGLRHLAGMGWQAAILCGLSLALSSTAVALRLLEERGLVRTPLGRSALGVLLLQDMAAIPMLVAAGLLGSDGDSAPSFEAALVAVVVVLACYRLRLLDWAARSQLHELFTAATLLVVLGTAQLFDYAGLSAGLGGFLVGMLLAESRHRNELEHTIEPFKGLLLGLFFLAVGMSVNVEEALDYWPYVLAGVVALLSLKALVLYGIARLMGLPHYHRLLYALVLAQGGEFSFVIFNEAWDNHLMSLEQRDLLAIVVAISMGAVPIVIRLLERLPGRYGGIGDMAVTLVGFAGSPPPQSAADNEERSGPG

SEQ ID NO: 14337 - protein, 198 aa, Glycine max
  misc_feature (83)..(83): Xaa can be any naturally occurring amino acid
  misc_feature (101)..(101): Xaa can be any naturally occurring amino acid
  misc_feature (153)..(153): Xaa can be any naturally occurring amino acid
  unsure (1)..(198): unsure at all Xaa locations
GVLYYTPQILEQASVNYLLSTLSLNSTSSSFLISTRTTLLILPYIAITIKLINISSRKTVLLSTIPILIAALLILLLESLVNXQSTTNTSISTISGISYCXFCSINVNQCPNILYTEILPTQMRKLYISISSLTFGIYDIIVTYTLGGILNGXSLRYIDNMYTVIFFIAYVWCVFNIRYTRSIRLKVMMDWLSIGLRR

SEQ ID NO: 14338 - protein, 247 aa, Zea mays
GKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 14339 - protein, 1078 aa, Bradyrhizobium japonicum USDA 110
MSSKNRLDPIPQPPTKPVVGNMLSLDSAAPVQHLTRLAKELGPIFWLDMMGSPIVVVSGHDLVDELSDEKRFDKTVRGALRRVRAVGGDGLFTADTREPNWSKAHNILLQPFGNRAMQSYHPSMVDIAEQLVQKWERLNADDEIDVVHDMTALTLDTIGLCGFDYRFNSFYRRDYHPFVESLVRSLETIMMTRGLPFEQIWMQKRRKTLAEDVAFMNKMVDEIIAERRKSAEGIDDKKDMLAAMMTGVDRSTGEQLDDVNIRYQINTFLIAGHETTSGLLSYTLYALLKHPDILKKAYDEVDRVFGPDVNAKPTYQQVTQLTYITQILKEALRLWPPAPAYGISPLADETIGGGKYKLRKGTFITILVTALHRDPSVWGPNPDAFDPENFSREAEAKRPINAWKPFGNGQRACIGRGFAMHEAALALGMILQRFKLIDHQRYQMHLKETLTMKPEGFKIKVRPRADRERGAYGGPVAAVSSAPRAPRQPTARPGHNTPMLVLYGSNLGTAEELATRMADLAEINGFAVHLGALDEYVGKLPQEGGVLIICASYNGAPPDNATQFVKWLGSDLPKDAFANVRYAVFGCGNSDWAATYQSVPRFIDEQLSGHGARAVYPRGEGDARSDLDGQFQKWFPAAAQVATKEFGIDWNFTRTAEDDPLYAIEPVAVTAVNTIVAQGGAVAMKVLVNDELQNKSGSNPSERSTRHIEVQLPSNITYRVGDHLSVVPRNDPTLVDSVARRFGFLPADQIRLQVAEGRRAQLPVGEAVSVGRLLSEFVELQQVATRKQIQIMAEHTRCPVTKPKLLAFVGEEAEPAERYRTEILAMRKSVYDLLLEYPACELPFHVYLEMLSLLAPRYYSISSSPSVDPARCSITVGVVEGPAASGRGVYKGICSNYLANRRASDAIYATVRETKAGFRLPDDSSVPIIMIGPGTGLAPFRGFLQERAARKAKGASLGPAMLFFGCRHPDQDFLYADELKALAASGVTELFTAFSRADGPKTYVQHVLAAQKDKVWPLIEQGAIIYVCGDGGQMEPDVKAALVAIRHEKSGSDTATAARWIEEMGATNRYVLDVWAGG

SEQ ID NO: 14340 - protein, 324 aa, Neisseria meningitidis Z2491
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 14341 - protein, 403 aa, Moorella thermoacetica ATCC 39073
MNEGISFNTIEEAIAEIKAGRMVVVVDDEDRENEGDLVMAAARVTPEAINFMATHGRGLICVPMEGQRLDELELEPMVNQNTESMGTAFTVSVDAAEVTTGISAFERAATIKRLIDPSTRPEDLRRPGHIFPLRAKPDGVLRRAGHTEAAVDLARLAGLYPAGVICEIMNPDGTMARVPQLYKFCQEHGLKLITVADLIEFRRRREKLVRRVAEADLPTRYGHFKAVAYEEIMNGKGHLALVKGDIAKGRPVLVRVHSECLTGDVFGSERCDCGDQLQRAMKMIEDEGAGVILYMRQEGRGIGLLNKIKAYKLQEEGKDTVEANEALGFPPDLRDYGIGAQILADLGVRQIRLLTNNPKKIAGLEGYGLQVVERVPIEICPNKVNRRYLKTKKEKMGHLLHIS

SEQ ID NO: 14342 - protein, 507 aa, Desulfitobacterium hafniense DCB-2
MEQLWLKVPSRPLLMTHVGNDERSLGHGFVIYLLLQFPGDFTLTLGARGIEKSFPSLTLLCPALNWPEREVRDLLGLHPDGHPDPRPLVLHPGWTEGFYPLRKPCPETPVSIGGECPGEALKEVSFNPQPLSFTEAEGEGTFEIPVGPVHAGIIEPGHFRFQTIGETVLHLDAQLFYTHKGIEKLLEGKDLEEGLKIVERVCGVCAVSHALAYCEAVEKLKGMEVPRWILGWRTVLAELERLYNHVGDIGNLCAGVGFALGNGNALQNKEQLQRLNHQLFGHRFLRGNITPGGVKKIPQREERAYLQRRLAELEQDFEEWLPLILEHDGFRQRAITTGVLSKQSALDLGVTGPAARASGISQDWRERHAHLLYEELKVEPQVEQEGDVWSRLMVRVREVKQSFALLAELLEGDFLQDTVEQGGSALNGSEPFSPQPYSFAWGCAESPRGTDVIWLMLDDEGKIYRCRIRSASYANWAAVPLAVQGNIVPDFPLINKSFELCYSCCDR

SEQ ID NO: 14343 - protein, 423 aa, Xanthomonas axonopodis pv. citri str. 306
MSTAPQKPLAIRERLSEVRYEIRGELARRARELEAQGRKLIKLNIGNPGAFGFRAPEHLQRAIADDMGRTDPYTHQQGLPEAREAIATAYARRQHPDAHPDRIFVGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNEEGVLVVPGSSFNVPYRHHFRVTLMPEAGVMRDVFARIDRALARRAEAVTKVVPLKPRSVA

SEQ ID NO: 14344 - protein, 361 aa, Arabidopsis thaliana
MEEDNQEIQRDNVGSSSFFKTCFNALNALSGIGILSVPYSLARGGWLSLSLLLLLAVTAFYTSLLITKCMNADRNIKTYPDIGERAFGRPGRIIVSVFMHLELYLVTTGFLILEGDNLHNLFPGFTIEMIGLRLNGKQAFMATVAFVIMPTLWWDNLSVLSYVSMSGVLATTVTLGSISWIGAFDGIGFHQKGKLINWSGIPTALSLYAFCYGAHPVLPTLYSSMKSKHQFNNVAIYTTLVNPVAKYALMITPTVNTIKDWFPSRYSKKAYLHLLISTFFIISSVVIAETLPFFGYMMSLVGALLSVTVSILLPCLCYLKIFGNYKKIGCETIMLFGMVVMSVFVGVIGTYIALRDIIGSV

SEQ ID NO: 14345 - protein, 975 aa, Burkholderia sp. 383
MKLEHPDRLMNRTPLSLAALETHDAFAERHIGPDAASQQAMLDTLGFASRAALIDAVIPASIRRAETLPLGPFAQPKSEAEALAALRVLADKNEVFRSYIGQGYHDTHTPAVILRNVLENPAWYTAYTPYQPEISQGRLEALLNFQQMVADLTGLAISNASLLDEATAAAEAMTLLQRTGKPTSNVFYVADDVLPQTLEVIRTRALPVGIEVKTGPAADAAQANAFGVLLQYPGVNGDVRDYRALTEAIHAAGGHVVVAADLLALTVLTPPGDWGADVAIGNTQRFGVPMGFGGPHAAYLAVRDEFKRQMPGRLVGVTVDAQGKPALRLALQTREQHIRREKATSNVCTAQALLAIMASMYAVYHGPHGLKTIALRVNRIAALLAAGVKQLGFATVNDTFFDTLTIDTGARTAQVHEFAKAKRINLRRVSDTQVGVSVDETTTRDDLADLLAVFAQAAGGTAPAVDALDAGLAGVAALPAGLERTSAYLTHHVFNRHHSETEMLRYLRSLSDKDLALDRSMIPLGSCTMKLNATSEMLPVTWPEFGGIHPFAPAEQTVGYREMIDQLEQMLVAATGYAAVSLQPNAGSQGEYAGLLIIHAYHASRGEAHRDVCLIPASAHGTNPASAHMAGMKVVVVACDAQGNVDIADLKAKADEHAKDLAAIMITYPSTHGVFEQNVREICEIVHAHGGQVYVDGANMNAMVGLTAPGQFGGDVSHLNLHKTFCIPHGGGGPGVGPVAVGAHLAKFLPNQRSTGYTREEDGIGAVSAAPYGSASILPISWMYIAMMGAKNLTAATETAILNANYIAKRLAPHYPVLYSGPGGLVAHECILDLRPIKESSGISVDDVAKRLMDYGFHAPTMSFPVPGTLMVEPTESESQEELDRFIAAMIAIRDEIRAVEEGRADREDNPLRHAPHTAAVVTANEWLHAYSREQAAYPVASLGTNKYWPPVGRADNVYGDRNLFCSCVPMSEYA

SEQ ID NO: 14346 - protein, 397 aa, Bacillus cereus ATCC 14579
MFHRIEEALEDLKKGKVVIVCDDENRENEGDFIALAEYITPETINFMITHGRGLVCVPITEGYAERLQLEPMVSHNTDSHHTAFTVSIDHVSTTTGISAHERATTIQELLNPASKGADFNRPGHIFPLIAKEGGVLRRAGHTEAAVDLAKLCGAEPAGVICEIINEDGTMARVPDLIECAKQFDIKMITIEDLIAYRRHHETLVTREAEITLPTDFGTFHAIGYSNSLDTKEHIALVKGDISTGEPVLVRVHSECLTGDVFGSHRCDCGPQLHAALAQIEREGKGVLLYMRQEGRGIGLLNKLRAYKLQEEGFDTVEANEKLGFPADLRDYGIGAQILKDLGLQSLRLLTNNPRKIAGLQGYDLEVVERVPLQMPAKEENKSYLQTKVNKLGHLLNL

SEQ ID NO: 14347 - protein, 358 aa, Desulfovibrio vulgaris subsp. vulgaris str. Hildenborough
MSRTIIPFGPQHPVLPEPLHLKLVVEDETVVEAIPALGYVHRGLETLASIRDYNQMVYVVERVCGICSCIHAMCYCQSLECMMNVEVPRRAKVLRTIWSELHRIHSHLLWLGLFADGFGFESLFMQFWKVRERVMDINEATAGNRVVISTNIVGGVRRDLSPEHQKWILDEMNHLEREIRALMTTILDDYTVCKRTKGVGVLTAQQAIQLGAVGPMLRGSGVAQDARQLQYAAFDELDFEPIAVPDGDSWARCKVRFLEVLQSVDLVRQAISKLPDTELSVKVPGKPEGEVVARVEQPRGELMYYVKGNGSKHLERVRIRTPTFANIPPLLAIMGGLQLADVPVAVLSIDPCISCTER

SEQ ID NO: 14348 - protein, 391 aa, Halobacterium sp. NRC-1
MRDGRDPAGMPSERAAAVTPFAAMDVLERAADRADVIHMEVGEPDFAPPAAATEAAVDALRAGDDDYTTSRGRRSLRDAISGYYAAEYGVSVPAERIVVTPGSSPALLTVLLATVDPGSAVVLSDPHYACYPNFVRLADGVVRTVGLAPDAGFQPAVSDYDAAIGDDTAAMLLNSPGNPTGAVIDGESLSALVALADRTDTAVVSDEIYHGLAFDAAAHSVLEYTDDAFVIDGVSKRYGMTGWRLGWVVCPRRYVDTINAIAQNTLICAPSFVQAGAEAAIRHGTDWLDGVRADYRTRRDILCAAAERWGFDPGYTPAGAYYMLLDVSRLGAAPAVADALLETAGVAVTPGPDFGANATEYVRASFAVSTDAVREAVARIDAVLASATTLT

SEQ ID NO: 14349 - protein, 464 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVALLTRKIYDGIEVGDKPRLNIKGYIQGNALTDRYIDSNGRIKYANRMGLISDKIYQSAKTNCNGSYFDVDPHNILCLNDLQKVTKCLKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPEYKPEQCLPMVDRWFSGDPL

SEQ ID NO: 14350 - protein, 398 aa, Clostridium acetobutylicum ATCC 824
MNFSKKAGQIAASITLEITAKADEMKANGINVIGFGAGQPDFNTPKNIRDAAIYAIENGYTKYTPVSGIKELKMAICDKFKRDNNLNYSLSNIIVSTGAKQCLSDTFSALLNPGDEVILSAPYWVTYPELIKLNDGISVIINTTEENHFKLSVDDLENAYTSKTKAILINSPSNPTGTVYTETELKAIAEFAKEKDLFIISDEIYEKLIYDGERHVSIASLSQDAFNRTVVINGMSKSYAMTGWRLGYAASGSSEFIKLMSHIQAHTTSNANSITQYASVEALNGRQEELHSMVTEFEKRRTYMSKRVNNITGIHCLLPKGAFYVMMNISNLFGKEINGVKINNSVDFSKELLSENKVAVVPGTGFGNDNYVRLSYATSMDNIVKGLDEIENFIGKLR

SEQ ID NO: 14351 - protein, 456 aa, Solanum berthaultii
  misc_feature (449)..(449): Xaa can be any naturally occurring amino acid
  unsure (1)..(456): unsure at all Xaa locations
MVLAFIVFVLMLLLTDVVSSHFIVETLPGFDGQLPFKLETGYIGVGEEEKLQLFYFFVESERDPQNDPLMIWLTGGPGCSGLSTFLYEFGPLTFDYANSSGNFPKLELNLHSWTKVANIIFIDQPVGTGYSYAKTSEAYNSNDTLSATLTYDFLRKWLMDHPEYLKNPLYVGSESYAGIYSALVTRKIYDGVEVGDEPQMNIKGYIQGNALTDAYITVNSRVKYVYHMGLISDKIYQSAKANCNGNYVDIDPNNILCLNDLQKVKKCLNNIQSHHILENWCDLSLLRSNVHSGPWCRENNYIYSKIWANDKAVQKALNVREGTILEWVRCNNSMKYSARESMKRSGSYVYEIQSSIDDHRHLTSKSCRALIYSGDHDMIISHVSTEEWIDTLKLPIVDDWEPWFVEDQVAGYKVKYLQNDYELTYATVKGAGHTAPEYKPRQCMSMVDXWFSGDPL

SEQ ID NO: 14352 - protein, 485 aa, Synechococcus sp. RS9917
MTTPLIPVILCGGTGTRLWPLSRASYPKQYWPLGGSGDETLLQQTQQRLEGLSGLAAPLLICNDDHRFIVAEQMRQIGVEPGAILLEPMGRNTAPAVAVAALQATARGDDPLLLVLAADHVIRDAALFRAAIEAGRADAEAGRLVSFGIVPTAPETGYGYIEAAAPLQAGSLQPVPIARFVEKPDRATAEQFLASGRFTWNSGMFLFRASAMLAELERLAPEVVSCCRAALEQDVADLDFLRLEREAFAKCPNVAIDVAVMEKTALGSVLPLAAGWSDVGSWSALWDTADRDDDGNVLRGRVISEGSRNCYLRSEHRLVVGLGVENLVVVETDDAVLIADRSQAQNVKTIVKQLEADGSPEGKAHRRIYRPWGSYTGVVEDHRWQVKRISVKPGASLSLQMHHHRAEHWIVVKGTALVERDGEQQLIGENQSTYIPLGCKHRLSNPGRIPVEMIEVQSGAYLGEDDIVRFDDLYGRSDATAALKA

SEQ ID NO: 14353 - protein, 461 aa, Solanum berthaultii
MVRVTLFLLLLLVSDVVSDHFIVETLPGFHGKLPFTLETGYIGVGEEEKVQLFYFFVPSERDPLNDPLMIWLTGGPGCSGLSSFVYEIGPLTFDYANSNGNFPKLELNSNSWTKVANIIFIDQPAGTGYSYANTSEAYNCNDTLSVTLTYDFLRKWLMDHPEYLNNPLYVGGDSYSGIFVAPLTRKIYDGIEVGDKPRLNIKGYIQGNALTDRYIDSNGRIKYANRMGLISDKIYQSAKTNCNGSYFDVDPHNILCLNDLQKVTKNIRRAQILEPYCDLPYLMDILQETPTNGQSVFPIAGPWCREKNYIYSYVWANDKVVQKALNVREGTTLEWVRCNESMHYRGKERTESYVYDVPSAVGDHRHLTSKSCRALIYSGDHDMVVPHLSTEEWIDTLKLPIADDWEPWFVDAQVAGYKVKYLQNDYELTYATVKGAGHTAPQYKPEQCLPMVDRWFSGDPL

SEQ ID NO: 14354 - protein, 284 aa, Corynebacterium jeikeium
  misc_feature (160)..(160): Xaa can be any naturally occurring amino acid
  unsure (1)..(284): unsure at all Xaa locations
MSTYGYGRHEHGQNFLTDHKIINSIVDLVKQTSGPIIEIGPGSGALTHPISHLGRAITAVEVDAKLAAKLTKKTASASVEVVHDDFLNFPLPATPCVIVGNIPFHLTTAILRKLLHAPAWTDAVLLMQWEVARRRAGVGASTMMTAQWSPWFTFHLGSRXPRSAFRPQPNVDGGILVIRRVGDPKIPIEQRKAFQAMVHTVFTARGRGIGEILRRAGLFSSRSETQSWLRSRGIDPATLPPRLHTSDWIDLFQVTGSSPPRHRPISQSGSSQRPPQRKNRGRRR

SEQ ID NO: 14355 - protein, 246 aa, Saccharomyces cerevisiae
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 14356 - protein, 280 aa, Streptomyces turgidiscabies
MDTVTLGEHDAEQRGYWDAKQTDDINLLLGSEDGLYHHHYGIGDYDHAVLDAPAGRREEQIQRELHRMETLETGLVLDALGEVPSTARVMDAGSGRGGTSFVIADKFGCRVDGVNYCAHHVDFTQNLARERGVANRVQFHFTNMMQTPFEDGTFDFIVSNETTMCVDIHKAFAEFSRLLRPGGRYVAVTWSRHDAVHPRSEASREIDEHYLCGMHKRSTYFEALAANGLVPYHVRDHTEEAIPYWELREHSELRTGVEAPFLRGFREQSIDYLVIASERV

SEQ ID NO: 14357 - protein, 284 aa, Streptomyces turgidiscabies
MTITTGNHARNEYERELKSHWDAKTADEINLLLGAEDDLYHHHYAIGDFDRSVLDTPPEHREEAILRELHRMESDQIRLILDALGTLPADSRGMDAGSGRGGTAFTIARELGHRVEGVNFCEHHVEFAEGLARKRGWDDRVRFHLGNMLQTPFEDGSFDFVVSNETTMYADAFEAMREFSRLLRPGGRYVMTTWCRDEAVDPRSEATRSIDKHYVCNMHRRGTYFQAFAAHGLTPYRVERYTREAMPYWELRNLSALRTGVEEPFLEGYRDGSLNYMVVAAERI

SEQ ID NO: 14358 - protein, 496 aa, Triticum aestivum
MAMVAAGGGGGVLGEWGWWLGLVFGAAPLLCLAVWNATDAWYRAAFFLKHGSQRRLPPGHMGLPFLGETLSLIWHFKLARRPDEFIAAKRRAHGGAGAGLYRTHLFGSPAVIACSPAANKFVLQSPDNFGARWPVPELVGITSVVNVEGATHARLRGFITAAINRPSSLRTIAAVMQPRIMVALASWADMGTIVAATEIKNVTFANICKMFISMEPSPLTEKIDKLFRDLVAGLRSFPLDFPGTTFHSARKCRRKLNAIFREELEARKKVGRECDDLMGGLMHMEDEQGRKLRDEEVVDNIVSLVIAGYESTASAIMWATYHLAKSPVALAKLREENMAVSKSKGASSMITHDDLPNMKYTAKVVEETIRMANISPMLHRVANRDVDHNGYTIPAGWSVVVWVRSLHTDPGNYENPLTFNPDRWDEPAKPGTYLVFGGGYRICAGNMLARLQLTIMLHHLSIGYEWELLNPDAEIDYLPNPRPADGAVMSFRKLST

SEQ ID NO: 14359 - protein, 1260 aa, Aspergillus oryzae
MEQKTVPLNPESVRAPLVDVSNRVNNCPSPNLVQGEESMGGLQYLSSPQPMSIVTSPPEQKRYVDNNCLSPTANPKTSSKRNSTLSANSVISNQGKRKTHVGPWQLGRNLGEGTTGRVRLAKHKYTGQTAAIKIVSKTSAAMTQSNSIAEMDRNRGLHGKSGTRHIPSGIEREVVIMKLIEHPNVVRLYDVWENRGEIYLVLEYVEGGELFNYITENGPLQEFEAVKLFRQILAGLGYCHRFGICHRDLKPENILLDSQGNVKLADFGMAALQREGYWLKTSCGSPHYAAPEIVKGDEYRGNKADLWSCGIILFALLTSYLPFDGQDLSSTLKLVKTAKVEIPSNVSYEAADLIHKILQKKPEKRIDMADVWKHPLLRRYECLDPVMHNPYIGPAPSWSVKECGPRISRHELESESDILRNLQTLWHDVEREVLIERLLDPEPTLERMFYNALVRFRDEHLENWPGQSLEYSASDYHHISKDSNGTFSRRDNDRSKGSRRRGQVPMSKVAQLRSNAIQEPKSCATVGSYDPFRSPCHVVPEKEGHTYVTIHRDVPDHGGRKEESDSIAEGSVISEEEFRDQTPCPPSSPFAIVQNKKKPSSLKSFHSRTSHTGNRRQLNGLSAPRSASYKRNVCFRHVRNRSQGSTTAMKPKGAPINVPDKDMSENSLMSIDPGPFADRESSPLLPAQPAVVRRPGVALRTCAPQKKVRESDFIWKDDARQVSHELSQICEEAFNRASLSTGCTTTSTCMSAETPATSVSMASPEASHSRIATSNSKAPVTPSRCGESPRSYTAAELTETRRKLIAHSTQDGTEDVPGYLVAVIKHLDRLIEQDKARQRERVYTPEPEAQPSELSQDAGCLPKISEELHNRQSNSATQYKPYRPGLTTSTGTNTGRPSRNGIGTIRMVPQSSVPSIETIQPLTIRKKSEGPSPNIHHEPFADGSNEENLAPCRYSSMNSFHSRRPCELDPIAEIPPKSEKRNAARYPDNKKWSWLPIKHQPPTETVCKNLRPLHPVDRTVTVHEVNPSADSLTNQPETPAGKSKGGFFKKFMKGKASNPKYPTTGQYHLINTIRTSSNRPVPDSQATETTPILSHPTEPPRLINADKPLPQRPGTSRKPVNWFARMFQFTPATKALALNTSKMKGRKEVHRILREWKPYGITVHYDKADGIIYGKVSRSNIRRIRPVAFSAEFYTVLEDGRRGNLSLVRFKQERGAVSSFNKVIDTLEKFMKRRGLLVEDPVRAQQMMKVLDKYQDPQGK

SEQ ID NO: 14360 - protein, 88 aa, Glycine max
  misc_feature (34)..(34): Xaa can be any naturally occurring amino acid
  unsure (1)..(88): unsure at all Xaa locations
RAFAEKHYADLSAKPFFSGLVDYIVSGPVVAMIXEGKNVVTTGQKIIKATNPSQSRPTTIHNNFAINIKKNVIHKTNSFKSANKEIAL

SEQ ID NO: 14361 - protein, 345 aa, Ralstonia solanacearum
MKALVYEGPGKISLENKPKPELQAPGDAVVRVTLTTICGTDLHIIKGDVPTCEPGRTLGHEGVGVIESVGAAVTSLKPGDHVLISCISSCGKCANCRRGMYSHCETGGWILGHRIDGVQAEYVRVPHAETSLYKVPPGVDEEALVMLSDIFPTGFECGVLNGRVQPGSTVAIVGAGPIGLASLLTAQFYSPARIIMIDTNVARLEVASGLGASDCINVTRENAAAAVKRLTDGMGVDCAIEAVGVPATFELCQELVAPGGVIANIGVHGVKADLHLETLWSQNIAITTRLVDTVSTPMLLKTVRAGKLLPGQLITHRFKLDDILAAYDTFRNAGETHALKVIIAT

SEQ ID NO: 14362 - protein, 107 aa, Lilium longiflorum
RAAPAQASMVAPFVGLKSSSAFPVTQKPATGLPTLPSNGGRVQCMKVWPIVGKKKFETLSYLPTLPVEALLKQIEYLIRSGWVPCLEFSLVGFVSRDYHQSPGYYDG

SEQ ID NO: 14363 - protein, 531 aa, Saccharomyces cerevisiae
MRVYQFCRPFQLFTCFLCYLLVFVKANKEKISQKNYQVCAGMYSKEDWKGKIDPFISFNLKKISGLSDESDPGLVVAIYDFQDFEHLGVQLPDEEMYYICDDYAIDIGICEEENRDEFIVQDVVYDPYTSTNRSLANPIMTFSQNEVGLHDTRYPIKETGFYCVTAFRSSTSTKFNAVVNFRNAYGQLAGTEINKLPLYGLLAVAYVVAMALYSFAFWKHKHELLPLQKYLLAFFVFLTAETIFVWAYYDLKNEKGDTAGIKVYMVFLSILTAGKVTFSFFLLLIIALGYGIVYPKLNKTLMRRCQMYGALTYAICIGFLIQSYLTDMEAPSPLILITLIPMALALIIFYYMIIRSMTKTVIYLKEQRQIVKLNMYKKLLYIIYASFLSVLAGSIVSSFIYVGMNTIDMIEKNWRSRFFVTDFWPTLVYFIVFVTIAFLWRPTDTSYMLAASQQLPTDPENVADFDLGDLQSFDDQDDASIITGERGIDEDDLNLNFTDDEEGHDNVNNHSQATGQCLPLQQNNATSSRFD

SEQ ID NO: 14364 - protein, 525 aa, Carboxydothermus hydrogenoformans Z-2901
MRILASDPIAEKGLNILREEGFIVDEKTKLSEEELIKIIPQYDALIVRSETKVTARIIEAAENLKIIGRAGVGVDNIDLAAASKKGIIVVNSPEGNTIAAAEHTFALMMALLRNIPQAHAALKEGKWLRKEFTGYELRGKTVGIIGLGRIGTAVAKRVKAFETRVIGYDPFISEERAQMLGITLMSLEELLQNSDIVTMHLPLNNETRNLINRERLKLMKKSAFIINCARGGIIDEEALYEALKAGEIAGAALDVFSKEPLTESPLFELPNVIVTPHLGASTKEAQINVAIDVAREIASVLKGGLAQNAVNFPAMDKESYQRLKPYINLAEKLGNFLAQILSGGLLAAEIVYNGSAFKEETRPLTLAALKGLLDPLLMERVNYVNAPVVAKERGIKVRETVMENGADYTNLITLKVTTEKGERIIAGTLFRNNEPRIVQIDQYRVDVVPEGYKLFVPHKDQPLMIGKVGIILGEKGINIAGMQLGRITPGGDAVMVLSLDHPADGDSIKAIAAIPGIYEVKAVSL

SEQ ID NO: 14365 - protein, 248 aa, Glycine max
MCLSGGVWCAEMVEAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 14366 - protein, 363 aa, Oryza sativa
MMYKHVGDDARGSSAGVVCCVDVVDDDVDALLCGEDAGELEREGEPAQGSSPSSSLSCAAAAAAAADDDDEDEDEHGVHGEVVQVTPGGEEHCYDYDYDVDVPVGAELVMPACSPPRTAVHRPGWSESVSWILKVRSVHGFQPATAYLAVSYMDRFMSSRSLPDHGWASQLLCVACLSLAAKMEESSAPPLLDLQIEGTRFIFEPRTIQRMELIVLVELDWRLRSVTPFAFVDFFACKVGSSGRSSRILALRACQIILSAIHELEFLNHCASSMAAAAVLFAVNESPAAMSHRSSVSSESAASWCIGLTEERISSCYQLLQRALNATARKRKRHPMILAACSSVTSSSSRSKRRKLDGHFGED

SEQ ID NO: 14367 - protein, 584 aa, Aspergillus oryzae
MATPGNQNHRAWWKESSVYQIWPCSFKDSNDDGIGDIPGIISKLDHIKNLGIDIVWLCPSYKSPQVDMGYDIADYYDIAPEYGTVADVEKLIKGCHERGMKLLMDLVVNHTSDQHEWFKQSRSSKDNEYRNWYIWKPARYDEQGNRQPPNNWVSHFQGSAWEWDEHTQEYYLHLYATEQPDLNWEHPPVRKAVHDIMRFWLDKGANGFRMDVINFISKDQRFPDAPIKDPRTPWQWGDKYYANGPRLHEYFQELGKILKEYDTFSVGEMPFVTDTEEVLRAVKYDRNELNMIFNFEHVDIDHGKYDKFEPGSWELTDLKFFFERWQKFMYENDGWNALYWENHDQPRSVDRYTNAKEEDRVIASKMLATILALKAGSPFVYQGQEIGMGNVPPEWDIEEYKDIDCLNHWKRLPNDPEIQKIARQEYQKKSRDNGRTPVQWTNAPNAGFTSPNVKPWMSVNPNYARGINAEAQVNDPNSTYSYWASVLGLRKKYVDIFVYGNYELVDRDSQEIFAYTRQYEDQKALVLANWTDGTLEWDSSSNGVKAVKDVLLNTYDSASDVKERFSGSKWSLRPYEAVVLLIEA

SEQ ID NO: 14368 - protein, 305 aa, Aspergillus oryzae
MTASKDLPPDTTPYYYLKIFLKSQLCTKAQLPPKNTTLIDKVAIVTGANTGLGLESSRQLLSYNLSLLIIAVRSVAKGEIAAATLRKEYPIATIEVWNLDMSSYDSIRAFVRRTETQLSRLDIVILNAGLQNMQFGVVPSTGHEETIQVNYLSTVLLSILLLPVLKNKSTVGTPGRLSIVSSGTALFARFPHRKFSLLLPSYDDPKNFDLIEQYSASKLLGHMFMWKLADYVSADDVVVNLVDPGFTKGTQLQRDVSGVVSLAMSLAKVITARTVRDGASTYVDATVVKGKESHGCFVMDWQIRP

SEQ ID NO: 14369 - protein, 472 aa, Mycobacterium bovis AF2122/97
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLDKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 14370 - protein, 283 aa, Listeria monocytogenes str. 1/2a F6854
MKTVKLNNGVEVPILGFGTYQITDAAEAEQAVKDAIKTGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDVFNNPVLTKIGAKYGKSAAQVILRWLVEQDIIVLAKSVKPERMAQNLAIFDFELTEADKEEIAGLNQGESQFFSHADPEMVKWMASRKLNV

SEQ ID NO: 14371 - protein, 296 aa, Oryza sativa
  misc_feature (92)..(92): Xaa can be any naturally occurring amino acid
  unsure (1)..(296): unsure at all Xaa locations
MYDELASKGNVEYIAGGATQNSIRVAQWMLQTPGATSYMGCIGKDKFGEEMKKNAQAAGVTAHYYEDEAAPTGTCAVCVVGGERSLVANLSXANCYKSEHLKKPENWALVEKAKYIYIAGFFLTVSPDSIQLVAEHAAANNKVFLTNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 14372 - protein, 482 aa, Shewanella sp. ANA-3
MLLKDPSLLRQQCYINGQWCDAQSKETVAIANPATGAVIASVPVMGQAETQAAIAAAEAALPAWRALTAKERGVKLRRWFELLNENSDDLALMMTSEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPVVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGIGEGVTTGPLINCAAVEKVQSHLEDALSKGATVVAGGKPHSLGGNFFEPTVLTNVDSSMRVAREETFGPLAPLFKFTDVDDVIKQANDTEFGLAAYFYGRDISLVWKVTEALEYGMVGVNTGLISTEVAPFGGMKSSGLGREGSKFGIEEYLEIKYICMSV

SEQ ID NO: 14373 - protein, 276 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAEVSIRDSFTRGKSN

SEQ ID NO: 14374 - protein, 337 aa, Triticum aestivum
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 14375 - protein, 266 aa, Chlorobium tepidum TLS
MARLSIGFIGTGRIAQALISGLSHDPNIVICGYDKMPDALHSVSLQYGVNTEESIESLARDAEIIVIAVKPYQMAEVLAELKPALHGQHLIVSVAAGISTGFIESNCPEGTRVVRVMPNTPAFVGEGMTALCKGMHATADDLLVAERIFNAIGKTAIIEESGMDAATAVSGSGPAYMFRIIDSLAEGGEACGLDRETAQLLAAQTMLGAAKMVLSGHKSPEELVREVTTPGGTTEAGLKAMDERDLRGALIDTVRAAAARSKELMK

SEQ ID NO: 14376 - protein, 394 aa, Nicotiana sylvestris
MTTKNRQIKNFTLNFGPQHPAAHGVLRLVLEMNGEVVERAEPHIGLLHRGTEKLIEYKTYLQALPYFDRLDYVSMMAQEHAYSLAVERLLNCEVPLRAQYIRVLFCEITRILNHLLALTTHAMDVGALTPFLWAFEEREKLLEFYERVSGARMHASFIRPGGVAQDLPLGLCIDIDSFTQQFASRIDELEEMLTGNRIWKQRLVDIGTVTAQQAKDWGFSGVMLRGSGVCWDLRKAAPYDVYDQLDFDIPVGTRGDCYDRYCIRIEEMRQSVRIIVQCLNQMPSGMIKADDRKLCPPSRSRMKTSMESLIHHFELYTEGFSVPASSTYTAVEAPKGEFGVFLVSNGSNRPYRCKIRAPCFAHLQGLDFMSKHHMLADVVTTIGTQDIVFGEVDR

SEQ ID NO: 14377 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 14378 - protein, 330 aa, Oryza sativa (japonica cultivar-group)
MCWFNRKGPSGFSGASTAEEVTAGVDARGLVAVITGASSGIGLETARVMALRGVRVVMAVRNVAAGHRASEAIRAEIPGAGIHVLEMDLSSMDSVRRFATEFEALNLPLNILINNAGIMTRNCTRSIDGLELQFATNHIGHFLLTNLLLENMKRTSSKTGVEGRIVNVSSSAHFVTYPKGICFDKVKEPSRFISLIAYGQSKLANILHSTELSRVLKNNRETVEYEQEDGVNISANAVHPGVVTTNLFRHRTIINALVKSIGRFVHKTVEQIILSFLTIHKGRARFRARYEADLLRFLGKWKKNEIRIGIPSIGFHGGDGFRRCQVAERL

SEQ ID NO: 14379 - protein, 230 aa, Oryza sativa (japonica cultivar-group)
MWFFNFNRNGPSGFSGASTAEEVTAGVDARGLAAVVTGASSGIGLETTRVLALRGVRVVMAVRNVAAGHKAREAIRAEIHGAIVHVLEMDLSSMDSVRRFASEFDSLNLPLNILINNAGILSKDCIRSIDGLELHFATNHIGHFLLTNLLLENMKSTSRTTGVEGRIINVSSSGHILTYPEGICFDSVKDLSRFSTYIAYGQSKLANILHSTELARILKVVFLFAKHAYE

SEQ ID NO: 14380 - protein, 236 aa, Brassica napus
RFVQASALVSQPALYSKDLLREHTIGPAMVHPSETVKGSLWHDLQDPGVKRALFVRVGLQILQQFSGINGVLYYTPQILEQAGVGILLSNLGISSSSSSLLISALTTFVMLPAIAVAMRLMDLSGRRTLLLTTIPILIASLIVLVISNLVHMNSIVHAVLSTVSVVLYFCFFVMGFGPTPNILCSEIFPTRVRGICIAICALTFWICDIIVTYSLPVLLKSIGLAGVFGMYAVVCC

SEQ ID NO: 14381 - protein, 225 aa, Prochlorococcus marinus str. NATL2A
MLKTICASTEIELSKWITEKPVKKNQPIAIFSSCQRFGKGQAGRIWHAPKGGVWVSAAINREDSCENNSQLYGLAVALALVERIERIGVNVNIKWPNDLLVDGQKLAGILPRLFFRGGKLRLLRVGVGLNVFNNVPQEGISLKQIIGDKTMNINFWSSEVLLAIERSLDLLDNKNFLCSQVEQRLWSRKYIDKETGLKWDIKGIDSSGGLNLSKEDKVKVLSNYA

SEQ ID NO: 14382 - protein, 579 aa, Yarrowia lipolytica CLIB122
MATEHVEHAENAKQSPQPSFSGSESGRIGRYQIIKTLGEGSFGKVKLAYHLATHEKVALKIINRKTLAKSDMQGRVEREISYLRLLRHPHIIKLYDVIKSKDEIIMVIEFAGKELFDYIVQRGKMPEDEARRFFQQIISAVEYCHRHKIVHRDLKPENLLLDENLNVKIADFGLSNIMTDGNFLKTSCGSPNYAAPEVISGKLYAGPEVDVWSCGVILYVMLCGRLPFDDEFIPNLFKKISNGVYTIPPYLSAGAKHLLQQMLVVNPLNRITVQGIMEDPWFKQGIAEYLVPRDLKPDQVEIDDKVVGALSDTMGYDRDQVYEALKAPKSDGTEIRDAYDLMKENRQQLEKDSTVFDKVDESGKPKHQFSRKNPPALTFDSHHMPTIVDHSDLRTPNTTIAVLPSSLPAYHRANMMAHGPATLRKLNPISSRKSKTRWHFGIRSKSYPLDVMGELYRALKNLGAEWAKPSENDLWTIRVRWRYTPEKDESDSTTKPDSGLLKMQIQLYLLEQNSYLVDFKFDGWECETESGEIKTRDVAQVSNSKSANETFTFSAYPFLHLATRLIMELAVSSQKESEK

SEQ ID NO: 14383 - protein, 219 aa, Arabidopsis thaliana
MMNRLFGKPKQEANALQTLDKLNETLEMLEKKEKVLLKKAGAEVEKAKEYSRAKNKRAAIQCLKRKRLYEGQVEQLGNFQLRIHDQMIMLEGAKATTETVDALRSGASAMKAMQKATNIDDVDKTMDEINEQTENMKQIQEALATPMGAAADFDEDELAAELDELESEELESQLLQPATTAPPLPSVPVPAGRQPARPVPQKRTAEEEELAALQAEMAL

SEQ ID NO: 14384 - protein, 331 aa, Edwardsiella tarda
MTIKVGINGFGRIGRFVFRAAQERNDIEVVGINDLIDVDYMAYMLKYDSTHGRFNGTVEVEGGNLIVNGKTVRVTAERNPEDLKWDEIGVDVVAEATGLFLTDETARKHITAGAKKVVLTGPSKDATPMFVNGVNFDTYAGQDIVSNASCTTNCLAPIAKVLNDKFGIESGLMTTVHATTATQKTVDGPSAKDWRGGRGASQNIIPSSTGAAKAVGVVLPEVNGKLTGMAFRVPTANVSVVDLTVNLVNGASYEDICKAMKEASEGELKGVLGYTEDAVVSQDFIGEVCTSVFDAKAGIALTDKFVKVVSWYDNEIGYSNKVLDLIAHISK

SEQ ID NO: 14385 - protein, 451 aa, Shewanella sp. ANA-3
MNKLIAFLKERKITEVECVISDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYEQKGWEPVIAPEMEFYLTSRSDDHDLPLKPPIGRSGRPEAGRQSFSIDAANEYDPLFEDMYDWCELQGLDIDTLIHEDGPAQMEINFSHGNPLSLADQVFVFKRTLREAALKHNVCATFMAKPVTDEPGSAMHIHQSVINKETGKNIFTNEDGTQSPLFLSYIAGLQKFIPELLPLMAPNANSFRRFLPGTSAPVNLEWGVENRTCGLRIPESSPQNRRIENRIPGADANCYLAIAASLLCGYIGMVEGLKPSTPVQGKSNESRSNNPHCLPLTLEEALAAMEESDACKEYLGEAFTTGFVAVKQAELENFRRVVSSWEREFLLLSV

SEQ ID NO: 14386 - protein, 180 aa, Glycine max
TLHQPTAGIVKQLRLENFMCHSKHETEFGNHVNFITGQNGSGKSTILAALCVAFGCRAKETQRTSTLKDFIKTGATDAVIQVEIQNEGEGAFKPEIYGPVIIVERRISESTSSATLKDHQGRKVVSWKTDLLEIVEHFNDAVSRKISLDPLVDFAEAHGSQRIFITPHDTNSVRAGDRIK

SEQ ID NO: 14387 - protein, 79 aa, Prunus salicina
PWKPSNCSGSQFKDGKVYPQLRSKLKKSWPDVESGNDTKFWEGEWNKHGTCSEEKLNQMQYFERSHNMWRSYNITEVLK

SEQ ID NO: 14388 - protein, 241 aa, Xanthomonas oryzae pv. oryzae KACC10331
MGIRSMPAAVPLQRIPNFQSPIPSPTMSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 14389 - protein, 233 aa, Triticum aestivum
  misc_feature (110)..(110): Xaa can be any naturally occurring amino acid
  unsure (1)..(233): unsure at all Xaa locations
DTPAARRCACPGSWQRTPCPPLRQETASSPRSSTLFQRHEGLARYAAISQDNGLVPIVEPEILLDGEHGIERTFEVAQKVWAETFYQMAQNNVMFEGILLKPSMVTPGAXECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 14390 - protein, 231 aa, Nicotiana alata
MKMASNSATSLFLTLFLITQCLSVLTAAQDFDFFYFVQQWPGSYCDTKQSCCYPKTGKPASDFGIHGLWPNNNDGSYPSNCDSNSPYDQSQVSDLISRMQQNWPTLACPSGTGSAFWSHEWEKHGTCSESIFDQHGYFKKALDLKNQINLLEILQGAGINPDGGFYSLNSIKNAIRSAIGYTPGIECNVDDSGNSQLYQVYICVDGSGSNLIECPVFPRGKCGSSIEFPTF

SEQ ID NO: 14391 - protein, 173 aa, Prunus salicina
FCYVMSSGSYDYFQFVQQWPPTNCRVRIKRPCSKPRPLQNFTIHGLWPSNYSNPKMPSNCNGSQFDARKVYPHMRSKLKRSWPDVESGNDTRFWEGEWNKHGRCSEQTLNQMQYFETSHDIWMSYNITEILKNASIVPSPSATQTWKYSDIVSPIKAATKRTPLLRCKRDKNN

SEQ ID NO: 14392 - protein, 187 aa, Prunus salicina
LSFIMSAAHGSYDYFQFVQQWPPTNCRVRKQPCSKPRPLQIFTIHGLWPSNYSNPTKPSNCNGSQFDDRKVYPQLRTKLKRSWPDVEDGNDTKFWEREWNKHGTCSEGRLNQMQYFERSHNMWMSYNITEILKNASIVPHPTRTWSYSDIVSPIKTATKRTPLLRCKPDPAQPKKGKRAQPNSPPQS

SEQ ID NO: 14393 - protein, 104 aa, Zea mays
  misc_feature (43)..(43): Xaa can be any naturally occurring amino acid
  unsure (1)..(104): unsure at all Xaa locations
PGIFFFLDETLLEQNLCRLIEPHSRVGIAHIAEMIELPIAPVXKKLSQMIVDKKFAGALDQGAGCLLIFEDFKAEEIFPAPLETLLNVGKVVGSPYVRAAKIMA

SEQ ID NO: 14394 - protein, 279 aa, Bacillus cereus ATCC 14579
MSIQNISFLGAGSIAEAIIGGLLHANVVKGEQITVSNRSNETRLQELHKKYGVKGTHNKKELLTDANILFLAMKPKDVAEALTPFKEYINNNVLIISLLAGVSTDSIRKLLQKDVPIIRAMPNTSAAILKSATAISPSKHATAEHIRTATSLFETIGLVSVVEEEDMHAVTALSGSGPAYIYYVVEAMEEAAKKIGLKEDVAKSLILQTMIGAAEMLKASDKHPSILRKEITSPGGTTEAGIEVLQEHKFQQALISCITQATKRSHNLGKTLEQLTKEK

SEQ ID NO: 14395 - protein, 337 aa, Thermus thermophilus HB27
MKTYALVMAGGRGERLWPLSREDRPKPFLPLFEGKTLLEATLERLAPLVPPERTLLAVRRDQEAVARPYAHGIRLLLEPLGRDTAGAVLLGVAEALKEGAERLLVLPADHYVGDDEAYREALATMLEAAEEGFVVALGLRPTRPETEYGYIRLGPREGAWYRGEGFVEKLSYTKALEYIRKGYVWNGGVFAFAPATMAELFRRHLPSHHEALERLLAGASLEEVYADLPKISIDYGVMEKAEKVRVVLGRFPWDDVGNWRALERVFSQDPHENVVLGEGRHVALDTFGCVVYADRGVVATLGVSGLVVAKVGDEVLVVPKDRAREVREVVKRLEAQE

SEQ ID NO: 14396 - protein, 470 aa, Bacillus subtilis subsp. subtilis str. 168
MNSAHNKNETTFQRSMKSRHLFMLSLGGVIGTGLFLSSGYTIQQAGPAGTILAYLVGAGIVYLVMLCLGELSVAMPVTGAFHTYAAKYIGPGTGFTVAWLYWLTWTVALGSEFTAAGLLMQRWFPHTSVWMWSAVFALFIFLLNAFSVKFFAESEFWFSSIKVLAIVLFILLGGSAMFGIIPIKGGEAAPMLSNFTAEGGLFPNGFVPILMTMLSVNFAFSGTELIGIAAGESVDPDKTIPKAIKTTVWRLSLFFVGTIFVLSGLIPIQDAGVIKSPFVAVFDRVGVPYAADIMNFVILTAILSAANSGLYASSRMLWSLSKEKTLHPTFAKLTSKGTPFNALVFSMIGGILSLLSSVFAPDTVYVVLVSISGFAVVVVWMGIAASQFMFRKRYIEAGNKVTDLKYRTPLYPFVPIAAFLLCLASVVGIAFDPNQRIALYCGVPFMAICYAIYYVKNRKSQPAADMTHSK

SEQ ID NO: 14397 - protein, 98 aa, Solanum demissum
MARSFSNSKILSAFVSDSVSAFLSRRGYAAASQGAVSGVAKGGVPRSNVMMQKSGEESVKTSWVPDPVTGYYRPEGQANEIDAAELRKMLLKNRSGSN

SEQ ID NO: 14398 - protein, 358 aa, Codonopsis lanceolata
MSCYKGKYADELIANATYIGTPGKGILAADESTGTIGKRLSSINVENIESNRWALRELLFCTPGALQYLSGVILFEETLYQKTAAGKPFVDVLKENGVLPGIKVDKGTVVLAGTNGETTTQGLDGLGARCAQYYAAGARFAKWRAVLNIGPNEPSQLAINENANGLARYAIICQENGLVPIVEPEILVDGAHDIAKCADVTERVLAACYKALNDHHVLLEGTLLKPNMVTPGSDSAKVAPEVVAEYTIRALQRTMPAAVPAVVFLSGGQSEEQATVNLNAINKYKGKKPWSLTFSFGRALQQSTLKAWAGKEENVAKAQAAFLARCKANSEATLGTYEGGASLSEGAAESLHVKDYKY

SEQ ID NO: 14399 - protein, 345 aa, Triticum aestivum
MEAAAAAACRGGVVLARARPGHPARRHGVGAGAGPAARRRFLVVASLGVAPSAPSRSAVAVAQEIAQAAYEDDVASVRVVLMMAFGPASTAVLPPPDDHVNTASVACVLEKKCAFGQRFLVVGDDPALGLWDPAKATALDWSEGHVWTATTDLPANRLVEFKFLLQDPSGHVRWQHGGYWALQITKASNALVVYEDWDDAGCQEVSEAALHLPIGAEETDMLLADDGRTDDDQETYEGFMHAEESPAAVGASLDAETIWVHGANRTQFTLQKDEKIPEELRRRANMAAAQNGSLASAGINGDDIILYKEAANTPARMFENDMVWMRKALQGLLRNLGFHIGTTKT

SEQ ID NO: 14400 - protein, 277 aa, Rhodobacter sphaeroides 2.4.1
MSVNSPVRPVMAADILARKGGEPIVCLTAYTTPMARLVDAHCDLTLVGDSLGMVVHGLPTTLGVTMEMMILHGQAVARGTSRSMLVVDMPFGSYEESPAQAFANARRLMAETGCAAVKLEGGQHMAETIRFLVARGVPVMAHIGLTPQAVNALGGYKVQGRGADAERVMEDAIAVAEAGAFSVVLEKVPDGLSQRITQRIAIPTIGIGASAHCDGQVLVLDDMLGLFADFRPKFVKRYGELGASADEAIATYAAEVRARRFPAPEHVFADELKGKAQ

SEQ ID NO: 14401 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 14402 - protein, 815 aa, Arabidopsis thaliana
MDLASNLGGKIDKSDVLTAVEKYEQYHVFHGGNEEERKANYTDMVNKYYDLATSFYEYGWGESFHFAQRWKGESLRESIKRHEHFLALQLGIQPGQKVLDVGCGIGGPLREIARFSNSVVTGLNNNEYQITRGKELNRLAGVDKTCNFVKADFMKMPFPENSFDAVYAIEATCHAPDAYGCYKEIYRVLKPGQCFAAYEWCMTDAFDPDNAEHQKIKGEIEIGDGLPDIRLTTKCLEALKQAGFEVIWEKDLAKDSPVPWYLPLDKNHFSLSSFRLTAVGRFITKNMVKILEYIRLAPQGSQRVSNFLEQAAEGLVDGGRILNLFLDKCFSGERFSRQCISSWPGSQSKRMRDGDGHRISAAKVLVENGVEDVLILEATDRIGGRIHKQNFGDVPVELGAGWIAGVGGKESNPVWELASRFNLRTCFSDYTNARFNIYDRSGKIFPTGIASDSYKKAVDSAILKLKSLEAQCSGQVAEEAPSSPKTPIELAIDFILHDFEMAEVEPISTYVDFGEREFLVADERGYECLLYKMAEEFLVTSHGNILDYRLKLNQVVREVQQSRNGVVVKTEDGSVYEANYVIVSASIGVLQSDLLSFQPLLPRWKTEAIQKCDVMVYTKIFLKFPQCFWPCGPGQEFFIYAHEQRGYFTFWQHMENAYPGSNILVVTLTNEQSKRVEAQSDQETMKEAMSVLRDMFGATIPYATDILVPRWWNNRFQRGSYSNYPMISDNQLLQNIKAPVGRIFFTGEHTSEKFSGYVHGGYLAGIDTSKSLLEEMKQSLLLQPLLAFTESLTLTHQKPNNSQIYTNVKFISGTS

SEQ ID NO: 14403 - protein, 356 aa, Glycine max
  misc_feature (144)..(144): Xaa can be any naturally occurring amino acid
  unsure (1)..(356): unsure at all Xaa locations
MHSKAALLSFLANKCSKIQTHTLSPMALNNGVPATGTGLIVSFGEMLIDFVPTVSGVSLAEAPGFLKAPGGAPANVAIAVSRLGGKAAFVGKLGDDEFGHMLAGILKENGVRADGITFDQGARTALAFVTLRADGEREFMFYRXNPSADMLLKPEELNLELIRSAKVFHYGSISLIVEPCRSAHLKAMEVAKEAGCLLSYDPNLRLPLWPSPEEARKQILSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 14404 - protein, 582 aa, Cryptococcus neoformans var. neoformans JEC21
MSGGSSLDEKTSSLDHGYKASTLAIVNSSSAAEKAGRPHFFIEESSSHGAFVGEQGGNGAQVTIQDVWGAPVETSSLLKSLGSIGLTLIYWPIGLLISLAGISVYLEFTSYFPSRSGAEVVYLEQAYRKPRFFFPVAFAVQTVILSFVSSNAIVLIGPYYEVVAEYIFKMTDHTPSDWESKGVGIAALTIIILPVFFSTNISLRLSNILGIAKIITLLIIIIPGFVALGGHFKVVPDPTANFHNAFEGTTNNGYNLSNALVNIIFSYGGYTNSFNVANEIKNPIRTIKYTANTAVIFVAVLYMLTNIAYFAVLTQEEIKGSTQVTATLFWEKLWGSKVSKGLTILPVLSASSNILNTIVGHSRMIREIGRQGVLPYPKFWVTTWPIGTPTGALFAIWFVSLIVIVVVPAGNAFNFIVALQNYPSSFFLVLMTLGLFIVRRDRRRLSLPRPEYRSWTIVVLFFLAANTFLIIMPWVPPTGGVNNSSFGFFYAASSLTGLGIVFLCGFYYVLWSKLLPKWKGYKLRQTVITLADGALTHKMVKVKNEDVDAWDVTHDPSGRLLNEDEDLVEINEEHASLRDLKE

SEQ ID NO: 14405 - protein, 131 aa, Arabidopsis thaliana
  misc_feature (91)..(91): Xaa can be any naturally occurring amino acid
  misc_feature (105)..(105): Xaa can be any naturally occurring amino acid
  unsure (1)..(131): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRXNKWVPCVEFEFEHXFFLPAETPVTGTDLGRFHLPSVKVEV

SEQ ID NO: 14406 - protein, 1014 aa, Aspergillus oryzae
MFTFTPLLGAQSSSSKASQSILELDGGIKILVDVGWDDTFDPLDLQELEKHVPTLSLILLTHATPAHIGAFAHCCKTFPLFTQIPVYATSPVIALGRTLLQDLYASSPLAATFLPKASISEPGASTSAASAAASAAASAAASAPEGEGGADASHSGRILLQPPTAEEIARYFSLIHPLKYSQPHQPLPSPFSPPLNGLTLTAYNAGHTVGGTIWHIQHGMESIVYAVDWNQARESVMAGAAWFGGSGASGTEVIEQLRKPTALVCSTRGGDKFALPGGRKKRDDLLLDMIRSTLAKGGTVLIPTDTSARVLELAYALEHAWRDAAGTGQEDNVLKEAGLYLAGRKANTTMRLARSMLEWMDENIVREFEAAEGVDAATGQSRANPGGQRSGQNQGKEEKGTGPFTFKHLKIVERKKKLEKILNNQAPKVILASDTSLDWGFAKESLRLVAGGPNNLLLLTESFHKERLADNQEDPYRKTLGNMIWEWYEERKDGVALEKSSDGEMIEQVHSGGRELSWSDVHRAPLDPGDQLLYQQYLATKRQLQDTSQARGQENLDNAADALDDRSSSTSEDSETEQQGRVLNFSTSLAHSNRNKLGLSDEDLGVNILLRRKNVFDWDVRGKKGRERMFPYVAPRKKGDEYGEFIRPEEYLRAEEREEIDMQQRRSDSQTKLGQKRRWDETGPAGRRLSSSGAKRQQFPGKKDASTADDMSLTEDGEGADAALESEDEADSQTFEGPAKAVYQKASLTINARIAFVDFTGLHDKRSLEMLIPLIQPRKLILVGGMKEETTALATECKKLLAAKAGVDVSAADSAVIYTPVIGEVIDASVDTNAWMVKLSNSLVRRLKWQHVRSLGVVTLTAQLRGPELNPPEDAADSPSKKQKLLQEETSSPATAPTVDGTKPTADKSDVYPVLDILPANMAAGTRSMTRPLHVGDLRLADLRKIMQGAGHTAEFRGEGTLLIDRMVAVRKSGTGKIEIEATAQSAAAVGRGAGSFLDVKRKIYEGLAVVAGN

SEQ ID NO: 14407 - protein, 119 aa, Triticum aestivum
  misc_feature (73)..(73): Xaa can be any naturally occurring amino acid
  unsure (1)..(119): unsure at all Xaa locations
MAAPAKASWMVAMSVGTVEALKDQAGLCRWNYTLRSIHRAAKANVRSGVSQGNKQLPASVSAVAERRPAEKAXEEGLRTVMYLSCWGPKLGVVVARSVVFVAASNLVLLSIHGLRLGSG

SEQ ID NO: 14408 - protein, 259 aa, Asparagus officinalis
MLAIFHKGFAHPPQELYSPEHCRRQSKSPEEILRDFHSAHPSDTFCISFSTGAALASNSSAGAHSPCVSFHQRLFSSLDEVYCMFVGSLDNLSSLIRQYGLCGRSTSEAMLVIEAYRTLRDRGPYPADQVLKDLNGSFAFVIYDNKTGSVFAAQSYDGRVPLFWGVACDGSAVICDDLNVMKSGCGKSFAPFPNGCMFSSEGGLKSFERPMNKMKAVPRVDSEGTMCGSFFKVDSCTKISTMPRVGSSADWTSWEDSHK

SEQ ID NO: 14409 - protein, 188 aa, Prunus salicina
LCFIMSTGDGSYDYFQFVQQWPPTNCRVRTKCSNPRPLQIFTIHGLWPSNYSNPTMPSNCIGSQFNESKLYPHLRSKLKRSWPDVEGGNDTNFWGKEWNKHGKCSEQTLNLMQYFQRSHEMWNSFNITDILKNASIVPSPNQTWTYTDIVSALKTRTKRTPLLRCKPDPKAKSQPTRQAKSQPTSQPK

SEQ ID NO: 14410 - protein, 171 aa, Prunus salicina
LCFVMSTGSYVYFQFVQQWPPTTCRVRWKPCSQPRPLQFFTIHGLWPSNYSNPKMPSNCIGSQFNFTKVYPHMRSKLKISWPDVESGNDTKFWEGEWKKHGTCSEERLNQMQYFERSFLMWKSYNITEILKNASIVPSATQTWKYSDIVSPIKAVTKTTPALRCKRDRATN

SEQ ID NO: 14411 - protein, 337 aa, Triticum aestivum
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPTVDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 14412 - protein, 121 aa, Prunus salicina
PKRPSNCAGSRFNFTKVYPQLRNKLKISWPDVEGGNDTKFWEGEWNKHGTCSAERLNQMQYFERSHDMWMSYNITKILKNASIVPSATQTWSYADIVSAIKTATKRTPLLRCKPDPQPNKP

SEQ ID NO: 14413 - protein, 471 aa, Burkholderia xenovorans LB400
MSKSVADVVQLVKDEDVKFVDFRFTDTRGKEQHVSVPVSAFDEDKFESGHAFDGSSIAGWKGIEASDMLLVPDANTAFIDPFYEESTLVLTCDVVEPADGKGYERDPRSLAKRAEAYLKSTGLGDTAFFGPEPEFFIFDSVKWGTDQSGTFVKIGSEEAPWSSALDFEGGNTGHRPGTKGGYFPVAPVDTFQDIRSEMCLLLEQIGIPVEVHHHEVAGQGQNEIGTKFSTLVQRADWLQQMKYIIHNVAHTYGKTATFMPKPVVGDNGSGMHVHQSIWKDGTNLFAGNGYAGLSEFALFYIGGIIKHARALNAITNPSTNSYKRLVPHFEAPVKLAYSARNRSASIRIPHVSNPKGRRIETRFPDPMANPYLCFSALMMAGLDGVQNKIHPGEAADKNLYDLPPEEDAKIPTVCAGLDQALDSLDADREFLTRGGVFTDSMLDAYIELKTGELQRYRQSVHPIEFEMYYSL

SEQ ID NO: 14414 - protein, 1137 aa, Prosthecochloris aestuarii DSM 271
MANGILFRSIPHRLRHIFLTFFFIHNYFYRDFMPKTRTTGQPEPQWYKDAIIYEAHVKTFFDSNNDGVGDFEGLRQKLPYLESLGITAIWLLPFYPSPLRDDGYDIADYMDINPDYGTIDDFRAFLNEAHERGLKVITELVINHTSDQHAWFQRARRAEQGSDERNFYVWTDDPKKYSETRIIFQDFESSNWTWDPIAGQYFWHRFYHHQPDLNFENPSVEKALYKVLDYWLEMGVDGLRLDAVPYLYEEEGSNCENLPRTHEFLKRLRKHVDDKFPNRMLLAEANQWPEDAAEYFGDGDECHMNFHFPLMPRMYMALEMEDRFPIIDILDQTPEIAETCQWASFLRNHDELTLEMVTDEERDYMRRVYAHDPKARINLGIRRRLAPLMSNDRRKIELMNIMLLSLPGTPVLYYGDEIGMGDNFYLGDRDGVRTPMQWNGDRNAGFSRANPQQLQLPVIIDPEYHYEATNVEVQDSNINSLLWWTRHMLSTSRRYKALSRGDIRFIACQNPQILIFSRTFEDETMLCIINLSRNAQAATVDLSEYEGHTPEEVFSLSHFPGITSRPYTVTLGPYGYFWFKLIRTEEEIGSRRYVDKPFAQVASLKDLFAGKALERLETKVLPEYIRGCRWFGGKARKIVRVSVEEHIPVTACDNTVYMIVEVRYPSGSNDTYQLPVTFLPAGEFNPDDDYFLKQVVCSVKIGDEEGYLCDSAYQKSFHSFLLDTIVSSKGLKGSTGKLTGEKGSRVEEFLETQDDGEMNSVLFGAEQSNTSIMYGDRLCLKIYRKISSGVSPEVEICRMLTEKTSFESSPAYLGALHFTRSRKDQCSLGILQNFIPNEGDAWSQTLHFVHRYYEDVLVMLPQISEVPVLPSTGGESVEMPEIIHGLIGEPYLEMVSRLAERTAGMHLALASPDLGQDFIPEPFTTLYQRSIYQSMREQVKRGMVLLREQMGGVAEEYQGLAAGLLKREGEILEQLSHIKARKIAASKIRIHGDYHLGQVLWTGKDFVIIDFEGEPARSLSERRIKRSAFRDLAGMMRSFHYAAFNVLIQDRSIRQEDVERLEPWAELWSFYTGQHFFDVYEDAVRGQGLIPEDVKEQHLLLRAYLMDKAIYELNYELNNRPEWVGIALKGLSRLLEL

SEQ ID NO: 14415 - protein, 396 aa, Moorella thermoacetica ATCC 39073
MQLAQRAAGISPSPTLAIDAQAKAMKAKGVKVINFSAGEPDFGTPEHIKQAAIDALAAGFTRYTPVAGIPELRQAICASLAARGVTYEPADIVVSCGAKHSLYNAMQVLLNAGDEVILSAPYWVSYYEQVKLAGGVPVVVTTGPDTGFKLTPGLLEAAITPRTRLLILNSPCNPTGAVYSREELAALAEVIVARDLIVISDEIYAALLYDGLTHTSIASLAPEVKERTILIDGVSKTYAMTGWRIGYAAAPRPVAKAMTDLQSHSTSNPTSIAQKAAVAALTGSQEAVEMMRREFEQRRNRILAGLRELPGIECNQPGGAFYVFPYIGKLFGRKFRGRVLGNSTDVATALLNEFQVAVVPGVAFGAEPYLRLSYATSMDQIEAGLERLRAFVTELE

SEQ ID NO: 14416 - protein, 445 aa, Nocardioides sp. JS614
MTAGATLPTAASAALFERARAVTPGGVNSPVRAFNAVGGTPRFIRSARGAWLTDADGNEYVDLICSWGPMLLGHAHPEVQAAVSAAVARGTSYGAPTEPEVELAEEIAARAPVERVRFVSSGTEATMSAIRLARGFTGRDVVVKFAGCYHGHVDSLLASAGSGLATFAVPGTPGVPESSTALTLVLPYNDRAAVEKAFAEHGDRIACLITEAAPGNMGVVPPDADGSGGGFNGFLAETCARHGALFVSDEVMTGFRASRQGQWGLDGAVEGWRPDLMTFGKVMGGGFPAAAFGGRADVMSRLAPEGPVYQAGTLSGNPIATTAGLATLRLATDDVYAHIGAAADTIKTAASDALSRAGVEHVVQAAGTMFSVFLTAGPVRDFADASRTDVAAYAAFFHAMLDQGVYLPPSAYEAWFLSSAHDDRAVQTVLDALPTAARAAAAAQT

SEQ ID NO: 14417 - protein, 385 aa, Caulobacter crescentus CB15
MVHPVFDNLPTTIFERMSGLARQYGAINLGQGFPDDQGPLPVREAAARALIEGSNQYPPMRGLPELRAAVAGHYGRTQDLTLDPDTEIVVTSGATEALAAAFTSLISPGDEVVLFQPLYDAYLPLVRRAGGVPRLVKLSPPHWRFERAMLEAAFSNRTRMVVLNSPLNPAGVVAPDEDLALLAEVCVRHDVVAVCDEVWEAVVFDGRRHRPLMSFPGMRERTVKIGSAGKLFGMTGWKVGFLCAAPPLARALAAAHQFLTFTTPPNLQAGVAWGLDNHRAWFDDMPANLQRSRDRLTAGLRDAGYVVLESQGTYFLNVDLAASGIALDDVTFCERCVTEHGVAAIPVSAFFAEDPVTTVVRLCFAKADATLDEAVRRLAAAKAAL

SEQ ID NO: 14418 - protein, 665 aa, Arabidopsis thaliana
MVAPPLLSSHEFRPLSWHPRPLQQELICLGRIITMSAFVSKYEDELIKTAKYIATPGRGILAADESTETIGKRFAGINVENTESNRQAYRELLFTSPGSYPCLSGVILFEETLYQKTSDGKPFVDLLMENGVIPGIKVDKGLVDLAGTNGETTTQGLDSLGARCQQYYEAGARFAKWRAFFKIGATEPSVLSIQEDARVLARYAIICQENGLVPIVEPEVLTGGSHDIKKCAAVTETVLAAVFKALNYHHVLLEGTLLKPNMVTPGSDSPKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYSWIEIFSSLLKSGLKVFMWSAKKFPKIKIVTSEIDNGLDEEFRVIPWYGRVWGQIFWHRRGLGHCGPAALGVPSISNHPFALSEVDKFPRVLLLTRMTNSNSIFLVDITYIFSIVAAKLVSLALQKATMSAFVGKYADELIKTAKYIATPGKGILAADESTGTIGKRFASINVENIESNRQALRELLFTSPGTFPCLSGVILFEETLYQKTTDGKPFVELLMENGVIPGIKVDKGVVDLAGTNGETTTQGLDSLGARCQEYYKAGARFAKWRAIP

SEQ ID NO: 14419 - protein, 161 aa, Halobacterium sp. NRC-1
MTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 14420 - protein, 321 aa, Xanthomonas axonopodis pv. citri str. 306
MDDRTLLAKLAGGRLSGDALARDAGLTRAAVWKRIQNLRAAGVDIEGRAGDGYRLATPLDLLDATRIRAGMAPGAAAGLAALDVAWTLDSTNTTLLAQPAPEQGVAVLLAERQTGGRGRRGRQWTSPLGAHIYLSASRRFNGGLGQLAGLSLAVGVAVAEALRGCGFADVGLKWPNDLLARQRKLGGLLIEGGGEMAGNARAVIGLGLNVHMPASAAASIDQPWVDLDTLAGSPVSRDRVTAAVLSGLLPALDLFEAQGLAPFLGRYADLDVLSGRAVQVEEAGNRHTGVALGLAADGALRVQLGETVRLFHSGEVSVRPA

SEQ ID NO: 14421 - protein, 425 aa, Kineococcus radiotolerans SRS30216
MRETGPPRTRTKQEEPVSAPDLAPVRPGRALLLENIHADARTLLSEAGWEVETASGALDEAELAERLDGVSLLGIRSQTQVTAKVLEAATDLRAVGAFCIGTNQIDLFAAAAHGVAVFNAPYSNTRSVVELALAEIIALTRRLTVKDRAMHEGVWDKSAAGSHEVRGRRLGIVGYGNIGSQLSVVAEALGLSVFFYDTTDKLALGNARRCGSLHELLEIVDVVTLHVDGRSSNLGFFGEAEFSRMRPGSIFLNLSRGFVVDHEALSRHIRSGHIAGAAIDVFPTEPKGSGQGFESELRGLPNVILTPHVGGSTEEAQEDIGRFVAAKLRDYALHGATTLSVNLPTLGTETTPGTVRLAHLHRNVPGVLANINKVLAEAGVNIEGQQLATRGDLGYVVTDIAAHASEDVGRRLRELPETVRVRQLG

SEQ ID NO: 14422 - protein, 175 aa, Triticum aestivum
MVPTVMASLATSVAPFQGLKSIAGLPVSRRSNGASLGSVSNGGRIRCMQVWPIEGIKKFETLSYLPPFSTEALLKHVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESVKA

SEQ ID NO: 14423 - protein, 481 aa, Rhodobacter sphaeroides 2.4.1
MRRLRNVKIVATLGPASNDYATIRALFEAGADVFRLNMSHGSHDDIRARHQMLRQIEADTGTPVCILADLQGPKLRVGTFANGSEELVERGRFRLDLDPAPGTAERVNLPHPEIFAALEPGSSLLVNDGKIRLEVADCGPDFADCIVTVGGTISNRKGVNVPDVVLPLAALSEKDRRDLEFVCELGVDWLALSFVQRPEDVEEARSLARGRAAILSKIEKPAAVKAYDAILAVSDGIMVARGDLGVELPVQAVPPIQKRLVRGARAAAKPVIVATQMLESMIDSPMPTRAEVSDVATAIYEGADAVMLSAESAAGSYPIEAVMTMNNTAISVESDPVYRDIIEASRAAKRASVADAIVAAAREIAETTPIKAICCFTQTGKTVSLVARERPRVPILALTPLVETARRLSLTWGTHCVVTAPQERFKGAVICAARAALSDGFAQEHEQIAVVAGVPFNVRGTTNILRVAPCDERLIYSGDPE

SEQ ID NO: 14424 - protein, 181 aa, Arabidopsis thaliana
MSGITYQILFLLLLASVSLSPVRCLGYGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 14425 - protein, 467 aa, Lycopersicon esculentum
MAIFLIIFVVFFGFCILSTPLFRWIDIVYNKKNLPPGTMGWPIFGETREFLNQGPNFMKNQRARYGNFFKSHILGCPTVVSMDAGLNVYILNNEAKGLIPGYPQSMLDILGKCNIAAVHGATHKYIRGALLSLINPTMIKDHILPKIDKFMRSHLSGWDNCNVIDIQQMTKEMAFFSSLDQIGGFATSSSIAQEFRAGFLNIALGTISLPINFPTTNYYRGLQGRKTIVKLLRKIIEDRRGSKKIQQDMLGLMMNEEAKNRYTLSDEELIDQIITIMYSGFETVSTTSMMAVKYLHDHPKALEEIRKEHFAIREKKSLEDPIDYNDFKAMRFTRAVIYETLRLATIVNGVLRKTTQDMELNGYMIPKGWRIYVYTRELNYDPLIYPDPYTFNPWRWLENNLDHQSSFLMFGGGTRLCPGKELGVAEISTFLHYFVTRYRWEEVGGNKLMKFPRVEALNGLWIKVSAY

SEQ ID NO: 14426 - protein, 1116 aa, Xanthomonas campestris pv. campestris str. ATCC 33913
MNAVPALQADAEQSAVVADQLWYKDAIIYQVHVKSFFDSNDDGIGDFPGLISKLDYIAELGVDTIWLLPFYPSPRRDDGYDIAEYMAVHPDYGTIADFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLESVLEVMRFWLDRGVDGLRLDAVPYLIERSGTSNENLPETHAILRKIRATLDAEYPDRMLLAEANMWPEDTQQYFGQNADECHMAFHFPLMPRMYMAIAREDRFPITDIMRQTPEIPETCQWAIFLRNHDELTLEMVTDSERDYLWQTYASDRRARINLGIRRRLAPLLERDRRRIELMTSLLLTMPGTPVLYYGDEIGMGDNIHLGDRDGVRTPMQWSIDRNGGFSRADPAALVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDTEESAALLPHLATLEGEILPAWLSARRWFSAKDQALKSVRISRRTPLPGDEPMSLLELDVELEDGHHECYMLPVGIVWEREHPSTLAEQLALARVRQGREVGYLTDAFALKPMVRGVIDALRHDAALDFHDGDDASQQGQVRFESTPALAALEIPDDPEIRWLSAEQSNSSLVVADKAVFKLLRHVATGANPEIEIGRRLTEMGYANAAPLLGSVSRVDAQGTITTIALLQGFIRNQGDAWRWTLDHLARSFDEYATAQTDEARNEAVAGYDAFAAVVGKRLAELHEALSRSTDDADFAPQRIDLPTANDVVGGVARQVEEMWETVHARLGATDDAAEREALESVLAERPQLDALLAKAPSVLAESLLTRVHGDFHLGQILVAFDDVVLIDFEGEPAKPLAERRAKASPLRDVAGFLRSLDYASEVSARGEEGTAARAGVGVDAHLDDFLVEFRRRSTQSFLDAYHAVLDASAHPWIAPAAFNAATLLFLVEKACYEVRYEAANRPGWLMVPIQGLRRILQRARAGAGDT

SEQ ID NO: 14427 - protein, 768 aa, Triticum aestivum
MDRLPSGGQTLLLLVVATLTLQHSATAYESESSGSIRMARPDCPDKCGSVSIPYPFGTGKGCFQEPFDVTCNATGPYLASTRVRILDINLAMGEIRVLNPHIAWECNYTNGTNSSGSDGLTLDPFHKLSNTKNKLISIGCATLGLILGATKGKNQLEFPIVNTCFSFCTDASSVDDSKECIGMGCCQTPFPGNISSFNTGSAPLPSLYNSTNQSFSPCSYSFVTEEDWFKFDRSYVSSTNFATKYTDGVPLVLDWVVGNKSCSEATKMGSQYACQAKNSQCINVSNGPGYRCNCSQGYEGNPYLQGGCQDINECEPPNQSLYPCQGKCTNTVGNYTCFCPSGFRSDDPKSIPCVPADPKKALKVVLGISFSAIFLMVCIFALRAEYQKRKLAKEKDKFFDQNGGQILYRQIMSKQVDTLKIFTQEDLKKVTNDFDKSRELGRGGHGTVYKGILKDDRVVAVKRSKIMNVTETDEFVQEIIILSQTDHRNVVRLLGCCLEVEVPILVYEFIPNGTLFEFIHRSYGSPPPSLDTRLRVAQESAEALAYLHLSMNHPIVHGDVKSMNILLDENYMAKVTDFGASRTLPKDAAQFMTLVQGTLGYLDPEYLQERQLTEKSDVYSFGVVLLELITGKTAIYNDGPKEGKSLVWSFLLAMKEDSLEDILDPSIVRAGTETLLGEVAELGRMCLGPIGEERPSMTQVADRLKALRSTWREELVLDRAVTEHMVVHMPPVAAPMPWDLASSSSGAPSTVPYMSGMGIEAPRWYSFI

SEQ ID NO: 14428 - protein, 236 aa, Bdellovibrio bacteriovorus HD100
MKKIAVVTGANRGLGLALSEALAQRGFKVLMAMRNPDKAQKTLNGLTMKGLDVVPMKLDLSQEKSITDFVEVVKREYGFVDVLINNAGILIDSEDGGNSSLFKTKASTLQKTFVTNTLGPFLLTQKIFPLMKQEGYGRIVNVSSGMAQLSEKQTASASYRISKTGLNMVTNLFASEVDGEDICVNSVSPGWVRTDMGGPHADRSVEQGIKGLLWAATLPKGGPNGGFFQDGEAINW

SEQ ID NO: 14429 - protein, 297 aa, Xylella fastidiosa Ann-1
MMQPPINVHTPHSSAQLTLLPPKHLNQLESHGMESRLFNTPAKKAFGQHFLVDRYYIDRIIHAINPQPNDHIVEIGPGQGAITLPLLKCCGSLTAIELDRDLIAPLTAAATPIGKLDIIHRDVLTVDLSILAKQGNKKLRMVGNLPYNISSPILFHVLQQAAIIADMHFMLQKEVVDRMAAPPGSKVYGRLSVMLQAWCEVTTMFVVPPDAFQPPPKVNSAITRLVPRDPTTIRIADTKRFSDIVRAAFGQRRKTLRNSLADICTPAHFEHAGIRTNARAEQLEVTEFIALANAKNT

SEQ ID NO: 14430 - protein, 152 aa, Malus x domestica
ACNSNPTPCKDPPAKLFTVHGLWPSNWNLPDPIFCKNTTITPQQIGHIEAQLEIIWPNVFNRTNHLVFWNKQWNKHGSCGYPIINDEIQYFETVIKMYIIKKQNVSKILSRAKIKPEGKNRTRTEIINAISISTNNMTPKLKCQKNNGTIEL

SEQ ID NO: 14431 - protein, 491 aa, Candida albicans SC5314
MAPKLNNPNLFQNKPFINGQWYDSKSTSTFKVYDPATQELIIELPDQTPEEIDEAIAITHKAFQTYQRTPVYERAKWLRRMYELMIENLQDLATLITWENGKCLADALGEIKYAASYFEWFSEECKRNYGHTIQPSNQNNKVITYKQPVGPVGLLCPFNFPSAMGARKAAPALAAGCTCILKPDGQTPLSSLALAYLAQQAGFPDGCFNVVLTSVTNTPMCGLKFCQSPKLKKISFTGSTNVGKLLMQQSSSTLKKLSMELGGNAPIIVFNDCNLDLAVDQSITSKFRSLGQTCVCANRIYVEKGVYDEFCNKFVEKVNQFKIGNGFEPGVTHGCLINTKAIEKVEDHVQDAVEKGAKLIVEGGRLPQLGENFYSPSVVKDVTQDMKVVKEETFGPLAAIIPFDSKEQVLQWCNDTPYGLASYIFSENLNTVWYMSEFLENGMVSVNTGLFTDAALPFGGVKESGFGREGSLYGMDDYTVIKSITLGNVYN

SEQ ID NO: 14432 - protein, 954 aa, Vibrio parahaemolyticus RIMD 2210633
MTELLQSLSTQNEFVGRHNGPKLSDQQKMLEAINAVSLDALISETVPANIRLEQPMTLAEAKSEADMLATMKQFAKQNQVKRTFIGQGYYNTFTPNVILRNVLENPGWYTAYTPYQPEISQGRLESLLNFQQMVIDLTGMEIANASLLDEATAAAEAMTLCKRAGKSKSNVFFVADDVHPQTIEVVKTRAKFIGFEVLVGSLESLPEQDVFGALVQYPSTTGEVRDLTDIIAKAQANKTLVTVATDLLACTLLKPAGEMGADVAIGSAQRFGVPMGYGGPHAAFMATRDKHKRTMPGRVIGVSIDAKGNQALRMAMQTREQHIRREKATSNICTAQALLANMASFYAVYHGAEGLRTIARRTHHMTAILAAGLTKGGFELAHNSFFDTITINTGEKTQDLYTKALAADINLRVLPGKLGISLDETTTVADVEALFAIFGVKEDVTALSTEVAGNEFAAIPEALRRTSEYLTHPVFNTYHSETQMMRYLKQLENKDFSLTHGMIPLGSCTMKLNAAAEMIPITWPEFGSIHPFAPAEQAAGYAALAKDLKEKLCEITGYDAFSLQPNSGASGEYAGLIAIQRYHESRGEGHRNVCLIPSSAHGTNPATASMVSMKVVVVKCDDEGNIDIDDLAAKIEKHKDNLSSIMITYPSTHGVYEEKVKEVCEMVHAAGGQVYLDGANMNAQVGLTSPGFIGSDVSHLNLHKTFCIPHGGGGPGMGPIGVKSHLAPFLPGHIENGVEGEDFAVSAADFGSASILPISWAYIAMMGEAGLSNATKVAILNANYVMERLRPHYPVLYRGKNGRVAHECIIDIRPLKEETGISEEDIAKRLMDYGFHAPTMSFPVAGTLMVEPTESEDLAELNRFCDAMISIREEMTKVKNGEWPLENNPLVNAPHTQVDLSAEEWDRPYSRELGCFPSKATKSWKYWPTVNRVDNVYGDRNLICSCPSIDNYED

SEQ ID NO: 14433 - protein, 353 aa, Ralstonia metallidurans CH34
MKAAVYYGPQDIRCTDIPDPVIRSDHEMLVKVTATSICGSDLHLYRGALDGIMEKGKSQTGHELIGEVVEVGKSVGRFKQGDRVSMGYSVSCGHCYMCEVGQTAHCETTKNAVYGFGIPFGSINGTHAEALIVPHADGHAMNVPKGIPDEAAVTLSCNLPSAIIANRLADIQVGENVALVGCGPTGMMTLDIALHRGPGRVVVLDKVAHRLDVVRKKGGVAIDANQEDWKEKALAETGGRGFDKVIEVVGYPETLQMCLDLVRPGGTVAAIGVFCDSTFNLNLADVFLRNISLHMNGFANAQPYMWEALRLMERGVINPQEYFSHAFELADVDKAFSVFHQKSDSAMKVLIRP

SEQ ID NO: 14434 - protein, 526 aa, Arabidopsis thaliana
MKQNETFDQEREDLYHTFDEEDEESQTESSVPSTPLSRNRSEDVPVPWPRSYRQSMDLLTGVTPPTSTSFVSSFRQRRQSSVFGSFTSSPSKQQLLIDKDEIQSSVVSSIKSFLASHLQLSVPGDLLTPQENRSCTFSQSVLNGINVLCGVALLTMPYAVKEGGWLGLFILFSFGIITFYTGILLKRCLENSPGIHTYPDIGQAAFGTTGRILVSILLYVELYASCVEYIIMMSDNLSRMFPNTSLYINGFSLDSTQVFAITTTLIVLPTVWLKDLSLLSYLSAGGVISSILLALCLFWAGSVDGVGFHISGQALDITNIPVAIGIYGFGFGSHSVFPNIYSSMKEPSKFPTVLLISFAFCTLFYIAVAVCGFTMFGDAIQSQFTLNMPPHFTSSKIAVWTAVVTPMTKYALTITPVMLSLEELIPSSSRKMRSKGVSMLFRTILVLSTLVVALTVPFFATVAALIGSFIAMLIALIFPCLCYISIMKGRLTNFQIGICILIVIIGIVSGCCGTYSAIARLIGEMT

SEQ ID NO: 14435 - protein, 392 aa, Arabidopsis thaliana
  misc_feature (164)..(164): Xaa can be any naturally occurring amino acid
  unsure (1)..(392): unsure at all Xaa locations
MASASFVKPNTLSSPWIGQRSFAHTSASSSPPPRVSFAIRAGAYSDELVKTAKSIASPGRGILAIDESNATCGKRLASIGLDNTEDNRQAYRQLLLTTPGLGDYISGSILFEETLYQSTKDGKTFVDCLRDANIVPGIKVDKGLSPLAGSNEESWCQGLDGLAXSRSAEYYKQGARFAKWRTVVSVPCGPSALAVKEAAWGLARYAAISQDNGLVPIVEPEILLDGDHPIERTLEVAEKVWSEVFFYLAQNNVMFEGILLKPSMVTPGAEHKNKASPETVADFTLTMLKRRVPPAVPGIMFLSGGQSEAEATLNLNAMNQSPNPWHVSFSYARALQNSVLRTWQGKPEKIEASQKALLVRAKANSLAQLGKYSAEGENEDAKKGMFVKGYTY

SEQ ID NO: 14436 - protein, 263 aa, Bdellovibrio bacteriovorus HD100
MKTILDFHDKKSKKQKISMITCYDYSFARIVADSDIDCILVGDSLAMVMLGHSTTLDVSASVMAHHTAAVVRGAGDKFVIADLPFMSYRKGLTANMTAVEKVMKAGAHAVKLEGAAGNLKLVRHLVDSGVPVMGHLGLTPQSVNQLGGFKVQGRDEKAQKKILEAALQLQDAGAFSVVLECVPSKLAKEITAALEIPTIGIGAGVDCDGQVLVLQDMLGMNQGFKPKFVKTYLDGFNTIKGALNQYHQEVSTEIFPSEKESYS

SEQ ID NO: 14437 - protein, 380 aa, Listeria ivanovii
QNRWRPELHDIQVSGIRAFNTRVTGIPDMIRLTLGEPDFPTPEHVKQAAIQAIQDNFTNYTPNAGMPELLEAASTYFQEKYNLEYNTNEIIVTVGATEAISVALQTILEPGDEVILPDPIYPGYEPLITLNKAHPIRIDTTETNFKLTPTQLRKHITPKTKALIIPYPSNPTGVSLTKEELVDLANVLREAGIFVIADEIYSELIYHEEHASIAPMLREQTIVINGLSKSHAMIGWRIGFLLAPEIITKQMLKIHQYSVTCASSISQKAALEAITNGKDDAFQMRTEYKTRANFTQDRLEKMGFTVVPPDGAFYFFVKLPDEITENSFDWAVKLAEEAKVAVVPGNAFSEKGDRFFRLSYATSFNKLAEALDRMAAFLSK

SEQ ID NO: 14438 - protein, 141 aa, Vibrio sp. Ex25
MALERTFSIIKPDAVERNLIGEIYNRIEKAGLRIVAAKMVHLTEDQASGFYAEHEGKEFFPPLKEFMTSGPIMVQVLEGENAIARYRELMGKTNPEEAACGTLRADYALSMRHNSVHGSDSPESAAREIEFFFPESEVFSR

SEQ ID NO: 14439 - protein, 572 aa, Xylella fastidiosa Ann-1
MHHDTSLIDIIAVGLSLAFVLGALAQRLKLSPLVGYLVAGICVGPFTPGFVADQQIANQLSELGVMLLMFGVGLHFSLEDLLEVKAIAIPGALVQIAAATLLGWGLAWTMGWPMVQGVVFGLALSVASTVVLLRALEERRLIDTQRGRIAVGWLIVEDLVMVLALVLLPALAQMLNGNESVAGHTQNAGSDSNAMLTALGWTLLKMAGFVAVMLVVGRRVIPWSLEKVAATGSRELFTLAVLGIALGVAFGSAKLFGVSFALGAFFAGMVLKGSETSHAAATDSLPLRDAFAVLFFVAVGMLFNPAILIEHPFQVLATFLTITIGKSAAAFLIVRAFGHPTSTALTISTSLAQIGEFSFILAGLGIQLAILPETGRDLILAGALLSIIANPFLFTWLDRWQAQQTAEETTLVEPELPPGPSPDLYNHAIVIGYGRVGSMLAQLLQSRHVPLLVIDDNSEHVLKAHAAGIPAIRGSAAADLVLAEAHPERAKIAVLAIPQPLEAGEILAKLRALNPELTLVARAQNDAEVKHLLGHGADATVVAEHEMAHSLAEMVLSSTNHPNSTRLQPAIA

SEQ ID NO: 14440 - protein, 108 aa, Oryza sativa
  misc_feature (17)..(17): Xaa can be any naturally occurring amino acid
  misc_feature (30)..(30): Xaa can be any naturally occurring amino acid
  unsure (1)..(108): unsure at all Xaa locations
EDLGKRCPKYYQAAARXAKWRAVLKSGPNXRSHVYIDLNAHGIARYAIICQENGLMPIAQPEILADGSHDIERCAYVTEKVLDVCYKDLNEHHVLLEEPLLKPNMGTP

SEQ ID NO: 14441 - protein, 289 aa, Spinacia oleracea
MASAAFSLLPSTSSTTFNRHATTKLLNLKFLHNHRNKPFFTTTIKSLSSPSPTPVLTQDDLKKLAAEKAVDSVKSGMVLGLGTGSTAAFAVSRIGELLSAGKLTNIVGIPTSKRTAEQAASLGIPLSVLDDHPRIDLAIDGADEVDPDLNLVKGRGGALLREKMVEAASDKFIVVVDDTKLVDGLGGSRLAMPVEVVQFCWKYNLKRLQEIFKELGCEAKLRMEGDSSPYVTDNSNYIVDLYFPTSIKDAEAAGREISALEGVVEHGLFLGMASEVIIAGKTGVSVKTK

SEQ ID NO: 14442 - protein, 267 aa, Triticum aestivum
HYRTSLYKKAGWYRSGIPGISSTHASEAACDELRNSRLFLKLLEAILKTGNRMNVGTNRGDAHAFKLDTLLKLADVKGTDGKTTLLHFVVQEIIRTEGSRLSASNQSTPRTLANPLRDELECKKLGLQVVAGLGNELSSVKKAAAMDSDVLSSYVAKLAGGIEKITEVLRLNEELNTRDDAWRFHDTMQKFLKKADDEILRVQAQESVALSLVKEITEYFHGDSAKEEAHPFRIFMVVRDFLSVLTQVCREVGRINDRTIASSVRHF

SEQ ID NO: 14443 - protein, 348 aa, Coccidioides immitis RS
MVLRSPAHVVRSARPALLMARPRATLSMASQVFAPLALRSPTPQQNQRRQSSHSPMGAAPINPRKQVTVKTLQSLYKKNEPITMMTAHDFPSAHVAEAAGMEMILVGDSLAMVALGMADTSEIGLEEMILHCRSVSRAVTTAFTIGDMPMGSYEISPEQALQTAIRLVKEGRVQSVKLEGGSDMAPTIKRITQAGIPVVAHIGLTPQRQNALGGFRVQGKSTAEAIKFFHDALAVQDAGAFMVVLEAVPAEVASIVTKKLKIPTIGIGAGNGCSGQVLVQVDMVGNFPPGRFLPKFVKKYGDVWGESLRAIEQYRNEVKSREYPSKEFTYPSVKEDVEEFQKFVDEHH

SEQ ID NO: 14444 - protein, 220 aa, Triticum aestivum
MFNRLFGKPKEQANAGALATLDKLNETLDMLEKKEKVLEKKAGAELERAKEFSKAKNKRAAIQSLKRKKLYEQQIEQLGNFQLRIHDQMIMLEAAKATTETVDALRTGAKAMKAMQKATNIDDVDKTMDEINEQTENMKQIQDALSSPLGASADFDEDELEAELEELEGAELESQLLEPVVTIPIHTTTVPGKAQPTRPAPQKASAEEDELAALQAEMAL

SEQ ID NO: 14445 - protein, 265 aa, Vibrio cholerae O1 biovar eltor str. N16961
MIRYGDIPMRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 14446 - protein, 589 aa, Phytophthora infestans
MSSSSRKFFVGGNWKCNGSLGQAQELVGMLNTAKIPVNVEVVVAPSQVHAATVKASLRSYVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEAHASIRAWLKEKVSPEAAEQTRVIYGGSVGAKNAPELSQKEDIDGFLVGGASLKPDFLQIINAQNPTANVGGAVNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 14447 - protein, 396 aa, Cystobacter fuscus
MNLANRLKVIKPSPTLALNTKAKELAAQGVDVVSFAAGEPDFDTPDFIKQAAIEALNKGFTKYTACAGIPELREAICAKLQRDNHLTYKPDQVLVSVGAKHSLYNIFQALLNEGDEVIILSPYWVSYPEMVQLAGGKPVIVHTREEDGFAPDPDAIRKALSPRTKALIINSPSNPSGVVFSRDTLAKIADAVRGHECLLVSDDIYEKLLYTGEFANIGNVAPDLLPRLVVVNGMSKAFSMTGWRLGYTAGPKWLIAGMQMVQDQSTSNASSFSQKAAVAALKGPDSIFEPMVKEYRARRDMVVELLNSFDGVRCRTPEGAFYVLPNISGLYGRSYKGTPLQGSIQVSEILLNDFRIAAVPGAPFGVDENIRLSFATSREQLQKGLERFREFTASVR

SEQ ID NO: 14448 - protein, 417 aa, Methylobacillus flagellatus KT
MAEIRNYTMNFGPQHPAAHGVLRLVLELDGEVIQRADPHIGLLHRGTEKLAENRTYLQSVPYMDRLDYVSMMVNEHAYVMAIEKLLGLEVPLRAQYIRVMFDEITRILNHLLWLGAHALDVGAMTVFLYAFREREDLFDCYEAVSGARMHAAYYRPGGVYRDLPDRMPQYEESTVRSKEDVKQLNENRQGSLLDFIEDFTNRFPAYVDEYETLLTDNRIWKQRTVGIGVVSPERAMALGMTGPMLRGSGVAWDLRKKQPYEVYDRLDFDIPIGVNGDCYDRYLVRIEEFRQSNRIIKQCIDWLRKNPGPVISDNTKVAPPPREEMKHDMEALIHHFKLFTEGFHVPAGEAYAAVEHPKGEFGIYLISDGANKPYRLKIRAPGFAHLAALDEMTRGHMIADLVAIIGTQDIVFGEIDR

SEQ ID NO: 14449 - protein, 128 aa, Arabidopsis thaliana
  misc_feature (79)..(79): Xaa can be any naturally occurring amino acid
  misc_feature (95)..(95): Xaa can be any naturally occurring amino acid
  misc_feature (110)..(110): Xaa can be any naturally occurring amino acid
  misc_feature (114)..(114): Xaa can be any naturally occurring amino acid
  unsure (1)..(128): unsure at all Xaa locations
MASSMFSSTAVVTSPAQATMVAPFTGLKSSASFPVTRKANNDITSITSNGGRVSCMKVWPPIGKKKFETLSYLPDLSDXVELAKEVDYLFRNKWXPCVEFEFEHGFFYRXAREXFPGYFCVGQFWRFP

SEQ ID NO: 14450 - protein, 223 aa, Triticum aestivum
  misc_feature (200)..(200): Xaa can be any naturally occurring amino acid
  unsure (1)..(223): unsure at all Xaa locations
MSGAALVAIAASIGNLLQGWDNATIAGAVLYIKKEFQLENNPTVEGLIVAMSLIGATIITTFSGPVSDWVGRRPMLILSSLLYFLSGLIMLWSPNVYVLLLARLVDGFGIGLAVTLVPLYISETAPSEIRGRLNTLPQFSGSGGMFLSYCMVFGMSLLPSPDWRIMLGVLSVPSLFFFILTVFYLPESPRWLVSKGRMAXAKKVLQRLRGKEDVSGEMALLVE

SEQ ID NO: 14451 - protein, 250 aa, Methylobacillus flagellatus KT
MRRKLVVGNWKMNGNLAQNKRLLEALVRGLQDVEHVDIAVCVPYPYLFQAQKILSGTNIAWGAQNVAKHENGAYTGEVSAAMLKEFGASYVIVGHSERSDAYCESNANIAEKFAIAKHYGITPIFCVGETLQERESGVMEYAIANQLDAVLSVSGGALLDQAVIAYEPVWAIGTNRTATPEQARAAHSFIRERIAAMHPGAAESVRIIYGGSVNPRNAAQLLSMPDIDGGLIGRCSLDADDFERICRAAC

SEQ ID NO: 14452 - protein, 520 aa, Aspergillus oryzae
MAKVDQKVVLVVIDGWGVAGPDSRKDGDAILAAETPFMSGFAEADSKTAQGYSELDASSLAVGLPEGLMGNSEVGHLNIGAGRVVWQDSVRIDQTLKKGELNKVDNVVASFKRAKEGNGRLHLLGLVSDGGVHSNITHLIGLLKVAKEMEIPKVFIHFFGDGRDTEPKSATKYMQQLLDQTKEIGIGEIATVVGRYWAMDRDKRWDRVEIAMKGIVSGEGEESSDPVKTINERYEKDETDEFLKPIIVGGEERRVKDDDTLFFFNYRSDRVREITQLLGDYDRSPKPDFPYPKNIHITTMTQYKTDYTFPVAFPPQHMGNVLAEWLSKKDVQQCHVAETEKYAHVTFFFNGGIEKQFAGEVRDMIPSPKVATYDLDPKMSAEAVGQKMADRIAEGKFEFVMNNFAPPDMVGHTGKYEAAIQGVAATDKAIGVIYEACKKQGYVLFITADHGNAEEMLTEKGTPKTSHTTNKVPFIMANAPEGWSLKKEGGVLGDVAPTVLAAMGIEQPEEMSGQNLLVKA

SEQ ID NO: 14453 - protein, 302 aa, Leptospira biflexa
RIGRLVLRSGIKDPNLEFVAINDLVTPDNLSYLFKYDSTHGRFDGDVSHTDNEIIIDGKKVKTFSERDPEKLPWKELGVDFVIESTGLFTDRVGAEKHIKAGAKKVVISAPAKDKDIPTFVMGVNHEKYDSAKDNVVSNASCTTNCLAPITKVVLDNFGIVEGLMTTIHAMTATQPTVDGPSKKDFRGGRGAAQNIIPASTGAAKAVGLCIPEVNGKLTGMSFRVPTPDVSVVDLTVRTEKPTSLAEIKKKMKEASEGSMKGILGYTEDMVVSNDFLGDIRSSIFDADACIELSPTFFKLVS

SEQ ID NO: 14454 - protein, 300 aa, Leptonema illini
RIGRMVFRAVVEQNRNVEIVGINDLLDAEYMAYMLRYDSTHGRFTGDVKVEGGQLIVNGKKIRVTAESDPANLKWNEIGAEYVIESTGLFTTLEKTQAHLKAGAKKVVISAPSADAPMFVMGVNHSSYKNDMDIVSNASCTTNCLAPITKVINDRWGVEEGLMTTVHAVTATQKTVDGPSKKDWRGGRGAYQNIIPSSTGAAKAVGKVIPELAGKLTGMSFRVPTSNVSVVDLTVRLKKPAKYEDICKAMKEESEGAMKGVLGYTDEEVVSNDFLHDARTSIFDAKAGIQLSDTFVKVVS

SEQ ID NO: 14455 - protein, 342 aa, Aspergillus oryzae
MSLYQNIALNGSFALHGLRHPLDMYSSLGPTLSEATFGLLGYSFEPSRDIGDLSGKVLFVTGGNAGLGKETVLQLAQHNPSRIYLAARDATKAREAISSIQDIISASVDIRHIQLDLSSFQSTRDAAEKFCSECDRLDILILNAGTMANPPELTKEGFEIQFGTNHIGHFLLTKLLLPTLKKTVGSPASDVRIVTLSSVGSHAAPSLDVMTSTSALLDSHTLVRYSASKAANILFASELARRYPEILSVSVHPGVVSSELYRHTGAMNAISKFGVGLLSTVFRSIRTGAMNQLWAAGTKREQLVNGAYYVPIGVRGSSRFTDDADMARKLWEWTENQIAEKS

SEQ ID NO: 14456 - protein, 431 aa, Prosthecochloris aestuarii DSM 271
MPQLTRSAELFEKAKQFIPGGVNSPVRAFKSVGGTPIYMAKGQGAYMTDVDGNTYLDYVGSWGPFILGSMHPRITAALEHTLTKIGTSFGTPIEMEIEIAELLCQIVPSIEMVRMVNSGTEATMSAVRLARGYTSRDKIIKFEGCYHGHGDSFLIKAGSGALTLGAPDSPGVTKGTANDTLNAKYNDIESVRLLVNENKGNIAAIIIEPVAGNTGVIPAKPGFLQALRDLCTEEGIVLIFDEVMCGFRVALGGAQERYGVTPDLTTMGKIIGGGLPVGAFGGKREIMERIAPLGDVYQAGTLSGNPLALTAGLETLKILRDENPYPELERKAAFLEEGFRNNMNKLGLNYVQNRVGSMACLFFTETPVTDYDTAVTADLKKYGTYYHAMLDQGIYLAPSQFEAMFTSAVMTDEDLEKTVKANYVALQATQK

SEQ ID NO: 14457 - protein, 302 aa, Leptospira interrogans serovar Icterohaemorrhagiae
RIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVS

SEQ ID NO: 14458 - protein, 425 aa, Mycobacterium avium subsp. paratuberculosis K-10
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGVGTGISASDRATTMRLLADPTSIAEDFTRPGHVVPLRAKDGGVLRRPGHTEAAVDLARMAGLQPAGAICEIVSQKDEGSMAQTDELRVFADEHDLAMITIADLIEWRRKHEKHIERIAEARIPTRHGEFRAIGYTSIYEEVEHVALVRGEIAGPNSDGDDVLVRVHSECLTGDVFGSRRCDCGPQLDAAMAMVAREGRGIVLYMRGHEGRGIGLMHKLQAYQLQDAGEDTVDANLKLGLPADARDYGIGAQILVDLGVRSMRLLTNNPAKRVGLDGYGLHIIERVPLPVRTNAENIRYLMTKRDKMGHDLAGLDDFHESVHLPGEFGGAL

SEQ ID NO: 14459 - protein, 349 aa, Oryza sativa
MSRSGAMDLASGLGGKITKDEVKSAVDEYEKYHGYYGGKEEARKSNYTDMVNKYYDLATSFYEYGWGESFHFAHRWNGESLRESIKRHEHFLALQLGVKPGMKVLDVGCGIGGPLREIAKFSLASVTGLNNNEYQITRGKELNRVAGVSGTCDFVKADFMKMPFSDNTFDAVYAIEATCHAPDPVGCYKEIYRVLKPGQCFAVYEWCITDHYEPNNATHKRIKDEIELGNGLPDIRSTQQCLQAAKDAGFEVIWDKDLAEDSPVPWYLPLDPSRFSLSSFRLTTVGRAITRTMVKALEYKALEYVGLAPQGSERVSNFLEKAAEGLVEGGKKEIFTPMYFFLVRKPISE

SEQ ID NO: 14460 - protein, 420 aa, Yarrowia lipolytica CLIB122
MTLEETLASAKTAGDKGNLVEAEKLYREILDQKAGTNEKSIQIQESALINLGTLYASNNKPQDLADLIHTSLTVMSGFAKSKTAKIIRNLIDLFAKVPSDCIDLQIATTQKCIEWAVSEKRNFLRQSLQTRLVSLFLEKKTYYDALNLINTLLKELKKLDDKMVLVEVQLLEAKAYHALRNIPKSRASLTSARTSANAVYCPPLTQAALDTMSGILQADDKDYKTAFSYFYEAFEGYVGQENPKAGTVLKYMLLCKIMLNLADDVETILNNKSAQAYQGRDVDVMKAVAVAYANRSLKEFEHVLELYKEEVQADPVIRVHFNDLYDSLLEQNLLKVIEPFSCVEINHIAEIIGLDTRQVEGKLSQMILDKGIKGVLDQGNGWLFIYDEPQTDKTYDSALETVKHMSTVVDLLYEKASSLN

SEQ ID NO: 14461 - protein, 379 aa, Archaeoglobus fulgidus DSM 4304
MMQRGANRIEVVQPSATLRVSTMAKELKREGKDVVDMSVGEPDFPTPDFIIEAAYKAMKEGKVFYTPTKGVPELIDAIVEKLRNENGIDVGAENIIVTPGAKYAIFEAMMCLLQEGDEVILLDPSWVSYEACILMAGAKPVWVPHEEGFEDAPIEDYITSNTKMIVVNTPSNPLGVVYPKEFLKKVRDLAVDKDILVMSDEIYEKIIFEGEHYSLAAMDGMLERTITINGFSKTYSMTGWRLGYAAAPEWIIKLMNRMQSHSVSHPTSFVQYAGVAALKGDQSFIKEIVEEFRARRDMIMAKLDEMGIEYAPPKGAFYIFMNVGRDSNEFCEEFLKREYVALTPGSAFGVAYKSWVRLSYATSRERIGEFLSRLERFLG

SEQ ID NO: 14462 - protein, 296 aa, Bacillus anthracis str. 'Ames Ancestor'
MVIQWFPGHMAKARRQVTEKLKLIDVVIELVDARLPLSSRNPMIDEIITHKPRLVVLNKADMADDRLTKQWIAYFKEKGHMAISINAQAGQGMKEIAAACKVLVKEKFDKMVAKGIRPRVIRALIVGIPNVGKSTLINKLAKKNIAKTGDRPGVTTAQQWIKVGKEMELLDTPGILWPKFEDELVGLRLATTGAIKDSILNLQDVAVYALRFMEKHYPERLKERYNLNDIPEDIVELFDAIGKNRGCLMGGGMIDYDKTSELVLRELRGGKLGKMTFETPEEFAEQTEDAEKVEEV

SEQ ID NO: 14463 - protein, 248 aa, Ashbya gossypii ATCC 10895
MARTFFVGGNFKLNGSKQSIKEIVERLNTADLADNVEVVICPPATYLDHAVSLVSHPQVTVGAQNAYTKASGAYTGENSVDQIKDVGAKWVILGHSERRTYFNEDDEQVAEKTAFALERGVSVILCIGETLDEKKAGVTLDVVKRQLTPVLEKVKDWTNVVIAYEPVWAIGTGLAATAEDAQDIHAAIRDFLAERTSRDVADAVRILFGGSANGANAASFRDKADVDGFLVGGASLKPEFVDIINSRR

SEQ ID NO: 14464 - protein, 140 aa, Bartonella quintana str. Toulouse
MAVERTFSMIKPDATRRNLTGAITKMLEDAGLRVVASKRVWMNRREAERFYAVHRERPFFSELVEFMSSGPTLVQVLEGENAIAKNREVMGATNPADAQEGTIRKVHALSISENSVHGSDSAETAKTEITFWFSEMEIVG

SEQ ID NO: 14465 - protein, 415 aa, Glycine max
MDPCPFVRILVGNLAVKSPASSKPSSFSGKVHPSSSPFFCKILLQGLDSNSTSPRVSSVPLISDSDPHPHSFAASFDFSKAQILKASKKPLMKISVYKGPTTPSCVFTSAKLLGKVSIPLDLTLAESRPCTFHNGWLSLSKNTNPSQLLHLTVRAEPDPRFVFRFDGEPECSPQVFQIKGDVKQPVFTCKFSFRDKDKAHFPSLNANHAAERKGWSITVHDLSGSPVAAASMATPFVPSPGSQRVSRSNPGAWLIIRPDGDGTWKPWGRLEAWREPNNSNAVGYRFEVLPGTADPVTLAASTISSQHGGKFAIDATSGVTPVNTPRGSWDLGSGSGSGSNSDFGLEPNFFYNKGFVMSAMVSGEGKCSKPEVEVGVQHVTCTEDAAAFVALAAALDLSIDACKLFSQKLRKELRQ

SEQ ID NO: 14466 - protein, 791 aa, Arabidopsis thaliana
MDPGDPTSIIFSKIRTFELENASRVIDYFLLQDMEQRDLIRIAFGPDSLIQTFCQKAKVDLGFSSNGFSRPINIHGQSLSSSSPRNGFLEFSRNPSNPLSSSLTLNTLRDNKPNFNSSPFRESSSLFASSSGDEQQQQQFSNNFLFTNDEDPFANSHKRSFSANDACFESEEPWFGGGNGCHQFPQGGLVDGFGSSGVFGSPSEMDYMLEGMMRMKLAQQKSMVAAQFMAACGSPMLHRHGSGHFGEECGNYFSQGRHEREDSVSKQIYLTFPSESSFTDEDVSTYFRDFGLVDDVRIPYQQQRMYGFVTFAKAETVRTILARGNPHFICDSRVLVKPYKEKGKILQKRQQQQLHELLERGNYSPSSSPSGKDSRELYECRLGDSDRSEKDLQQVATSNEERGYNNGFYKGQETSLENTLPDSLFGSPKKSGETYQTESDTEHNNKEASSNQNPYPLYPSLTGNTLGYYPNFHDGSSQQQQWSNHFPIPRFWVPDYQFPPGGLALPPSVFGPPSERISPNQQQRMIATHGSPVSNIQGSGQFGIEGGFGSPSEQQRMIAPQFMGDFGSRMSNINFGPVLSVRIPNQKEQVYGFVSFANAETVTTILDQENPHLIGESPVNVTAAATTAGVGWREPFSVGNGPKGAMSRCNSLILFSLPGPRRFRNETHEMLQRNTEQADPQQAIEVEDQIRRLSNLQLPGMENKSIHHHQPSPSIGSHAHFPSQVREGGSGTGEKDLEQVETSNEEHQGQEKSLENTLPDSSFGSTKESGETRQTESDIEETKKASLDQSA

SEQ ID NO: 14467 - protein, 174 aa, Glycine max
VFVCLKCCGVHRSLGSQISKVLSVTLDEWSSDEIDAMIEVGGNSSANSIYEAYFPEGFTKPGPDATHDQRVKFIRLKYEHQEFLQPSLRIVSGKSNPPKSISKGIMDSFRITSDSQHMEGMVEFIGMLKVKVIKGTDLAIRDMMTSDPYVIFKLGQQTVQTTVIKSNLNPVWNE

SEQ ID NO: 14468 - protein, 337 aa, Thiomicrospira crunogena XCL-2
MLTPILFSTQERLSMKRLDQVLAADGVNAELELVIKDVMVACKDIAYKLGQGELAGILGATEDENVQGETQKMLDVISNDLLKDILVANPYVRGVGSEEEDYTIAGNADGKYLVTFDPLDGSSNIDVNLSVGTIFSVLEAQDDQSGDNQEVFLQNGRKQVAAGYVLYGPSSLLVMTTGNGVNLFTLDTNIGEFVLTKEALQIPEDTAEFAINMSNQRFWEPEMKQYIDDCLLGEEGPLAKRYNMRWVASMVAEVHRILIRGGIFMYPYDNRDPSKAGKLRLMYEGNPMSMIVEQAGGASSTGRMDIMDVAPQGIHDRVPVVLGSKNEVAKVVAYHTK

SEQ ID NO: 14469 - protein, 131 aa, Saccharomyces cerevisiae
SGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 14470 - protein, 375 aa, Pyrocystis lunula
MLRRSQALVVHNGSGMCKAGFAGDDAPRAVFPSIVGRPRHTGVMVGMGQKDSYVGDEAQSKRGILPLKYPIEHGIVTNWDDMEKIWHHTLYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDIKEKLAYVALDFEQEMQTAASSSALEKSYELPDGQVITIGNERFRCPEALFQPSFLGMESAGVHETTYNSIMKCDVDIRKDLYGNVVLSGGSTMFPGIAERMNKELVALAPSTMKIKIIAPPERKYSVWIGGSILASLSTFQQMWISKEEYDESGPSIVHRKCF

SEQ ID NO: 14471 - protein, 310 aa, Escherichia coli O157:H7 EDL933
MDNLDVICIGAAIVDIPLQPVSKNIFDVDSYPLERIAMTTGGDAINEATIISRLGHCTALMSRIGKDAAGQFILDHCRKENIDIQSLKQDVNIDTSINVGLVTEDGERTFVTNRNGSLWKLNIDDVDFARFSQAKLLSLASIFNSPLLDGKALTEIFTQAKARQMNICADMIKPRLNETLDDICEALSYVNYAEAKLLTGKETLDEIADSFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 14472 - protein, 502 aa, Glycine max
MEKMLGRNCGKLKTKIVCTLGPSSRSVEMLEKLLKAGMNVARFNFSHGTHSYHQETLDNLRTAMNNTGILCAVMLDTKGPEIRTGFLNEGKPIQIHRGQEITITTDYSIKGDENMISMSYKKLAHHLSPGSNILCADGTISFTVLECDKENGLVRCHCENSAVLGERKNVNLPGVVVDLPTLTEKDKEDILEWGVPNKIDIIALSFVRKGSDLVEVRNLLGKHAKSILLMSKVENQEGVANFDEILENSDAFMVARGDLGMEIPIEKIFLAQKVMIHKSNIKGKPVVTATQMLESMIKSPRPTRAEATDVANAVLDGTDCVMLSGETAAGAYPDIAVQTMARICSEAESFIDYGDLFKRVMETAPTPMSPLESMASAAVRTANCINAALILVLTRGGTTSKLVAKYRPSMPILSLVVPEITTDSFEWFCSQEAPARHSLIYRGLIPVLGTGSFGDSMTESTEETIQLALSYAKKNDLCKPGDSVVALHRLESGTVIKILDVC

SEQ ID NO: 14473 - protein, 347 aa, Escherichia coli O157:H7 EDL933
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGTLVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGASAINFLKINREVTIQTVFRYANRYPVTIEAISSGRFDVKSMVTHIYDYRDVQQAFEESVNNKRDIIKGVIKISD

SEQ ID NO: 14474 - protein, 298 aa, Streptomyces antibioticus
MDLTGRRAVVTGGASGLGAETVRALAAAGAEVTVATRRPLSAEPLVQELAAAGGAGRVTAEALDLSDPASVESFARAWRGPLDILVANAGIMALPTRTLAPNGWEMQLATNYLGHFALATGLHAALRDAGSARIVVVSSGAHLDAPFDFEDAHFARRPYDPWVAYGQSKAADVLFTVGARRWAADGITVNALNPGYILTRLQRHVDDETMRAFGVMDDQGNVKPLPYYKTPEQGAATSVLLAASPLLKGVTGRYFEDNQEARTVQGQEDQPGGVAAHALDPEAADRLWEYGTDALRAA

SEQ ID NO: 14475 - protein, 591 aa, Oryza sativa (japonica cultivar-group)
MVKKSKKSKSKRVTLRQKHKVLRKVKEHHRKKRKEAKKEGKSHRKKVEKDPGIPNEWPFKEQELKALEARRAQALQELELKKEARKERARKRKLGLLEDEDIANLASAASAQGSEFAEKDAAKENASLDVVKSQDHSERAFYKELVKVIEASDVILEVLDARDPLGTRCIDMEKMVRKADPSKRIVLLLNKIDLVPKESVEKWLTYLREEMPTVAFKCNTQEQRTKLGWKSSKIDKSSNIPQSSDCLGAENLIKLLKNYSRSHELKLAITVGIVGLPNVGKSSLINSLKRSRVVNVGSTPGVTRSMQEVQLDKKVKLLDCPGVVMLKSSNSGVSVALRNCKRVEKMEDPISPVKEILDLCPHEKLLSLYRVPTFTSVDDFLQKVATLRGKLKKGGIVDVEAAARIVLHDWNEGKIPYFTVPPKRDAVDDSDAVIISETGKEFNIDEIYKAESSYIGGLKSLEEFRHIEIPSNAPPQIDEEMLEDGKKQNEPAQENHDESMSDANEREGAKTASASTQNDKLYTAEGILDPRKRKAEKKRRKANKFSVLTDMDADYDFKVDYQMKDALAEEGNDGGDEEPKEADPMTGVDDA

SEQ ID NO: 14476 - protein, 524 aa, Bordetella parapertussis
MAPPGHVVPSPANGHRHDARPATRLPEPTSLRRTLSARHLTMIAVGGSIGTGLFVASGATIAQAGPGGALLAYLLVGIMVYFLMTSLDELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 14477 - protein, 240 aa, Ehrlichia chaffeensis str. Arkansas
MSLLIVANWKMYGDFLTFSSFTKELSANLVNVKADVEVVLCPPFIACSKIVDCAPNIKLGAQNCFYESEGKYTGEVSAKMLYSCGCSYVIVGHYERRSIFYESDYCVQLKAKSAIDAGLIPIICIGETLLDRENGMLKNALLDQCYNSFPKHGEFVIAYEPVWAIGSNTIPSIDMITESLDIIRSYDSKSNIIYGGAVNQSNIKDVIAINQLSGVLVGSASLKVSSFCDIIYGAVNVRQN

SEQ ID NO: 14478 - protein, 492 aa, Vibrio parahaemolyticus RIMD 2210633
MCKTKIVATLGPASESRETLTKLIRAGANVVRLNFSHGTAQEHIARANLVREIAAELDTYVGVLVDLQGPKIRISCFENGAVLLNQGDVFTLSGTLDAQSGTQEMVGLDYPELIQDVNEGDILLLDDGRIQLKVSQLHRDEQWIKTTVLNSGKLSNRKGINLLGGGLSAPALTAKDIQDIDTAAKLRADFLAISFPRNAQDIEYARSLAQKAGCHAKIVAKVERAEVVETKEAMDDVIKASDIIMVARGDLGVEIGDARLPMVQKSLINRSKHWGKPVITATQMLESMIENPLPTRAEVLDVANAIIDGTDAVMLSAESAAGKYPIEAVEAMVRIAQGAEHELECNHDCWDTLQHLCSNPGKSFALSSMISASRVHQDLGVAILTQHGETPLLMSRCQSKTKIWALSDNPALLAQMTILRGVEPLYFKAAESHVDLAPQLVECLRQKANEAHISSILMTQLDSIEGMGEINACRLLSLNVSSHMKPAEEIAA

SEQ ID NO: 14479 - protein, 106 aa, Arabidopsis thaliana
MFEIIQAVFSAGVALALLTFAGITLGGSVVACIISTPLFVIFSPVLVPATIATTLLASGFTASGSFGATAFTILSWLYKKRTGRDLPKIPGLTPPAPASNPAGSGV

SEQ ID NO: 14480 - protein, 256 aa, Ashbya gossypii ATCC 10895
MQSNARQRELIREFLAVTSATSAAAETYLERNHWSLDHALDDFYTQSGGGGRAEQYSAELVATFERYAAGGAMDTEALVRYVGDLGFQLEDVATLCLARLLKVEELTADISRFQFLSTWHGLGCSSLPDMRAAVDALELRLRTDAAYFRALYAYTFGLGLDAGGRRLSVETAIAYWSLFFLDHTYAVTVPAPRLRSWFEFLRAGDHSVSRDTWDMFPRFAQRFPDDTELLEHYNELASWPLVIDEYYEWVKGRNQL

SEQ ID NO: 14481 - protein, 113 aa, Arabidopsis thaliana
  misc_feature (49)..(49): Xaa can be any naturally occurring amino acid
  misc_feature (93)..(93): Xaa can be any naturally occurring amino acid
  unsure (1)..(113): unsure at all Xaa locations
NDPRRRGGNHSGGEYIFSHHHPHEAGGVNLGKGQTPTAQATKVAPFTGXKTTANYPGTRTDNNDITSITSNGGRVSSTKERPPIGKKKIETLXYLTEQSDVETAKEGDNQSRN

SEQ ID NO: 14482 - protein, 407 aa, Oryza sativa
MPPKKAAPSKADLAKKQKVVEDKTFGLKNKNKSKNVQKYKKKEEEKAREKELNDLFKVAVSQPKVPVGVDPKSIVCEFFKVGQCQKGFKCKFSHDLNVQRKGEKIDIYTDKRDAETMEDWDQETLEKVVASKGAEYQQNKPTDIQLLGCPLGHIVSKPPVLILVLNAPGTTRGKSDICHVATVVNMIWCDELAWWDSFLVAAHDMVCKYFLDAVEKKQYGWFWVCPNGGKDCHYRHALPPGYVLKSQMKALLEEESEKIAIEDEIEDQRKKVKTTTPMTTDLFMEWKRKKAEEREAGLAALRAERAKNDRMSGRELFMADSSVFVDDAEAYDVYERQEESEANEEPSNKNQDEGPSSSTSNGKEVEESDDEDINIDDDLDIDELNELEASLSRTSIQIREPGEGTSS

SEQ ID NO: 14483 - protein, 423 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKLLGREGYCKVEDTPKGWFMTYIDRDSEQAVKDRLKRKRIKSDMAEDERQERMIARQIERAHKSLAKPNDGDAAEGEPESGGEEEYSGSDDDGEELEDVSKEANKATGKIAIALQTAVRGPKVNPFEDKPEVKFRFDEEGDLGTGEEKDELAKKKGKDVKAADARRSALDELMKEEEMAKERSNRKDYWLCPGIVVKVMSKSLAEKGYYKQKGVVRKVMDKYVGEIEMLESKHVLRVDQDELETVIPQIGGLVRILNGAYRGSNARLLSVDTEKFCAKVQVEKGLYDGKVLRAVKYEDICKISS

SEQ ID NO: 14484 - protein, 344 aa, Zea mays
CFADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 14485 - protein, 254 aa, Bartonella quintana str. Toulouse
MSPNIRPFIAGNWKMNGTVESLGELRAIAAGVSSDLGHLFEALICVPATLLSRASDALSGENLLLGGQNCHFDDCGPYTGDISAFMLKEAGASHVIIGHSERRTVYQESDAIVCAKVQAAWRAGLVALICVGETLEERTSNKVFNVLTRQLEGSLPDGATAENVIIAYEPVWAIGTGNSPTSAVVAEVHDFIRHKMCSRFGDDGRKMRLLYGGSVKPSNAFELLSTVHVNGALIGGASLKAIDFLTICDVYRKL

SEQ ID NO: 14486 - protein, 482 aa, Arabidopsis thaliana
MGKRQDWSVTACIFLFLSLASQIHCRSHIPFPSPKRGVSSSGDTSHFNVIQRESVPSPKDKDLIQQLPGQPSDVTFKQYGGYVAVNKPAGRFLYYYFVETIKPGNTTPLVIWFNGGPGCSSLGGAFKELGPFRVHSDGKTLFRNPYSWNNEANVLFLETPVGTGFSYSNSPINGKQGDKATAEDNYMFLVNWLERFPEYKGRDIYIAGQSYAGHYVPQLAQIILHRNNQTLINLRGILIGNPSLNREIQDDFGYKFMFSHGLISQQQMDNYNKFCTDSDLYDWDKCHLASQKIEAQKTHLDIYNIYAPLCLNSTLSSEPKKCTTIMKADPCSGNYLKAYLNIKEVQEAIHANTTKIPYEWTSCNTKLLWEWNEKDRYVSLTPILQELMGKGVRVMLYNGDVDLVIPFTSTLAVVKTMNLTVVKEWRPWFTGGHVGGFTEDYKGNLTFVTVKGAGHSVPTDQPIHALNIFTSFIRNTPLPQTA

SEQ ID NO: 14487 - protein, 312 aa, Pseudomonas aeruginosa PAO1
MQTLLKLLQDGRFHSGEELGAVLGISRSAVWKRLQHLEAEHGLQFHKVRGRGYRLASPLSLLDPRKIDSLWPVEIMPTVDSTNSEAMRRLAAGASTPFVIVAEQQTAGRGRRGRAWVSPYGENLYYSLAITVRGGARELEGLSLVVGLAVLRALESLGVQDTGLKWPNDLLQGGKKIAGILLELSGDPADLCHVVIGIGINVNMKTATDIGQPWTSLREALGELVDRSRLLSALNRQLADYLDRHSREGFAASREEWESCNLWQGAQVILSTALSSIEGRVLGVDSRGALRLEVDGVEQGFSGGELSLRLRQ

SEQ ID NO: 14488 - protein, 297 aa, Streptomyces lividans
MDLTGRRAVVTGGASGLGAETVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFDFEDPHFARRPYDPWAAYGNSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDVQPGGVAAHALDPEAADRLWEYGADTLSAG

SEQ ID NO: 14489 - protein, 249 aa, Xylella fastidiosa Ann-1
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 14490 - protein, 396 aa, Salinibacter ruber DSM 13855
MGRRLHLEPLPKSCILGAKKPCFPHVSSHIPSTHVMTGSHRTSHAGDGAPEDDLGTFQTLEQFILDRQDSFPHSTGAFSRLLRDISLAAKIVNRDMRRAGLLDVYGSTGERNVQGEVQQKMDALAHREFVQALRRGGECCLIGSEEHAEAIPLSTVSKEGDGKYIVLLDPLDGSSNIDVNVSVGTIFSIYRLPDGYEEEEPDPAAALQPGTEQVAAGYVVYGSSTMLVYTTGNGVNGFTLDPSIGEFLLSHPDIQTPSRGRLSSINSGYYHSFEEGLRDYLDWLQQKDPETNRPAKTRYIGSFVSDFHRNLLKGGIYMYPATESSPAGKLRLMYEANPMGFIAEQAGGAASDGHRRILEKEPDKLHQRTPLFIGSEEMVRRAEAFLQGEPERALSA

SEQ ID NO: 14491 - protein, 156 aa, Musa acuminata
PLLLSPLASTSSITQNTRSLFSPMAVAAIAEAPFHVLAVDDSVLDRKLIERLLKTSSFQVTTVDSGTKALQFLGLHAEDASISSVHADQLDVEVNVNLIITDYCMPGMTGYDLLKKIKESSSFRDIPVVIMSSENIPSRINRCLEEGANEFFLKPV

SEQ ID NO: 14492 - protein, 435 aa, Xylella fastidiosa Ann-1
MNQIRQAPAASASNATESKQEIRNYTMNFGPQHPAAHGVLRLILEMDGETVVRADPHIGLLHRGTEKLAESKPFNQSIGYMDRLDYVSMMCNEHAYVRAIETLIGIQAPERAQYIRTMFDEITRILNHLMWLGSNALDLGAMAVMLYAFREREELMDVYEAISGARMHAAYYRPGGVYRDLPDTMPKYKQSRWHKGKALKRLNAAREGSMLDFLEHFTDTFPQRIDEYETLLTDNRIWKQRTVGVGVIEPDVAKAWGMTGVMLRGSGIAWDLRKKQPYAKYDAVDFDIPLGTCGDCYDRYLCRVAEMRESNRIIKQCVQWLKVNPGQVMVENFKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 14493 - protein, 90 aa, Zea mays
  misc_feature (46)..(46): Xaa can be any naturally occurring amino acid
  misc_feature (62)..(62): Xaa can be any naturally occurring amino acid
  misc_feature (76)..(76): Xaa can be any naturally occurring amino acid
  unsure (1)..(90): unsure at all Xaa locations
MSAYCGKYTDELIKNAAYIVTPGKGILAADESTGTIVKRLSSINVXNVVVNRRALRELLFCXPGASQYINGVNPIXQTLYKKRLVGSPFF

SEQ ID NO: 14494 - protein, 341 aa, Zea mays
MEQPAAPDRSDFPAGECEWREELRQQQSQVDALRERLVEAKVGLRCSEGDSRKELEHLCRRVKTIATLLAYLKSKARIMAIPHLAHTSCGIRQQDGVGYVDRHGVPLADWPKGADPAPCGGASVDGTVAEGGARPEHGDAVGGDVDVDDILKSIRVVTDVMESLVKRVIVAESEAANEKEKVRMGLEEIRRKTLQVETMSAKVEEMEKFAVGTNGMLNEMRQRVEDMVLETTRQRQRAAENEVELSRVKHDFESLRTYVSTLVSVRETLLSSEKQFETMEKLFDRLVAKTNQLESEKAQKEAEVHKVMEENVRLRAMLDKKEAQLQAMSEQCKFMALNHDN

SEQ ID NO: 14495 - protein, 485 aa, Nostoc punctiforme PCC 73102
MNKAGNHLQQRYLEAFTTRYNERTKKSKQLAQTYRPIITSNMGPVGFSLSCKEMCYPITAKRSLGSRIWDVDGNEYIDFMMGLGVNLFGHNPPFIQAALKEQLEKGIQIGPQSELTGEVGELICELTGMERVAFSNTGTEAVMAAIRLARTATGRNKIVLFSGSYHGHFDGTLVEVETIDGIPHTVPITSGIPQNIVEDYLVLDYGNPQSLDAIRANKHELAAVLVEPVQSRRPDLQPKDFLLQLRQLTKELGIALIFDEVITGFRVHPGGAQAWFGVEADIATYGKIVGGGMPIGIIAGKATYMDRIDGGMWNYGDASQPQVETTYFAGTFRRHPLAMAAALAVLKHLKMQGSQLQQQLNQRMSQLVETLNAYFEEEEVPLRLRNFSSWFSPAFLENFSLLEYATPSELRELLYYHLLDKGVMLGGPGGYLSTAHTDEDINYIIQAFKDSVRELRKGGFLPPIAPQNLVKEFSLETREQIADVR

SEQ ID NO: 14496 - protein, 383 aa, Thermus aquaticus
MRGLSQRVKSMKPSATVAVNARALELRRKGVDLVALTAGEPDFDTPEHVKEAGRRALAQGKTKYAPPAGIPELREAVAEKFRRENGLEVTPEETIVTVGGKQALFNLFQAILDPGDEVIVLAPYWVSYPEMVRFAGGVPVEVPTLPEEGFVPDPERVRRAITPRTKALVVNSPNNPTGVVYPEEVLRALAEMALQHDFYLVSDEIYEHLIYEGAHFSPGTLAPEHTITVNGAAKAFAMTGWRIGYACGPKAVIKAMADVSSQSTTSPDTIAQWATLEALTNREASMAFIAMAREAYRKRRDLLLEGLSRIGLEAVRPSGAFYVLMDTSPFAPNEVEAAERLLMAGVAVVPGTEFAAFGHVRLSYATGEENLKKALERFAQALQ

SEQ ID NO: 14497 - protein, 468 aa, Oryza sativa
MEPKPSTPTAAATPRFKLGKQSSMAPDRGGAGESSEEGSSEAVGVMGFQLMYMAHEGDVEGIQELLDAGADPNFRDSDGRTAMHIAACEGQAEVVELLLQRGADAVAEDQWGSTPLADALHYQNHDVIKILEKHGSKLKIAPMHVKNVREVPEYEISPNELDFTNGNGISKGTFRKATWRGILVAVKKLDDDLIMDENKVQAFRDELDVLQLIRHPNVVQFLGAVTQSSPMMIVMEFMPKGDLRKHLSRKGALEPSYAVKLALDIARGMNYLHEHKPQAIIHRDLEPSNILRDDTGHLKVADFDLCKMLKWRRKVREEKAVTSPGNACRYVAPEVLRNEEYDTKVDVFSFALILQEMIEGCLPFYDKKNNEIEKAHNSKERPPFRAPPKHYAYGLRELIEQCWSENPASRPDFRTIIEQLSYIQNEISQRNRWKVKPLKCFLSFEGMWKKDRNEGSTTRSSRSSRSYF

SEQ ID NO: 14498 - protein, 325 aa, Methylobacillus flagellatus KT
MNNLVFPILRLLADGRFHSGEDIARRFSVTRSSVWNAIQAAEALGVEVFSVRGRGYRLPYPLLLLSEDAVQVALGDHKQRFKLLMFDSIESTNSYLMQQAALGAAHGTVAAALLQTKGRGRRGRSWQSAFGASLTFSLLWRFQLGASALSGLSLAVGLALVRTLHEYGLRSAQLKWPNDILVRGRKLAGILIELHGDMEGPSAAVIGVGLNLKLPVAAREKIDQPVTDLASHLPLEINPNDMLGQLLKQLAQVLEEFERAGFAGMREEWMSHHIFQGETVKLLFPDGREQYGRVEGIADDGVLLIKNEHGNQRFSSGEISVRGVS

SEQ ID NO: 14499 - protein, 432 aa, Prochlorococcus marinus str. NATL2A
MTDALNTKRSEEIFGAAKNLMPGGVSSPVRAFKSVEGDPIVFDRVKGPYAWDVDGNRYIDYVGSWGPAICGHAHPEVIAALQETLEKGTSFGAPCVLENQLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKELFAENPDAISGVILEPVVGNAGFITPEPGFLEGLREVTQENGALLVFDEVMTGFRISYGGAQERFGVTPDLTTMGKVIGGGLPVGAYGGRKEIMSMVSPSGPMYQAGTLSGNPLAMTAGIKTLELLKQEGTYEKLEAITKKLLDGILTAAKESNIPIYGQSISAMFGFYLCEGPVRNFEEAKSSDTELFSKIHRLMLQKGVYLAPSAFEAGFTSLAHSEDDINATIKAFKEIFSEMS

SEQ ID NO: 14500 - protein, 583 aa, Carboxydothermus hydrogenoformans Z-2901
MKRTKIVCTIGPASNDVGILKEMIISGMNVARINFAHGSHEEHRERIEKVRRASLEVGIPVAILIDTKGPEIRIGKVENGKIVLKEGDLVVFDPDIAEGQGLRVPVNYPGLARDVNVGGTILLDDGLIELKIEDIQGNKVIARVITGGELSNNKGVNLPGVKVNLPALTEKDRKDIDFGIEIGADFIAHSFVRKAADVLALRRYLEEKGADMEIIAKIENQEGVENIDEIIKVADGIMVARGDLGVEIPTEDVPLVQKEIIEKCNKNGKPVITATQMLDSMIRNKRPTRAEATDVANAIFDGTDAVMLSGETAAGKYPVEAVKTMARIAEKAEEKLLTLRKLNKPTTKSFKTVTDAISHASVTTAEELDAGAIITPTSSGYTARMVSRYRPAVPIIAATPDMKVLRKLTLVWGVFPLLVKTSDSTDEMLSKAIEASLESGLLKPGDLVVLTAGVPVGVKGTTNLLKVHVAGNVLAKGVGIGTRPITGTARVCRTAREAIERIQPGDILVTEATDRDFVSAIEKAAGLVVEAGGLTSHAAIAGLEFGIPVIVGVDGATSIIKDGEKLTLDPQRGLVYHGSAKVL

SEQ ID NO: 14501 - protein, 192 aa, Glycine max
  misc_feature (54)..(54): Xaa can be any naturally occurring amino acid
  misc_feature (143)..(143): Xaa can be any naturally occurring amino acid
  unsure (1)..(192): unsure at all Xaa locations
MLLDKNDIQETHYEVLHVKEHANYEEIRASYRSVVLSLHPDKLLKTSKTSSSNXQPERFLKVQKAWEILCNSSSRSFYDNELRSSRKDVLAADIAEDLSLRKDVLAADVAEDLSLQDMMIEDDGEALELFYQCRCGDYFSHAXRELKKMGYSLLRVGSGISVLNADTLPGSVILPCGSCSLKARLLINMDAN

SEQ ID NO: 14502 - protein, 803 aa, Ashbya gossypii ATCC 10895
MTYTFTYCKDESGSTTGTILSFDNCTLLIDPGWSGGCSYDECMAYWKEWIPQVDIILLSQPIQECIGAYAALFFDYISHFNSRIQVYSTLPVANLGRVATVDLYASLGIIGPFDTNRIDIEDIDTAFDHLNTVKYSQLVDLKSRFDGLSLVAYSSGFAPGGTIWCANTYSEKVLYAPRWNHTRDTILNSADLLDKGGKPSTALMRPSAVIMSAAHVGPSTPYRKRSQKFKEVIKKALSANTSVILPSAIGGKFLELFVLVHDILHENKKSGLQADAPVLLLSYSRGRTLTYARSMLEWLSSQLVKTWESRDNKSPFDLGNRLKIVNVNDLANYPGTKICFISQVETLINDALSKVCTKEKAMLVLTEKPTYYSHTIAILAKAYAKWERALNSNNLNAVEGNPIAYSESLSLQFSKTKPLTGSDLEEFKERIEARRKERAELLSSFQSNDNPAGASAFTAIEDDDDEEEDVLRPHGAGALSTKVEIPTDLIIQPNALPKHKMFPFQPGKVAHDDYGELVDFERFLPQSAPSSAKRGATNEEDEESYDPHDFRDIRTNDSGGKRRRREQDALQRQMNQDNLSYLDTLTKPQHRTSNTQKVVIRCTMAFVDLAGLVDERSMSIIWPALKPRKMVLLPSDAASVSPVAQQLQKKGLDVIEPELNKSLVINTSLRSLDIFIDAEMDQMLNWQRISEVYTVAHVVGRLTKEKDTKVSHRDKWVLKPLPNASARMQTTDSLRIGDVRLAELKRKLTAASHVAEFRGEGTLVVDGRVIVRKISESETVVDGTPSDLFYKVKSAVADMLAKV

SEQ ID NO: 14503 - protein, 561 aa, Bacillus subtilis subsp. subtilis str. 168
MKTDWWKDAVVYQIYPRSFQDSNGDGIGDLRGIISRLDYIKELGADVIWICPIYPSPNVDYGYDVTNHKAIMDSYGTMDDFHELLDQVHQRGLKLVMDFVLNHTSVEHPWFKEAELDKNSKYRSYYYWRPGTKNGPPTDWLSNYGCPVWQYEEHTGEYYLHMNAVKQADLNWENPEVRQAVYDMMKFWLDKGVDGLRIDQLHLISKKEYLPSYEDYINQQAEPKPFQPNGERIHDYLKEITDEVFSHYDVMSVGEVGSVTPEEGLKYTGTDKHELNMIFHFQHMELDQQPGKEHWDLKPLELSDLKSVLTKWQKKLEHQGWNTLFWCNHDQPRIVSRFGDDGEYRKASAKMLAAVIYFMKGTPYIYQGEEIGMTNAPFTRIEDYKDIQTINMYHKRVFEKGYDPNDVMRSILAKSRDHARTPMQWNSGKNAGFTDGTPWLKVNPNFTAINVEEAQGDPDSVLNYYKKLISLRKQYADLMKGSFDLLLPDDPQLFVYMRENSKQQLLSVNNFSKEQAVFQWPKNCGKAQASLLLSNYNNDDLDDEMVFRPYESRVYLLDKTN

SEQ ID NO: 14504 - protein, 130 aa, Brassica napus
MMRSCLSLALLVALSAAGCAAAQAADYDFFYLVLQWPGSYCDTKQSCCYPRSGKPAADFGIHGLWPNRDDGSYPQNCNPANAFDPSKVSDLLSSLRTEWPTLACPTSDGLQFWAHEWEKHGTCAQNLFNE

SEQ ID NO: 14505 - protein, 122 aa, Vibrio sp. Ex25
MKILIVDDFSTMRRIVKNLLRDLGFNNTQEADDGLTALPMLKKGDFDFVVTDWNMPGMQGIDLLKHIRADAELKHLPVLMITAEAKREQIIEAAQAGVNGYIVKPFTAATLKEKLDKIFERL

SEQ ID NO: 14506 - protein, 316 aa, Glycyrrhiza glabra
MAAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 14507 - protein, 1420 aa, Nostoc punctiforme PCC 73102
MGAIRLARATTGRSKIALFTGSYHGIYDGILVRGVTTSEGTRRSIPRAIGIPSYIADDVIVLDYGQPESLEILKTHAHELAAVLVEPIQSSRPDLQPKEFLLQLRQLTQATGTVLIFDEVITGFRMHPGGIQGLWDIQADLTTYGKTVAAGMPIGVIAGKAALMDTLDGGMWNYGDESYPQAETTMFAGTFFKHPLVMAAAWAALNHIKNSGPKLQQELSQKTAKLAQTINSYFEKRQVPIQVVHFGSLFRFIGSSPLKFNQLFFYHLLEKGVYVWEGRTFYLSTAHTDADIEHIIRAVKESVVEMQQGELLPSAPILTTLKIPLTAAQKELWFLAQMGDEVSRAYNESRTIHLRGTCNLLAVRKAVQEIINRHEALRTTFSPEGDEQLIHSTLTIDIPVSDFSTLDKSQREAQLSELLAREAQQIFHLEKGPLLGCHIVKLEENYHLVVLTNHHIVADGWSIGILLQELAAIYSAQCQGIASQLLQPMKWSEYALWQVERQQSPEMAKAEAYWLGQFSSSVPVLELPTDRPRPPIFSYTGARENLILDPTLYNALKNLSGQRGYTLFTILLTAFITLLQRLTNQQDIVVGIASAGQSAIAGESLVGHCVNLLPIRSQVIGNPGFTEYLSAIQQVLLDAYEYQIYPFIKLIENLKLPRDPSRTPLFTTGFNLDKAQFESKSLKQEFEVAKNSTSATKFDLNLNIFQTDNELLIELEYNTDLFDCQTIQRWSKHYVTLLEGIVANPEQPLAQLPVLTKTEQQQLLVEWNNTQTDYSGEYCIHELFEVQVERSPDAIAVIFEDQQLTYRELNQRANQLAHYLRSAKLSRSNSLGVGPEVLVGIFMDRSIDMVVSILGILKAGGAYVPLDPTYPKERLAFMLSDAQVSVLLTEDKFLEGLPEHQAQVVCLNQNSEAWCQERVDNPVREVTTNNLAYVIYTSGSTGKPKGVLVNHQNVIRLFTATQSWFNFSDRDVWTNFHSYGFDFSVWEIWGSLLYGGRLVVVPYWISRSPEAFYNLLCTQQVTVLNQTPSAFRQLMNAEEEAAGKTGTLALRLVIFGGETLELDSLQPWFERHGDGSQLVNMYGITETTVHVTYRPINIADLNQRNGSLIGHRIPDLQIYLLDSQRQPVPIGVAGELYIGGAGVTRGYLNRPELTAERFIVNPFSEVTDAYLYKSGDLARYLPNGELEYLGRIDHQVKIRGFRIELGEIETALRKHQAVREVIVQAVEESHGEKRLVGYVVLDDKQAVTIGDLQRFLKEKLPEYMVPSAFIFLPALPLTPNGKLDRRSLPAPETIRPNLSDAYVMPQTEMEQTIATIWQKALNIEKIGIHDNFFELGGHSLLMVKVHSKLREIFQTDLSMIDMFRYPTISSLAECFTTIKNHTLSLQKTDVKIEKIKDGKAQQQKRLQKLKSITKSLGVKE

SEQ ID NO: 14508 - protein, 384 aa, Kluyveromyces lactis NRRL Y-1140
MTSATAGKPIECVAAVAYEAGKPLTVEKIIVDAPKAHEVRVQVTHTAVCHTDAYTLSGVDPEGAFPSILGHEGAGIVESVGDGVTNVKVGDHVVLLYTAECGKCKFCKSNKTNLCGSVRATQGKGVMPDGTTRFHNLKGEPLLHFMGCSTFSQYTVVADVSLVTIDPSAPLSSVCLLGCGVTTGYGAAVKTANVQEGDTVAVFGAGTVGLSVVQGAKSRGASKIIVVDVNDQKKQWSMDFGATGFVNPLKDLKEGETIVSKLIDMTDGGLDFTFDCTGNVKVMRDALEACHKGWGQSIIIGVAAAGEEISTRPFQLITGRVWKGSAFGGIKGRSEMGQLVTSYQKGDLKVDDFITHKRPFTEINNAFEDLHHGDCLRTVLDLAN

SEQ ID NO: 14509 - protein, 200 aa, Malus x domestica
YDYFQFTQQYQPAVCNSNPTPCNDPPEKLFTVHGLWPSNKNGPDPEKCKNIQMNSQKIGNMAAQLEIIWPNVLNRTDHVGFWEREWLKHGTCGYPTIRDDMHYLKTVIKMYITQKQNVSAILAKAMIQPNGQNRSLVDIENAIRSGTNNMKPKFKCQKNTRTTTELVEVTLCRDRDLTKFINCPQPPQGSRYLCPADVQY

SEQ ID NO: 14510 - protein, 233 aa, Triticum aestivum
  misc_feature (197)..(197): Xaa can be any naturally occurring amino acid
  unsure (1)..(233): unsure at all Xaa locations
MLLRLPYARPAPSTARWRLERARARPAQLLRRGHAAASLADGAGAPLHYDPLADLLGPDVGPSPPQNTAPVAGKGKLRSWVGPNGQYYRELPCPNCRGRGYTPCKKCGIDRSSLDCPMCNGKGIRMCMQCGGECVIWQESIDEQPWEEVRSSSPLEVKEDDEVDRLEIKIDTSKRPRRTYPSPSPEVAMEISRSLRXLFTKHLEIIPQDAQLHAQRVAAIKSTGARPPRDPGF

SEQ ID NO: 14511 - protein, 469 aa, Pantoea agglomerans
MSAEHVLSMMNEHEVKFVDLRFTDTKGKEQHVTIPAHQVNADFFEEGKMFDGSSIGGWKGINESDMVLMPDATTAVMDPFFEDSTLIIRCDILEPGTMQGYDRDPRSIAKRAEDFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGQNLFAGDKYGGLSEMALFYIGGIIKHAKAINALANPTTNSYKRLVPGYEAPVMLAYSARNRSASIRIPVVASPKARRIEARFPDPAANPYLAFTALLMAGLDGIINKIHPGDAMDKNLYDLPPEEEAEIPKVAGSLEEALNALNEDREFLTRGGVFTDESIDAYIELRKAEMDRVRMTPHPVEFELYYSV

SEQ ID NO: 14512 - protein, 315 aa, Haloarcula marismortui ATCC 43049
MNDTRHRVLDALADGPVSGPTLADELDISRSAVWKHVEALRDEGFEIRSDDAGYALDSVPEFGASAVEYGLDAPFSVEYHDSIPSTNARARDLAAEGESDTVVLADEQTGGRGRLDRDWHSPSGGIWLSVLFRPDVPMAHAPVFTLAAAVAVTRAAREAGVEAGIKWPNDVLVRHGDEERKLVGILTEMEGEADRVSWVVVGIGVNANVDPADLPDEANPTSLSTERGEPLDRRLFTQRLLEEFDALRQDTGRVVEAWREYATTLGKRVRVETPGGPIEGEAVDIQFPGALVIETASGTEVVSAGDCEHLRPVSE

SEQ ID NO: 14513 - protein, 366 aa, Glycine max
  misc_feature (334)..(334): Xaa can be any naturally occurring amino acid
  unsure (1)..(366): unsure at all Xaa locations
MSVQLSSLWVPNSPPIPQHFVPNRGRFSASALSSQSPTIQLIGTRPPTRRATRPGNPNNNNLFDGCQGESDHWSELDTDLYHWTKALRPVQWFPGHIAKAEKELKEQLKLMDVVIEVRDGRIPMSTSHPQMDLWLGNRKRILVLNREDMISTADRNAWADYFTRNGTKVVFSNGQLGMGTMKLGRLAKELAADVNVRRRTKGLLPRAVQAGIVGYPNVGKSSLVNRLLKRRMCPAAPRPGVTRELRWVRFGKDLELLDSPGILPMRINDQSAAIKLAICDDIGERSYDVADVAAILVQMLTKLPTVGRDALCKRYKIDVDCRDGRTFIEKLAVXVFNGDVHQAAFRVLADFRKGKFGWTALERPPK

SEQ ID NO: 14514 - protein, 261 aa, Mycobacterium avium subsp. paratuberculosis K-10
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAATALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 14515 - protein, 279 aa, Bacillus licheniformis ATCC 14580
MVSSLKDTVTLHNGVKMPWFGLGVFKVEEGSQVVESVKAAIKNGYRSIDTAAIYQNEEGVGKGIKESGVPREELFITSKVWNSDQGYEKTLAAFDESLRKLGLDYLDLYLIHWPGKDKYKDTWRALEKLYKDGRVKAIGVSNFNVHHLESLLEDAEIKPMVNQVEFHPRLTQTELRDYCKKQGIQVEAWSPLMQGKLLDDQVLTDIAKKYNKSVAQVILRWDLQNEVVTIPKSIKEHRIIENADIFDFELSAEDVEKINALNKDERVGPDPDTMVNGFE

SEQ ID NO: 14516 - protein, 315 aa, Glycyrrhiza glabra
MAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 14517 - protein, 548 aa, Oryza sativa
MATSAAAAASTLPYLVAAASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKVGNDLRCKCTDPGLLLPRAKLSFWRNGKLVERNFGLPTLSAKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEVADVSEAVRQYADAVMLSAESAIGAYPQKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQVRIVD

SEQ ID NO: 14518 - protein, 141 aa, Oryza sativa
  misc_feature (76)..(76): Xaa can be any naturally occurring amino acid
  unsure (1)..(141): unsure at all Xaa locations
MKTKSSSVLSNSFPILLLIFLAAAASVPQIAMSAEQPEQAAPAAQEATVQIVYLDRPADADPEEFHIRTLAPVLGXSEEKAKEAVLYHYKHAASGFSAKLTPQQVEELKKQPGVLQVVPSQTYQLHGPGAGTGTMNTFSLV

SEQ ID NO: 14519 - protein, 714 aa, Gibberella zeae PH-1
MAAQPSASSSTAPATGPASAAGSEKDAHSSTPSSDIPVRSKESFDKLMVERFITRDAIAAAALGGQLDQTRKIMSDTRDKIQEYRQVRTDYRQWFPPSKLYGEGYNGFGNGYTENQGASRIIYPSQKSRPGQRTTPPFKYKRKDMLKQAEQHEELVPLRLEVEWDKIKLRDTFTWNLHERLLHVELFAAQLVEDMGLKPPVSQPVYEQVVHQMREQLNDFYPLVYSEDDALDPELPYSAYKNDEMRVLIKLNITIGQHTLVDQFEWEINNPSNSPEDFAANMARDLSLSGEFTTAIAHCIREQTQLFTRSLYSVGHPFDGRPIEDPDLVGAFLQTPLPNVFRPQQQAKDYAPYLYELSEADLERNETIFSREQRRQKRSINRRGGPQLPDLRERQRTIRTLVVSSVLPGAAATIDESRLYKRAAGPRTKRPIRDGDLSESDDSEDSGPDSPAPSQITGGTARTRGMRGAASAAQQRMANLGRSETPEASAIAHHHETRTSRRFREETEEPSQLIVTLKLSSDKLRRLMNRDYSDLTAPSHASVAFPRAPSASTPSRSMPPPPSTPSSVPPHASMTPSSSLPPGQIGRLPAPPTIPGQSASIPQFVLTEPLPQPPPPEWLVNALKELEKTYNRGDRFEAMMKYSYLDPVTELPIQGQPLPEGVKYAWLPRIRCLDCTNKLYTPGPDMTVRKFEAHLEFSGHKNAVAKRVAREANP

SEQ ID NO: 14520 - protein, 466 aa, Triticum aestivum
  misc_feature (172)..(172): Xaa can be any naturally occurring amino acid
  misc_feature (176)..(176): Xaa can be any naturally occurring amino acid
  misc_feature (189)..(189): Xaa can be any naturally occurring amino acid
  misc_feature (321)..(321): Xaa can be any naturally occurring amino acid
  misc_feature (328)..(328): Xaa can be any naturally occurring amino acid
  misc_feature (351)..(351): Xaa can be any naturally occurring amino acid
  unsure (1)..(466): unsure at all Xaa locations
NAEKFQSFWSDPAESSCADALRIKELAITTLTNYLTKENRAEDLRNLLTQLRPFFSLIPKAKTAKIVRGIIDAVAKIPGTSDLQISLCKEMVEWTRAEKRTFLRQRVEARLAALLLENQEYTEALTLLTGLIKEVRRLDDKLLLVDIDLLESKLHFSLRNLPKAKASLTAAXLNTXSINWRGEKRGTMXLQSGILHAEEKDYKTAYSYFFEAFEAFNALDDPRAIFSLKYMLLCKIMVNHADDVAGIISSKASLKYVGPDVDAMKAVADAYSKRSLKYFETALRDYKAQLEEDPIVHRHLSSLYDTLLEQNLCRLIEPYSXLNTIKLXQRGERRVDHVEKKLSQMILDKKXFAGTLDQGAGCLIIFEEMKTEAIFPSTLETISNVGKVVDSLYMRYAKDFEIMVCMEGLTEVLGWIEVPVITSQGSDMMRCTSLVQERLSVRKRVCETYHTLANFTCCIDSKVLLI

SEQ ID NO: 14521 - protein, 261 aa, Thiomicrospira crunogena XCL-2
MTLTKLHKMKQAGEKIVCLTAYEASQAYWAVEAGVEVILVGDSLGMVVQGHQTTLPVTLNDMVYHTQMVQRKNHQAWCIADIPFMSDMNLSSVLDSAARLMKEGQANMVKLEGGQRVVEMVQALSDLGVPVCGHLGLLPQSVQKKGYQVAGKEAESAARLLGEAKMLESAGADMLVLECVPAQLAKQITQNLSIPVIGIGAGHETDGQVLVLHDVLGLTIGKAPKFSKNFLSEADSIQTALYQYVSDVKSGRFPASEHCVG

SEQ ID NO: 14522 - protein, 401 aa, Bdellovibrio bacteriovorus HD100
MSAQRILLVENIHTVAKERLEEEGYKVDLITHAPSEDELLKILPNYDVLGIRSKTEVTKKVLDSNKHLVTIGCFCIGTNQVDLLTARERGIPVFNAPHSNTRSVAELVIAEMISLSRQLGDRNTQAHLGEWVKSAVGSKEVRGKTLGIVGYGHIGSQVSILAESMGLKVLFYDVLKKLPLGNAMVQNSLEDLLRSSDFVTLHVPETPETKDMIGARELSMMKKGSFLINASRGTVVVIDDLVKSLQEKHLAGCAIDVFPEEPASNKEKFKSPLQGIPNVILTPHIAGSTEEAQYAIGLEVAESFRRYLKIGSSPGAVNFPNVDLPVKQGTSRILNVHRNEPGVLGEINGLISKAGANIEGQYLSTDEKIGYLVMDLHSSQAHTLAADIEKLSRSIRTRVVY

SEQ ID NO: 14523 - protein, 1055 aa, Arabidopsis thaliana
MVKSGARASDSFIKQRSGSGSILRIKVENFMCHSYLQIEFGEWVNFITGQNGSGKSAILTALCIAFGCRARGTQRAATLKDFIKTGCSYAVVQVEMKNSGEDAFKSEIYGGVIIIERRITESATATVLKDYLGKKVSNKRDELRELVEHFNIDVENPCVVMSQDKAGSSYILECKGNSSSFLRNLLQQVNDLLQSIYEHLTKATAIVDELENTIKPIEKEISELRGKIKNMEQVEEIAQRLQQLKKKLAWSWVYDVGRQLQEQTEKIVKLKERIPTCQAKIDWELGKVESLRDTLTKKKAQVACLMDESTAMKREIESFHQSAKTAVREKIALQEEFNHKCNYVQKIKDRVRRLERQVGDINEQTMKNTQAEQSEIEEKLKYLEREVEKVETLRSRLKEEENCFLEKAFEGRKKMEHIEDMIKNHQKRQRFITSNINDLKKHQTNKVTAFGGDRVINLLQAIERNHRRFRKPPIGPIGSHVTLVNGNKWASSVEQALGTLLNAFIVTDHKDSLTLRGCANEANYRNLKIIIYDFSRPRLNIPRHMVPQTEHPTIFSVIDSDNPTFLNVLVDQSGVERQVLAENYEEGKAVAFGKRLSNLKEVYTLDGYKMFFRGPVQTTLPPLSRRPSRLCASFDDQIKDLEIEASKEQNEINQCMRRKREAEENLEELELKVRQLKKHRSQAEKVLTTKELEMHDLKNTVAAEIESLPSSSVNELQREIMKDLEEIDEKEAFLEKLQNCLKEAELKANKLTALFENMRESAKGEIDAFEEAENELKKIEKDLQSAEAEKIHYENIMKNKVLPDIKNAEANYEELKNKRKESDQKASEICPESEIESLGPWDGSTPEQLSAQITRMNQRLHRENQQFSESIDDLRMMYESLERKIAKKRKSYQDHREKLMACKNALDSRWAKFQRNASLLRRQLTWQFNAHLGKKGISGHIKVSYENKTLSIEVKMPQDATSNVVRDTKGLSGGERSFSTLCFALALHEMTEAPFRAMDEFDVFMDAVSRKISLDALVDFAIGEGSQWMFITPHDISMVKSHERIKKQQMAAPRS

SEQ ID NO: 14524 - protein, 481 aa, Vibrio angustum S14
MTERLRRTKIVTTLGPATDRDNNLEKIIAAGANVVRMNFSHGSPEDHIQRTKQVREIAAKLGKNVAILGDLQGPKIRVSTFKEDKIQLAIGDKFTLDSDLPKGEGDQFAVGLDYKELPKDVATGDVLLLDDGRVQLKVTSVEGNKVHTEVTVAGPLSNNKGINKKGGGLSAEALTDKDKADILTAAAMGVDYLAVSFPRNGEDMKYARRLATEAGLNAKLVAKVERAEAVATTEAMDDIILASDVVMVARGDLGVEIGDPELVGVQKKLIRRARSLNRTVITATQMMESMITSPMPTRAEVMDVANAVLDGTDAVMLSAETAAGQFPEETVKAMASVCLGAEKEPSINVSNHRLDRFFSSPEETIAMSTMYAANHMEGVKAMVAMTESGRTPLMMSRISSGLPIFALSRNENTLNQASLFRGVTPVFFNRDSDAGLEAAKHALDVLRDAGFVNVGDLVIITQGDVMDTVGSTNNMRILTVE

SEQ ID NO: 14525 - protein, 361 aa, Methylobacillus flagellatus KT
MISPTIEIIEEMRQGRMVILVDEEDRENEGDLVLAAQFTTAEHINFMAKHGRGLICLTLTEERCKQLNLPAMVQKNGSGMGTNFTVSIEAATGVTTGISASDRARTIQAAVAPNAKPTDIVSPGHIFPVAAQNGGVLVRAGHTEAGCDLAALAGLTPASVICEILKEDGSMARLPDLIEFAKQHNLKIGTIADLIQYRNEHECLVKRAAERDVITPYGPMRLIAYADMIAKETHLALVKGEITPDKEVLVRVHEPLSVFDLIDESSRSHSWNTLQAMRKIQEAEAGIVILLHNGEGAEDLVERIKFADEPVRIRQDLRNYGIGSQILLDLGVRKMKLLAAPRKMPSIVGFGLEITGYVEAP

SEQ ID NO: 14526 - protein, 154 aa, Arabidopsis thaliana
MRRGGKEEDEVEQLLQAAQDEMILKLSVDSHTSRSSSDYLDPDLHSRFLALKSQKKKDQQPKSKDVVEETPEDLMLRFAALKTSLPSASSSSSVLLQDEIGEDGDEIGEDAEVDKLIQWAIDAARLDPSPSSDDEQSQNCDSDDENDSTRDVKP

SEQ ID NO: 14527 - protein, 335 aa, Prochlorococcus marinus str. NATL2A
MTNKTNAASLDIVGIGNAIVDVLTTTDDSFLKKLSFDKGSMTLIDEKKAKELYEMTTNRIQKSGGSVANSLACVAQLGGKAAFIGRVRDDKLGEIFTEEISTTGTIFKTPPSSVGPSTARCIIFVTPDAQRTMCTYLGASVLLEPKDIDLSLVREAKILYLEGYLWDNPAAKNAFIKAAEIAKNAGRKVALSLSDSFCVSRHRESFIKLVEEHIDILFANEDEITNLYETSSLSNALEKLKKKCDLAAITIGEKGSILISNGKEIKIDPFILGKAIDTTGAGDLYAGAFLKGYADGLKPELSAKIGSICAGQIVTQLGSRSNTDLLNLINSHLEA

SEQ ID NO: 14528 - protein, 142 aa, Erwinia carotovora subsp. atroseptica SCRI1043
MTIERTFSIVKPNAVAKNAIGAIYARFESAGFTIVASKMLRLSREQAEGFYAEHKGKPFFDGLVEFMMSGPIMVQALEGENAVQRNRDIMGATNPANALAGTLRADYADSFTANAVHGSDSIESAQREIAYFFSDDEICPRA

SEQ ID NO: 14529 - protein, 283 aa, Lechevalieria aerocolonigenes
MTESKSEGTAVAAPTPEEVRQMYDDFTDPFARIWGENLHFGYWEDAGADVSVDDATDRLTDEMIALLDVRSGDRVLDVGCGIGKPAVRLATARDVRVTGISISRPQVNQANARATAAGLANRVTFSYADAMDLPFEDASFDAVWALESLHHMPDRGRALREMARVLRPGGTVAIADFVLLAPVEGAKKEAVDAFRAGGGVLSLGGIDEYESDVRQAELVVTSTVDISAQARPSLVKTAEAFENARSQVEPFMGAEGLDRMIATFRGLAEVPEAGYVLIGARKP

SEQ ID NO: 14530 - protein, 372 aa, marine gamma proteobacterium HTCC2207
MVLNTIEELIEDIRQGKMVILMDDEDRENEGDLVMAAPMVRAQDINFMATHARGLICLTLHEDRCKQLELAMMVNSSQNNASHGTPFTLSIEAAEGVTTGISAADRARTVQAAVASSARPEDIVQPGHIFPLKAQPGGVLSRAGHTEAGCDMAKMAGFEPAAVIVEIMNEDGTMARRDDLEVFAQKHDLKIGTIADLIHHRLVTEKTTTCISERAVSTSFGDFTLKTYHDDVHGEKHFALVMGDVIGEEPVLVRVHTNRSARDLLAIEDSSTFKSWSFHKALERVAAEGRGVVVLLYYPESSEDIDRSIEQILNPGQARSQQASEVVYQQVGTGSQILRDLGIQKMRLMSAPFKFTGISGFDLEVVEHVDYE

SEQ ID NO: 14531 - protein, 620 aa, Escherichia coli CFT073
MDSHTLIQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTQMGRSAFAVLLFQDIAAIPLVAMIPLLAASSASTTMGAFVLSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLLENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 14532 - protein, 482 aa, Photobacterium profundum SS9
MNLNDPSLFKQKCYIAGQWVTAENGKVEPVTNPSTGEIIGYVPVMGQEETLHAIEVAQQAFLSWKKVSAKERSNTLRKWYELILENVDDLATIMTTEQGKPFAEAKGEVVYAANFIEWFAEEAKRTYGEVIPSHKTDARIVVSKEPIGVVGAITPWNFPAAMITRKCGPAFAAGCAVVLKPAPDTPFSAFALAELAERAGLPSGLFNVITGDAVAIGGELTKNKVVKKISFTGSTAVGKLLMAQSAPTVKKLSLELGGNAPFIVFEDADLDAAIDGVMVAKFRNAGQTCVCANRLYVHETVYDVFVEKLVQRVSTLIMADGFTDGATIGPLINRASAEKVQSHVTDALDKGATLAFGEKADPATNFFPPHVITHVTDEMRVATEETFGPLAAVFSFATEDEVIARANDTDSGLASYVYTRSLQRAWRMGESLEFGMVGINEGLISTEVAPFGGVKESGLGREGARQGICDYMETKYMLMGGL

SEQ ID NO: 14533 - protein, 400 aa, Acorus calamus
MNRRRKDMTVPATRQDLMIVNMGPHHPSMHGVLRLIVTLDGEDVIDCEPILGYLHRGMEKIAENRTIIQYLPYVTRWDYLATMFTEAITVNGPEQLGNIQIPKRASYIRVIMLELSRIASHLLWLGPFMADIGAQTPFFYIFRERELIYDLFEAATGMRMMHNYFRIGGVAADLPYGWIDKCLDFCDYFLTGIVEYEKLITQNPIFLERVERVGIISGEEAINWGLSGPMLRASGIEWDLRKVDNYECYNEFDWEVQWQKEGDSLARYLVRISEMKESIKIIQQALEGIPGGPYENLEVRRFDKVKDSEWNDFEYRFISKKPSPTFELAKQELYVRVEAPKGELGIFLIGDNSVFPWRWKIRPPGFINLQILPQLVKRMKLADIMTILGSIDIIMGEVDR

SEQ ID NO: 14534 - protein, 322 aa, Yarrowia lipolytica CLIB122
MSRSKFTEYKQAARNFWVPEPHFTEKDYPDLTGKTYVITGGHSGVGLEATKLLIGKGAKVIIVGRNKEKAQDVLKELPDGKFDFAEADLADLTTISTAGDYITKNYPEIHGVILNAGVMTPPYSKTAQGHELQWGTNVVGHQAIMKYLTPIVIKTAKTSPPGTVRLVWVSSSAVVISGLPGGINFDDINYEKEENPSPHVLYSQSKIGNAYQAYLWSKNHPDSGVISVSVDPGNLKSNLQRHSSEFLKKAFNYVLYPAQYGAYTELAALLAPDVHDGEHLIPWGVPGHLRWDVDEGRKGEKGEHLWKKLEGDVKDFVKESYP

SEQ ID NO: 14535 - protein, 429 aa, Silene latifolia
  misc_feature (277)..(277): Xaa can be any naturally occurring amino acid
  misc_feature (418)..(418): Xaa can be any naturally occurring amino acid
  unsure (1)..(429): unsure at all Xaa locations
RWGPLIEEATYKNRQRLYLSEQQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDXRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACXPTPTKDVNHSA

SEQ ID NO: 14536 - protein, 318 aa, Oryza sativa
MEETIFSSTHTRIAVVTGGNKGIGLEVCRQLAGNGATVVLTARDEAKGAAAVEKLHGLGLSSVIFHQLDVTDASSIARLAEFLESRFGRLDILVNNAAVGGIVPVDDPSFGLLPTEEKFSGMDGHQRIEWMWKNCRQTYDAAKAGLKTNYYGTKNVTEALLPLLQSSSDGRIVNVASSFGLLRTADTKDCMQFFTNEELKRELNDADSLSEERLDELLGMFVRDFEAGAVAERGWPTEFSAYKVAKAAMSAYARILARKRPALRVNCVDPGYVKTDLTRNSGLLTPEEGASRVVAVALLPAGGPTGALFDGGKEASFV

SEQ ID NO: 14537 - protein, 616 aa, Bacteroides fragilis YCH46
MKKLLLLLGSFLLSLTTYAAMNISKIDPPCWFTGMNNPELQLMVYGEGIGQASVSVNYPGVSLSSVVKLESNNYLLVYLHLDKEVKPGKMPITFTVGKKKLVKEYELKARSKAGVDHKGFDASDALYLLMPDRFANGNPDNDRIEGMAEYKVDRNDPNARHGGDLAGIEQNLDYFTDLGVTALWFTPVLENNMKGGSYHGYATTDYYKVDPRFGTNEEYRSLIAKAHNRGIKVVMDMIFNHCGVEHPWIKDMPSKDWFNHADFKNNFVQTSYKLTPHVDPYASEYDFDQMNNGWFVEAMPDLNQKNPHVYKYLLQNSLWWIEYADIDGIRMDTYPYADYDAMSNWMKELNEEYPNYNTVGETWVTEPAYTAWWQKDSKLSAPRNSHLKTVMDFSFFDKVNTAKNEQTDTWFKGLDRVYNNFVYDYLYPNPASVLAFIENHDTDRFLGEGENLDMLKQASTLLLTTRRIPQLYYGTEVMMNGVKSKSDGYVRKDFPGGWTDDKENALTPEGRTRLQNESYNFYRNLLNWRKGNDVIAKGSMKQFMVQHGVYAYARQYKGKTVFVLLNGTDKEVKLPLKYYAEVLKDKTQGKDVISGKVTALNEELTMAPRQSMVIEL

SEQ ID NO: 14538 - protein, 950 aa, Neisseria meningitidis Z2491
MKLSELFNPNEFAARHLSFGDEAALLAAVDEKSMDEFVGNTVPQSIRMPSELDLPEALTEADALAKLKGIASKNMINKSYIGLGYYPTRVPNVILRNVLENPGWYTAYTPYQAEIAQGRLEALLNFQQVCIDLTGFPVAGASLLDEATAAAEAMAMAHRVGKVKSERFFVDERVYPQTLDVMKTRAKYFGFELVVGDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIADRIHALASAFADALVSDGLNVVHKVFFDTVTVDFGNKEKADQVFAAALESGYNLRRVNDTQVAAAFHETSACEDLVDLYRAFTGKDTFAFADDVKGRLNAELLRQDDILQHPVFNSYHTEHEMLRYLKKLEDRDLAMNRSMISLGSCTMKLNATAEMLPITWAEFSDIHPYAPEAQTAGYRELLADMENSLKAITGFDAISLQPNSGAQGEYTGMLSIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTAVAAAAYGSASILPITWMYLTMMGKQGMEQATRWALLNANYVAKRLSEDYPILYTGKNGRVAHECIVDLRPLKAESGITETDIAKRLMDYGFHAPTVSFPVAGTLMIEPTESESKAELDRFIATLKSIRREVQKVIDGEWPKDDNPLVNAPHTAADITGNWAHPYSREEAVFPLPFVREHKFWPFVNRVDDVYGDRNLVCSCPPMENYED

SEQ ID NO: 14539 - protein, 446 aa, Methanosarcina mazei Go1
MLSPIAWSTPPKKYGPWEAMVSLLTEGLVKRGIDVTLFATADSHTSGKLHAVCPRPYEEDKNIHVKVYECLHISEVFERADEFDIIHNHFDYLPLTYSRLVDTPVVTTVHGISSRRILPVYKKYNNSTFYVSISDAYRCDELEYIATVHHGIDTGSFPFNESPEDYLLYISRIHRDKGTKEAIEVAKRTGMRLKIAGFIADPEYFENEVAPHIDSEQIIYEGHVSHQHKKDLLSHARALLHMINYEEAFGLGVVEALTCGTPVIAINKGAMPELIIDGETGFLVNGVEEAVDAVQKLGSISRKKCRESVEIRFSVERMVEDYIKVYETILEKYRREEKRPWGFYEILTEKPGYKVKRITVLPQEEISLQRHAHRQEHWYIVSGEGLVTKNTDQIRVFSGDSVDLGVKEIHRVKNTGGQNLVFIEIAQGDYLGEDDIERFEDKYGRA

SEQ ID NO: 14540 - protein, 276 aa, Zea mays
  misc_feature (240)..(240): Xaa can be any naturally occurring amino acid
  unsure (1)..(276): unsure at all Xaa locations
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKXPEFVDIIKSATVKSSSCLVVFEMHAVACRSGFCLSL

SEQ ID NO: 14541 - protein, 83 aa, Zea mays
  misc_feature (51)..(51): Xaa can be any naturally occurring amino acid
  unsure (1)..(83): unsure at all Xaa locations
MNTVSLHAPRPSTGNFLMPTRDNLLPIRVDLEVDGQRYRDAYTWNPRDTDXEIISYSKRTAKDLKLAAQLRTPDAPMHALGNL

SEQ ID NO: 14542 - protein, 101 aa, Brassica napus
  misc_feature (6)..(6): Xaa can be any naturally occurring amino acid
  misc_feature (11)..(11): Xaa can be any naturally occurring amino acid
  misc_feature (21)..(21): Xaa can be any naturally occurring amino acid
  misc_feature (51)..(51): Xaa can be any naturally occurring amino acid
  misc_feature (58)..(58): Xaa can be any naturally occurring amino acid
  misc_feature (62)..(62): Xaa can be any naturally occurring amino acid
  misc_feature (75)..(75): Xaa can be any naturally occurring amino acid
  misc_feature (88)..(89): Xaa can be any naturally occurring amino acid
  misc_feature (92)..(92): Xaa can be any naturally occurring amino acid
  misc_feature (94)..(94): Xaa can be any naturally occurring amino acid
  misc_feature (96)..(96): Xaa can be any naturally occurring amino acid
  misc_feature (98)..(99): Xaa can be any naturally occurring amino acid
  unsure (1)..(101): unsure at all Xaa locations
EKEEVXAYSMXSSATVVTSPXQATMVVPFTGLKSSSAFPVTRKANNDITSXVSNGGRXNCMXAWPPIGKKKFETXSYLPDLTEAELPXXVDXLXRXKXXPC

SEQ ID NO: 14543 - protein, 1028 aa, Kluyveromyces lactis NRRL Y-1140
MLKYRSSVTVVRQFARTRVPLGLTPALGYRFVSTKCNVSSNQYGKIYEAKKNGPDAYEPLDTFQRRHLGPSPSNVDQMLKQLGYTDLDQFINGVVPENILVKRPLELNSPENGFTEQQMLKHLEELANKNNHKVRNFIGKGYYGTVLPPVIQRNLLECPEWYTSYTPYQPEISQGRLESLLNYQTVVSDLTGLPVANASLLDEGTAAGEAMLLSFNVAKKKKLTYVIDKRLHKQTKSVLKTRTEPFGIKLVEVDPLDESTWSVLSSDKDVSGCLVQYPDTEGNIIPGETLAKLADIVHQSKGLFAVASDLLALTLLKPPAQFGADIVLGSSQRFGVPFGYGGPHAAFFSVIEKLNRKIPGRIVGVSKDRLGKPALRLALQTREQHIKRDKATSNICTAQALLANIAANYCVYHGPQGLKEIAGRVYGFTTVLANGLSSSNHTLLNKSWFDTLTVELNGISAQDFIKTAVDKYQINLYQVNNETVSLSLDETVTKDDLIALLELFGCNANELPVALPEFPQELTRQDEILSNEVFNTHHSETAMLRYLHRLQSRDLSLANSMIPLGSCTMKLNATVEMIPITWPQFANIHPFQPRDQVEGYEVLIKNLEKDLASITGFDEVSLQPNSGAQGEYAGLRVIRRYFEDRGETHRNICLIPVSAHGTNPASAAMCGLKVIPVNCLKNGSLDLVDLKAKAEKHKDNLAAIMITYPSTYGLFEPGVRTAIDLVHENGGQVYLDGANMNAQVGLTSPGDLNADVCHLNLHKTFSIPHGGGGPGMGPICVQSHLAPYLPAHDVVPMITGVGSDKSIASVSSAPYGSASILPISYAYIKMMGSKGLPFSSVIAMLNANYMMSRLRPHYNILFVGEKGSTTETEDLTHCGHEFIIDLRAYKDQGVEAIDVAKRLQDYGFHAPTLAFPVPGTLMVEPTESENLEELERFIDAMISIKKEIDLFIKGDPQGQVLKNSPHSLEDVVSSDDWSSRGYTREQAVYPLPYLKYNKFWPPVARLDDTYGDTHLMCTCPSVEEVASE

SEQ ID NO: 14544 - protein, 228 aa, Triticum aestivum
MMRSCLPLALLVALSAAGCAAAQAADYDFFYLVLQWPGSYCDTKQSCCYPRSGKPAADFGIHGLWPNRDDGSYPQNCNPANAFDPSKVSDLLSSLRREWPTLACPTSDGLQFWAHEWEKHGTCAQNLFNEHGYFQTALHLRDQLRVLDALTSAGVSPDGGYYTLSAIKGAIQQGTGFEPFVECNRDESGNSQLYQLYFCVDANASGFVECPVQPGGRPCGNRVEFPTF

SEQ ID NO: 14545 - protein, 585 aa, Coccidioides immitis RS
MPLLSSEGPRPKVLVPEKLSPDGLALLRASTDVHEKMGLAPEELLTIISDYDALVVRSETKVTDEVLQTAKKLKVVARAGVGVDNVDVDTATKLGIVVVNSPAGNVGAAAEHTIALMMGTARKISHACSSLKGDKWERSKFVGVEVKGKTLGIIGLGKVGMIVARLAKGLGMNVNAMDPYASEAVASSASITLVSSLSELLPTVDFLTIHTPLIASTKGMISTAELANMKPGARILNVARGGTIDEIALLDALESGHIAGAGIDVFTSEPPKPGSSASRLIAHPNVVATPHLGASTVEAQENVSIDVCEQVLQILGGALPRSAVNAPLILPEEYKKLQPFVRLVEKMGSLYTQHYSSSTSFDANRSTFDLIYEGDIAGINNTKPLFAAFIKGLMATISSTNVSIVNAELVARERGIVVNEQRSRDPSTHSYSSLVTLVARPPSRAPSRAPGVAETQRPLQNPHQQIISGTCSGSQIIISRLGRFATSFVPEGRLLICHNYDSPGKIGVVGSILGKEDVNINFMSVAPISKQLLEENAAKGQNGGNGNGIHTEALMLLGVDGPVSQDVVTALVDSGGVLSASLVSL

SEQ ID NO: 14546 - protein, 478 aa, Streptomyces coelicolor A3(2)
MRRAKIVCTLGPATDSYDQIKDLVDAGMDIARFNFSHGTHAEHEERYHRVRKASDETGRSVGALADLQGPKIRLGHFGEGPVLLERGDSFTITVEEGVEGDRYICGTTYAGLAEDVTPGERVLVDDGKVCLEVTGVDGTRVRTRVIEGGMVSDHKGLNLPGVAVSVPALSKKDEDDLRWALRAGFDVVALSFVRSGRDILDVHRIMDEEGRRLPVIAKVEKPQAVENIEDIVAAFDGIMVARGDLGVEMPLEQVPTVQKRAVKLAKRNAKPVIVATQMLDSMIDNARPTRAEASDVANAVIDGTDAVMLSGETSVGKHPTDTVRTMARIVEAAEEDILAKGLPPLTERNKPRTQGGAVARAAAEMGDFLGAKFLVAFTQSGDTVRRLSRYRSPIPLLAFTPEPATRSQLSLTWGVETFLGPHADSTDAMVDQVDELLTRYGRCEKGDVVVITAGSPPGVSGTTNLVRVHHIGEDDIPK

SEQ ID NO: 14547 - protein, 102 aa, Zea mays
AAAGGLRRLLAAAATAGAAEVRASIFGHALNPTGRRAATKLLRKKMVGDQVAQWYPYDIKRDDPLVMAREEKERLAKLEMLKRRGKGPPKKGQGRRAVKRSK

SEQ ID NO: 14548 - protein, 359 aa, Oryza sativa
  misc_feature (97)..(97): Xaa can be any naturally occurring amino acid
  unsure (1)..(359): unsure at all Xaa locations
MSAYCGKYKDELIKNAAYIGTPGKGILAADESTGTIGKRFASINVENVEDNRRAFRELLFCTPGALQYISGVILFDETLYQKTKDGKPFVDILKEGXGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 14549 - protein, 269 aa, Methylobacillus flagellatus KT
MKISFIGGGNMARAIIGGLKQKGYSMATISVIELDAAKREQLTEEFGIHATEHLPSVANADIIVLAVKPQQLRDLAIFLASFLNQQLVISIAAGIPCAALSRWLNGYRAIVRAMPNTPAQIQVGISGLYAADGVSIEQREQADLLLSAAGSTLWVDDEQKIDAVTAISGSGPAYVFYFIEALEQAALELGFAPYQARALSLQTFLGASKLASQSDAPAATLRAQVTSKGGTTERAILSMEQAGIKQAIIQAAQAAAKRARELGEQLGKD

SEQ ID NO: 14550 - protein, 320 aa, Aspergillus oryzae
MTFHPDTLPNLKGKVFIVTGGNSGIGYYTVTHLAEHGAHVYLCARSLEKGTAAIANIKEMHPSANINLLQMDFMDLTSVVAAAKHFLTLETALHGLVNNAGIMATPFEITKDGHEAQWQTNYLAHWVLTEHFLPLMLLTAKGLYPGSVRIVNLTSSGHLGAPKGGINFKDLSLKDSGPWARYGQSKLANILHAKALHKAYGPGSPSARNGEGEIWVSSVHPGLVETNLATSVEDSGSGMTCVFSVLRMFGLMWSADKGSWTSLFCVASQDMKAEQSGTYLEIFRRFGEPRWQSDMANDWKLVKRLEEWTREVVRKEGWVL

SEQ ID NO: 14551 - protein, 647 aa, Yarrowia lipolytica
MSFPQQVIAPGQRLNELLEAIKQEFDSVTNEASVYRLHKDEFDVKVNQQTSDLGQIRQSVYELEMAHRKMKERYEEEIMRLKSELEARGGPAANPAHSQQQQQQQQQQQQQQQQNQQAQDQQARAAQQQAAQQQALAQQQAAQQQALAQQQAQAQQQAQAQAHHMGGVPPSQGQPPSLLRPSSNVFSGIMSGQPGTSSLAPPQGQPGQPQPGQPQPGQPQPYSGYVGANGYTSSPHNGPPVISAMASPNSKKRQVSTPVPGKASPQVAPQEMQQQQQQQGPPQQQQPPQQQQQSPEEMGNYLGDMDIERVPPELKKQKADWFVVYNQRAPRLLDVDIVQSLDHNSVVCCVRFSADGKYIATGCNRSAQIFDVQTGQLICRLQDDSVDREGDLYIRSVCFSPDGKYLATGAEDKQIRVWDIKSQSIRHVFTGHEQDIYSLDFSRNGRHIASGSGDRTVRMWDIESGQCTLTLSIEDGVTTVAISPDGKFVAAGSLDKSVRIWDTSTGFLVERLEAPDGHKDSVYSVAFTPNGMDLVSGSLDKTIKLWELQAPRGIQANQRGGVCVKTLCGHKDFVLSVASTLDGQWILSGSKDRGVQFWDPRTGQVQLMLQGHRNSVISVAPSPMGGLFATGSGDCKARIWRYFPVNR

SEQ ID NO: 14552 - protein, 687 aa, Candida glabrata CBS 138
MGNTSSKTKTSIKKKGKKLSNVAVPPALSKSDTTQSTKSVRSQSSRHSDVSRPTHSRKSSIHNFGASSEALNTEEPPLASTNDTRKGTENMSANNSISNNIGGLSNSGGNNTEGNNYLTAGTSMNNARRASSSRRSSYNHGELPPSMIQIEPKPPILRNSKTLSSANSFAYDENALTDDDENNNSISNNNDNSIVHTFGRDRNLSATEFQRTSSMSSSSRMRRKSDNSGIDRGDTPIGKSSLHRTNSMASSLLSRKSSFGSNGNTEYSTPLHSPAAVLDGNRGDYFGAQPGENNNLDTIGGNRDKLAELNNDKYRKSSMSSNQSGHSKLQIDAYPSISSDVAIAEAQTEIGIDTKKKKPVKPIDIDETIQKLLDAGYAAKRTKNVCLKNSEIAQICQKAREIFLAQPALLELSPSVKIVGDVHGQYGDLLRLFTKCGFPPMANYLFLGDYVDRGKQSLETILLLLCYKIKYPENFFLLRGNHECANVTRVYGFYDECKRRCNIKTWKTFIDTFNTLPLAAIVTGKIFCVHGGLSPVLNSMDEIRHVSRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLMCSFELLDPLDSAALKQVMKKGRQERKLAAQQQHQQQLQQD

SEQ ID NO: 14553 - protein, 282 aa, Bacillus licheniformis ATCC 14580
MMTAKNLQDRIKLNNGTAMPWFGLGVFKVEEGPELVQAVKTAIKHGYRSIDTAAIYGNEEGVGQGIREGLKEAGISREDLFVTSKVWNDDLGYDETIAAYEASLEKLGLDYLDLYLIHWPVEGRYKAAWKALETLYEQGRVKAIGVSNFQIHHLEDLLKDAAVKPAINQVEYHPRLTQKELQAFCRAHGIQLQAWSPLMQGQLLSHPLLKDIADKYGKTPAQVILRWDLQNGVVTIPKSTKAERIAQNADIFDFELTTEEMKQIDALNENTRVGPDPDNFDF

SEQ ID NO: 14554 - protein, 494 aa, Euglena gracilis
MSATQLLGGYQTISERTAPQNKLAVVGAVAVIAVASGVAAGYALNLSMPPLLPPCAPLAHGHLSRTTWHRPTPAAVAFASASEGAQTFVAPAAQSSNTFATSSVAASIGMVMGAGAVLLARMNQKPVAMNAWTGSVYGVLSQLWRSHGPSMLMSVRQDHLHPWQGILAADESRPNKTCGARLKSIGVENTEENVHSSRSCVHRTWLQRGNILGVIMYEETLYQKDKNGKPFVQIINEAGAVAGVKVDTGIAPLPGADDEGYTMGLDGLRERCQEYYRQGARFAKWRAVLRIDSKGLPSDRSILANATGLAQYAAICQECGLVPIVEPEILMDGDHDIETAAAAAERVLVAVYDALATQGVLLEGTLLKPNMVTPGVDSGIKATPETLPIFTCALLATVPAAVAGISFLSGGSSEEDASLNLNAINAIPYERKPWALTFSFGRALQASTLKTWGGKDENIARLRRCSLSVPSQWPGKYQGSGQAGESLFVKGYKY

SEQ ID NO: 14555 - protein, 332 aa, Candida glabrata CBS 138
MVRIAINGFGRIGRLVLRVALSRSNIEVVAVNDPFITTDYAAYMFKYDSTHGRYAGEVTHDDKHIIIDGKKIAVHQERDPANLPWGSENIDIAIDSTGVFKELDTAQKHIDAGAKKVVITAPSSTAPMFVVGVNEDKYTSDLKIVSNASCTTNCLAPLAKVIDEAFGIEEGLMTTVHSLTATQKTVDGPSHKDWRGGRTASGNIIPSSTGAAKAVGKVLPQLQGKLTGMAFRVPTVDVSVVDLTVKLQKETTYDEIKKVIKQASEGKLKGVLGYTEDAVVSSDFLGDSRSSIFDASAGIQLSPKFVKLVSWYDNEYGYSTRVVDLVEHVAKN

SEQ ID NO: 14556 - protein, 182 aa, Mesembryanthemum crystallinum
MASSMVSSAAVATVNRTPAQASMVAPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 14557 - protein, 393 aa, Oenothera elata subsp. hookeri
MNVTTTRKDLMIVNMGPHHPSMHGVLRLILTLDGEDVIDCEPILGYLHRGMEKIAENRTVIQYLPYVTRWDYLATMFTEAITINGPEQLGNIQVPKRASYIRIIMLELSRIASHLLWLGPFMADIGAQTPFFYIFRERELVYDLFEAATGMRMMHNYFRIGGVAADLPYGWIDKCLDFCDYFLTAVSEYQKLITRNPIFLERVEGVGIIGGEEAINWGLSGPMLRASGIEWDLRKVDRYECYGELDWEIRWQKEGDSLARYLVRMSEMTESIKIIQQALEGIPGGPYENLEIRCFDREKDPEWDGFEYRFISKKPSPTFELPKQELYVRVEAPKGELGIFLIGDQSGFPWRWKIRPPGFINLQILPQLVKRMKLADIMTILGSIDIIMGEVDR

SEQ ID NO: 14558 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFTRIIGFDNVRQVQCISFIAYKPASYDA

SEQ ID NO: 14559 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 14560 - protein, 183 aa, Mesembryanthemum crystallinum
MASSLMSNAATTMAAATTTAQANMVAPFNGLKSISAFPVTRKNNDITSVASNGGRVQCMQVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 14561 - protein, 377 aa, Musa acuminata
MADTDDIQPLVCDNGTGMVKAGFAGDDAPRAVFPSIVGRPRHTGVMVGMGQKDAYVGDEAQSKRGILTLKYPIEHGIVSNWDDMEKIWHHTFFNELRVAPEEHPILLTEAPLNPKANREKMTQIMFESFDVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELEAARTSSTVEKSYELPDGQVITIGAERFRCPEVLFQPSLIGMESAGIHETTYNSIMKCDVDIRRDLYGNIVLSGGSTMFPGIADRMSKEITALAPSSMKIKVVAPPERKYSVWIGGSILASLSTFQQMWISKAEYEESGPAIVHRKCF

SEQ ID NO: 14562 - protein, 514 aa, Shigella flexneri 2a str. 301
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLAGAVHKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVAGGKLSDIAPTMLSLMGMEIPQEMTGKPLFIVE

SEQ ID NO: 14563 - protein, 337 aa, Nostoc sp. PCC 7120
MIRVAINGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDANLTLVMGNDLVKVMAWYDNEWGYSQRVLDLAELVAEKWV

SEQ ID NO: 14564 - protein, 171 aa, Oryza sativa
MARNNGVAVMFAAVVVVAGALVAGAAAQSGCTSEMVSLAPCLDYMQGNASRPTASCCAALSSVVKSRPECLCAVLGGGASSLGVTVNTTRALELPAACGVKTPPPSECSKVGAPIPSPAPGGAAAPNAPPAAGTGSKTTPTTGASSAGESVGKAASVAMVIVSAAFAMLYA

SEQ ID NO: 14565 - protein, 464 aa, Yarrowia lipolytica
MDSDTESVKRRKSSGSESESSVRDPKRTKIEDEDFQENGIDDEDEEEEEEEAKDEGDEDDEEKGEDDEEDDEEKEGEDGEGEEEDEEEDEEKKREEEEKYVTSFNFDGVEYKYKERPAVIEEREGKIEFRVVNNDNSKENLMILTGLKNIFQKQLPKMPREYIARLVYDRSHVSMAVVRKPLTVVGGITFRPFDTRKFAEIVFCAISSTEQVRGYGAHLMNHLKDYVKATSPVMYFLTYADNYAIGYFKKQGFSKEISLDRSVWMGYIKDYEGGTLMQCSMLPRIRYLDVNKILLLQKALIHKKIRAISKSHVVRKGLDHFRDSTTPVDPMTIPGLKEAGWTPEMDELARRPKRGPHFAVMQHVLSELQNHASAWPFAQAVNRDEVPDYYEVIKEPMDLSTMEQRLEADSYKTMEEFVYDARLVFNNCRAYNNETTTYYKNANKLEKFMVAKIKEIPEYSHLVE

SEQ ID NO: 14566 - protein, 500 aa, Cryptococcus neoformans var. neoformans B-3501A
MPSLTQTKDLASLLSDASHFKQKGYINGEWVSASDGATFPLYNPATGAKLADMPHMPRSQVAEAINAAKAAFPAWAALTAYQRQNYLLKLFKEMEEHSEDLAIILCTENGKPLAESRVEISYGASFLTWNAAEALRTYGQTIPSPFPGTRNTVIKQPIGVCGLITPWNFPNAMITRKMAPALAAGCTVVIKAPAETPLSALAMCVLCERVGIPPGVVNVVTMDKGQREMAAGLELCENVKVSKISFTGSTPVGRLLMKQSSGTLKKLSFELGGNAAFIIFDDADLDLAVNGVILSKFRAAGQTCICANRIFVHSKIYDDFARRLVERVKAFKVGNGIEEGVTIGPLVSQRGVEKVERHVQDAVGLGAKVLVGGKRIDKGEGSCFYEPTVLVDVPRQCAVSNEETFGPLAPLFKFDDEDDVVERANSSEVGLAAYFFTKDLARTHRVAEKLEVGMVAVNTGAIAQACVPFGGVKQSGFGREGGPSGIDEFMVEKLITIGGL

SEQ ID NO: 14567 - protein, 610 aa, Xanthomonas axonopodis pv. citri str. 306
MPQWRVRMHSGGLELALVLMLAAIVAVPVFKRFGLGAVLAYLVAGVVLGPDGAGVVQDAERISGAAEIGVVMLLFVIGLELSPARLKVMRHSVFGAGATQVLVTAVILGGLLMAAQLGWKSALIVGVALALSSTAVGLQLLAERKALSSDYGRLAFAILLFQDLIAIPLLAAIPLLGGSKNATLQWQDVAKAVAALALVIVCGRFVLRHLFNVVARTRMPEVFTASALLVVLGTAWIMQEAGLSASLGAFIAGVLLADSEFRHELESQIEPFEGLLLGLFFISVGMGIDLHRVVAEPWLIAAGVAILLVVKFSLLVGIGSVAKLPLRSSLMLGSVLWLGGEFAFVVFNEADRVGLLEPANHDRLVAIVGVSMALTPLLLLGMQRILNGPLRARAPKTDRPFDTIDAQTPKVLVAGMGRFGQVVARLLTARHVPFVALEHNPDTVEDLRRFGSQLYYGDPTRPELLRAAGAERIKVFVIAVDDPETNIKTVRLIRRLYPQATVLARARNRQHAWKLMDLGAEPFREVFASSLELSERVLTSLGLGEALAHDHVKRFRQHDEDLLRRQHLVYDDEAKVIQTSRDARADLMNLFEADVRADVDGEPAPTLRER

SEQ ID NO: 14568 - protein, 829 aa, Lycopersicon esculentum
MSGRRSSYTLLNQIPNDNFFQPPAPKFSAGAGVVPYGESSSAEKNRGKVFDLDLMDQRMMQSHNRVGSFRVPGSIGSQRQSSEGSFGGSSLSGENYVGTSFGHKNEGCGSSVARSWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLRAVDPSKAPSVEVILIDRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLLNGPSSISIPSPLRFPRYRQVEPTTDFRSLAKQYFLDSQSLNLLFDDSSAGAAADGDAGQSDRSCIDRNNVVSSSSNRDEISQLPLPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLILMEKIGAGSFGTVHRGDWHGSDVAVKILMEQDFHAERLKEFLREVAIMKRLRHPNIVLFMGAVIQPPNLSIVTEYLSRGSLYRLLHKPGAREVLDERRRLCMAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKRLDIPSDLNPQVAIIIEACWANEPWKRPSFSTIMDMLRPHLKSPLPPPGHTDMQLLS

SEQ ID NO: 14569 - protein, 254 aa, Treponema pallidum subsp. pallidum str. Nichols
MHERNTTTNTPLDVTAQKLLVAQRSVDTLVQEGVLHAHMSIGLGTGSTAMPAVKRIADHLARGTLSDIAAVPTSFQTALICERYNIPLFSLSSKRIGGKLDVTIDGADEIDTQNFVIKGGGAALLQEKIAAYNSAHFVIIVDETKVVETLGTRAALPIEVVPEARMSVMRTLQDWGLSVHIREAVRKKGPVVTDHGNFILDARWQSLPTRTPQDMERALNALPGVIENGLFTERTVRVFVAHADGSVEERSASF

SEQ ID NO: 14570 - protein, 628 aa, Psychrobacter arcticus 273-4
MFAAAAGSPNLMLQATIFLGAALLFVPLGKRFGIATVLGYLITGLILGPSVLDVAGDAESLLHFSEFGVVMLLFIIGLELQPSRLWALRRSIFVLGGLQVGLTGVLLMGLLHQIFGLQLDTAFIVGFGLALSSTAFVLQILTEKQQLSSTHGREAFTILLFQDIAVIPLLAVIPFLSGVREQSYDLIYFGKVFAVFAGLIFASRYVVRPFFKFVASSGASELLTAVALFIVMGVSILMGQIGLSMALGAFLTGVLLADSEYRHELEASIEPFKGLLLGLFFMSVGMLTDVNLILAKPIFIIGCAMALMFIKFGVITAIAKLFGNRWPTSIRLGVTLAQGGEFAFVLFSVASAQNVLQPELANTLNLIVTISMALTPLAFLLLEKVGEPLFAKSKPSREYDTIPDHEHQVIIAGFGRVGQIIGRVLRMHNIEFTAIERSANRVDFVRKFGNQVYYGDPKNPEILRAAGIKKARIFILAIDDLERSITTAQYLRKNYPDLIILARARDRQHYYRLREVGVRHIWRETYLSSLDMSRESLQLLGISAEKARETVQTFRDYDDDLIERQQAIYDDEASMIESAQSAMAELESLFDEDIGKARKMDLSDFYEVLKSQAIPVDDENNSTTESKH

SEQ ID NO: 14571 - protein, 380 aa, Candida glabrata CBS 138
MSVAADSSKTLELFPQSVLAKHNSKDDCWVSTHERKIYDVSKYLKDHPEEADAVHKALDGKHGTDISQMELTTLKFVTDDYLVGYLATSDEEKKLLTNKSHKVEVKLNADNTFDSTTFVKDLPTEDKLSITTDYERDYKKHKFLDLNKPLLKQILFGNFTKDFYLDQIHRPRHYGKGSAPLFGNFLEAFTKTAWWVVPTVWGPVVLYFITTALMNMNNPLALFLFGLGIFVWTLIEYCLHRFLFHFDEWLPEHSMFFMIHFLLHGCHHYLPMDAYRLVVPPALFVVLCAPIYKLVFAALPYYWACAGFAGGMLGYICYDLCHYFLHHSKMPPFMRKLKKYHLEHHYKNYQLGFGVTSWFWDKVFGTYLGPDAPLSKMKYE

SEQ ID NO: 14572 - protein, 405 aa, Cryptococcus neoformans var. neoformans JEC21
MTSLTQALKRAQQTYANRNRKSYEAHQAASRHLPGGSTRSSIFIHPFPLCIQKGQGVKITDLDGHEYVDFVSDFTSGIYGKSHPVLIDAIKEALDNGLQLGAHTLAETTLASHFTSRFPSIELVRFANSGTEANILAISTAIKHTGRKKVLVFEGGYHGSVMSHFHMKGGDGDDLKVPFDFVVCSYNDRKATDALISQHPSEIGAILVEPMLGAGGCIPGDPAFLQFLREKASSIGAVLIFDEVQTARLSTGGRQKILGITPDLTTVGKFFGGGFAFGAFGGKKEIMEKFDARKGGAISHGGTFNNSPLTMVAGATAMEKILTEDALKNLNKLGDWMREEINRMFTSDGSPFLVLDLLFFYLLERGFWIAQRGLVSLSFAMTKEDVQRFIEAAIEATQKVKATLK

SEQ ID NO: 14573 - protein, 245 aa, Lactobacillus crispatus
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYNLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNSYLLFNGRK

SEQ ID NO: 14574 - protein, 1074 aa, Bacillus licheniformis ATCC 14580
MNKLDGIPIPKTYGPLGNLPLLDKNRVSQSLWKIADEMGPIFQFKFADAIGVFVSSHELVKEVSEESRFDKNMGKGLLKVREFSGDGLFTSWTEEPNWRKAHNILLPSFSQKAMKGYHPMMQDIAVQLIQKWSRLNQDESIDVPDDMTRLTLDTIGLCGFNYRFNSFYREGQHPFIESMVRGLSEAMRQTKRFPLQDKLMIQTKRRFNSDVESMFSLVDRIIADRKQAESESGNDLLSLMLHAKDPETGEKLDDENIRYQIITFLIAGHETTSGLLSFAIYLLLKHPDKLKKAYEEADRVLTDPVPSYKQVQQLKYIRMILNESIRLWPTAPAFSLYAKEETVIGGKYLIPKGQSVTVLIPKLHRDQSVWGEDAEAFRPERFEQMDSIPAHAYKPFGNGQRACIGMQFALHEATLVLGMILQYFDLEDHANYQLKIKESLTLKPDGFTIRVRPRKKEAMTAMPGAQPEENGRQEERPSAPAAENTHGTPLLVLYGSNLGTAEEIAKELAEEAREQGFHSRTAELDQYAGAIPAEGAVIIVTASYNGNPPDCAKEFVNWLEHDQTDDLRGVKYAVFGCGNRSWASTYQRIPRLIDSVLEKKGAQRLHKLGEGDAGDDFEGQFESWKYDLWPLLRTEFSLAEPEPNQTETDRQALSVEFVNAPAASPLAKAYQVFTAKISANRELQCEKSGRSTRHIEISLPEGAAYQEGDHLGVLPQNSEVLIGRVFQRFGLNGNEQILISGRNQASHLPLERPVHVKDLFQHCVELQEPATRAQIRELAAHTVCPPHQRELEDLLKDDVYKDQVLNKRLTMLDLLEQYPACELPFARFLALLPPLKPRYYSISSSPQLNPRQTSITVSVVSGPALSGRGHYKGVASNYLAGLEPGDAISCFIREPQSGFRLPEDPETPVIMVGPGTGIAPYRGFLQARRIQRDAGVKLGEAHLYFGCRRPNEDFLYRDELEQAEKDGIVHLHTAFSRLEGRPKTYVQDLLREDAALLIHLLNEGGRLYVCGDGSRMAPAVEQALCEAYRIVQGASREESQSWLSALLEEGRYAKDVWDGGVSQHNVKADCIART

SEQ ID NO: 14575 - protein, 349 aa, Cryptococcus neoformans var. neoformans JEC21
MDATTLTGHVKELNAANQAGKSDEVISLLKKLQAEVVPTEDLLRSSKAGVAVGKLRTHATPSVSSLAKEIVKKWRDAVEETKKKRKRAEGDEGKDVKKEKEEGNGKRVKAESMCALSPAAESGSDTHIHFAAGSLAATPSASTPASASTPDVKATSPPVRQPLSTIDSSRTTPRTAKSDGVADSLRADSSEGGSVDSVRDKCVIMIYDALALDSTAERAIGIERAANKAMNFSTGNDYRAKMRSLFLNLKDKGNPALRNEIVLGYVSTEKVASMSKDEMASESVRMLKEKIASDNLFKAKAVGVTQAETDAFKCGRCHQRKCTYYQMQTRSADEPMTVSRYLAHMIRWY

SEQ ID NO: 14576 - protein, 182 aa, Mesembryanthemum crystallinum
MASSLMSNAATTMAAATTTAQANMVAPFNGLKSISAFPVTRKNNDITSVASNGGRVQCMVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 14577 - protein, 186 aa, Mesembryanthemum crystallinum
MASSMLSNAAVATTAASRSAGAQASMVAPFTGLKSVSAFPVTRKSSNDLSTVPSNGGKVQCMQVWPPLGKKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYDA

SEQ ID NO: 14578 - protein, 367 aa, Oryza sativa
MERELLETFEAAKKAADAAAGADDSPEADRCLDAMRRLRGLRVTTDVLVSTQVGKRLRYLTKHPHSDIQSMATDLLGYWKKVVIEEGKKNGTTENVGSTNSAARAEKAQPMKVDKSSASGSVKPEKREVNVRGQKPESIKVEKITNNDSKNQQVKVERAPKEATRTPDTKKPSSVPNGPPKLTSLVKCNDPTRDKIRELLADAFSRVHGETSKDDREEVRNILDEVDARDPFRVAVTVESALFERLGRSTGAHKAKYRSIMFNLRADNNTDFRRRVLLGQVRPERLVDISPEEMASDARKLENKQIKEKALFDCERGGAPKATTDQFKCGRCGQRKTTYYQLQTRSADEPMTTFVTCVNCNNHWKFC

SEQ ID NO: 14579 - protein, 246 aa, Bifidobacterium longum DJO10A
MTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 14580 - protein, 352 aa, Bacillus anthracis str. 'Ames Ancestor'
MTIDRVCTIGPASNNKETLAKLINNGMKIVRLNLSHGTHESHKDIIRLVKSLDDSIKILGDVQGPKIRLGEIKGEQITLQAGDSFMLRTQPVTGSSTEASVDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPYQFIPLLQKMMIQECNRTNTYVITATQMLQSMVDHSIPTRAEVTDVFQAVLDGTNAVMLSAESASGEHPVESVSTLRLVSEFAEHVKKDGPFVMKDVLELLHKSLDE

SEQ ID NO: 14581 - protein, 173 aa, Oryza sativa (japonica cultivar-group)
MDVGVGGKAAKKAVGRKLGGPKKKPVSRSVKAGLQFPVGRIGRYLKKGRYAQRVGTGAPVYLAAVLEYLAAEASHCLSLPLPNPSKPSMVLELAGNAARDNKKNRIIPRHVLLAIRNDEELGKLLAGVTIAHGGVLPNINPVLLPKKTAEKADKPAKASKDKAAKSPKKQARS

SEQ ID NO: 14582 - protein, 126 aa, Arabidopsis thaliana
  misc_feature (2)..(2): Xaa can be any naturally occurring amino acid
  misc_feature (10)..(10): Xaa can be any naturally occurring amino acid
  misc_feature (12)..(12): Xaa can be any naturally occurring amino acid
  misc_feature (31)..(32): Xaa can be any naturally occurring amino acid
  misc_feature (39)..(40): Xaa can be any naturally occurring amino acid
  misc_feature (42)..(42): Xaa can be any naturally occurring amino acid
  misc_feature (52)..(52): Xaa can be any naturally occurring amino acid
  misc_feature (54)..(56): Xaa can be any naturally occurring amino acid
  misc_feature (59)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (72)..(73): Xaa can be any naturally occurring amino acid
  misc_feature (78)..(78): Xaa can be any naturally occurring amino acid
  misc_feature (80)..(82): Xaa can be any naturally occurring amino acid
  misc_feature (84)..(86): Xaa can be any naturally occurring amino acid
  misc_feature (88)..(88): Xaa can be any naturally occurring amino acid
  unsure (1)..(126): unsure at all Xaa locations
MXSSMLSSTXGXTSPAQATMVAPFTGLKSSXXFPVTRKXXNXITFITSKGGXVXXXKVXPPXXKXKXXTLSXXLPDLXDXXXGXXXGXYLPKDSLKSAGIFLPAPPSPGYYPKSGTKYPTYRQENF

SEQ ID NO: 14583 - protein, 266 aa, Listeria monocytogenes str. 1/2a F6854
MNRIGFIGAGNMGTAMIRGLAQANLVKREEIIVGGRNLEKLKPLEAEFTGLQITTDTEKLVEQADIIILAVKPYTIPEILTSVKEKLTPDKIIISVAAGVTIQDLEELTSAKTKIVRVMPNTPALVGEAMSSVSPNTNVTSEELKEVTAIFTSFGEAEVVSENLMDAVIGVSGSSPAYVYMFIEALADGAVLSGMPRDKAYKFAAQAVLGAAKTVLETGEHPGKLKDMVTSPGGTTIEAVKSLENDGFRSTVINAVQAAAKKNSSM

SEQ ID NO: 14584 - protein, 800 aa, Photorhabdus luminescens subsp. laumondii TTO1
MQQSRLDKAQFQAALTRQWQRFGLGSAQEMTQHQWWQAVSAALSELVPACPVINHSEQQRHVNYISMEFLIGRLTANNLLNLGWYEDVQAYLAEENIILSDLLEQETDPALGNGGLGRLAACFLDSMATVGQSAIGYGLNYQYGLFRQSFEQGQQIEEPDNWGRESYPWFRHNTQLDVEVNFGGKVVITDDGHETWQPEFTLIGEAWDLPVIGYRNGVTQPLRLWQATHASPFDLDKFNAGQFLTAEQQGVEAAKLTKVLYPNDNHQEGKRLRLMQQYFQCACSVADILRRHLLAGRKIEDLPKYEVIQLNDTHPTIAIPEMMRILLDKHQMSWETAWEITSHTFAYTNHTLMPEGLECWDEDLVSHLLPRHYSIIKEINYRFKKLVDKTWPGEPAVWEKLAVHYNHQIRMANLCVVAGFAVNGVAALHSQLIVKDLFPEYHQLWPNKFLNVTNGVTPRRWIKQCNPALSGLLDRTLNREWINDLDALKTLEPYADDAAFREEYRAIKQSNKILLSNYVNKVMGLKLDPNAIFDVQIKRLHEYKRQHLNLLHILSLYKQIQENPALDIVPRVFLFGAKAAPGYYLAKNIISAINQAAEKINNDPIVRDRIKIAFIPDYKVSVAELMIPAADVSEQISTAGKEASGTGNMKLALNGALTIGTLDGANVEIAEQVGDDHIFIFGHTVEEVKALKAAGYDPLKLLKEDQHLDNILKALASGEFSYSDKRAFDMLLHSLIEGGDPYLVLADFASYCDAHKRIDTLYRDTQHWTRSAILNTARMGMFSSDRTIRDYQQRIWQANR

SEQ ID NO: 14585 - protein, 238 aa, Zea mays
  misc_feature (200)..(200): Xaa can be any naturally occurring amino acid
  unsure (1)..(238): unsure at all Xaa locations
MDAAAKKMTRSISRQLSSGAARLWRQLSLDPHTPRRGGPGPVPAAGAGQTRFAIARQSSLDPTPRGGPDGSSAHQQLAVPENLDATMRLLFAACQGDAAGVEELLRSGVDVDSIDLDGRTALHIAACEGQGEVVRLLLDWKANINARDRWGSTPAADAKHYGHFEVYNTLRARGAKVPKTRKTPMAVSNPKQVPEYELNXLELEFRRGEEGTYLAKWYGSKVFVKILDKDSFSDAESM

SEQ ID NO: 14586 - protein, 693 aa, Gibberella zeae PH-1
MNVYEISSSGAPSPAPEGVSTPPAPDMPVKGKNRHRLIQRIQRISSTPSLSGLRRSKSVGSRGSPYGTRSTLSCVSLAATGPPQSQAPYSARSSTPQPSPLGLPSTSGSSPQSSGEFPFVTPGSELAIRRVENVTPITAPITAPLPSEFRSKQDVQLRVRPGVKPIQKPPFRFWEKMPNELQIHIFSFFQPKELVQASRVSRAFYKTCFDGQLWTSLDASEFYREIPAESLARIIIAAGPFIKDLNLRGCVQVEHYKRTEAIVKACKNLMNATLEGCQNFQKSTLHSLLRSNEKLVSLNLTGLTAVSNTSCKIIAESCPQLEAFNISWCGKVDARGIKGVVEACPRLKDLRAGEVSGFDNVATAEAIFKTNNLERLVLSGCAELNDEALKIMMHGVEPEIDILTDRPVVPARKLRHLDLSRCVQLTDAGVKTIGHLVPDLEGLQLSGCKLLSDDALESILASTPRLTHLELEDLENLTNSILSEHLAKAPCATSIEHLSLSYCESLGDTGMIPVMQTCTNLQNVDLDNTRVSDLVLAEAAAMVMKRSRRSTENGTRPKLSLQMVVYDCQNVTWTGVREVLFRNTQVKAVSGQPGRVSYPTEMIGLKCFYGFQMTVDEHQKRVMRGDLASAGRLERKWADYMQATEEAGMTGAGHRRRRRRAREAQALHLDEEDGGFGPTGRRRARTLGSCTVM

SEQ ID NO: 14587 - protein, 566 aa, Coccidioides immitis RS
MSLRPKPGAARAAQNQQVIKDLLKLNCNKTCADCKRNKHPRWASWNIGIFICIRCSGIHRGMGTHVSRVKSVDLDSWTDEQLQSVVRWGNARANKYWEAKLPPGHVPSEAKIENFIRTKYESKRWVMDGPIPDPSTLDGDGDEDVPLAVVQEKAKLERSASHQATSTLARPSPPAQQQSINLFDDDAPAPPTRPKTTDIPGTHAPTKSSQPAAAPKQGKPGDSLLGLDFFGTSQPTTASRPSSTPSGPPTTGPSRPDLKQSILSLYASTPKPQPASQHDRTTSFGSSPSFQSPHKPQNDAFGGLTDAFSGLSFSSSVSSPPKKETSFSVFDSLTSQKSSSSVPQTMSPAPASTGSGLLDIASPKPGKKPSQGKSPSISTGSTGRAFDLIGATMGSTKSTKTPPTASNDILDLFSSPPATTSPPAVSPPKPNEMNSIFNLSSSKPQTITQSPPSNAATTTSMLSSVNIDPWGGNAWASTDPSPPTTQPTSMMRVPDTLTANDIGSGWGASSGLGGSSAPKPTPTVTADEDFGGWTSAVPTETSTSAPKAKTTGGFSGNDDLFSNVWE

SEQ ID NO: 14588 - protein, 1017 aa, Schizosaccharomyces pombe
MFRACSKLQYHGVNTSLSRHLFLAKRNLSISSACLEAKNSQKFPALDTFEPRHIGPSKTDQQYQLESLGYKDFDSFLKDVIPDSVRTPESQLMAFGSVNPNEKNPPVNYSESEFTTLANNVANQNKLIKSFIGMGYYNVKLPAAIQRNVLENPEWYTQYTPYQAEISQGRLESMMNYQTMIADLTGLSISNASLLDEGTAAGEAMVMLMANDKKKRKTFLVDKNIYPNTLSVLRTRASGFGIKIELDNITPELITKSAKHVFGIFVQYPAADGSIFDYGHLAATARSFNMHVVAATDLLALTILKSPGEWGADVAVGSTQRFGLPMGYGGPHAGFFACSEEFKRKIPGRLIGLSKDRLENPAYRLALQTREQHIRREKATSNICTAQALLANMSAFYAIYHGPNGLQEIANRIYASTSFLKSALESSGYKIVNKSHFFDTLTIEVESADKVLAKALDHGYNLRKVDDSHVGLSLDETVCDKDIQALFSIFNINKSVDQYYMEIATSEPNGNSASTVDNLSICSLPENFRRTTLYLQHPVFNRYHSETELMRYIHHLQSKDLSLAHAMTPLGSCTMKLNAVTEMMPITNPLFANIHPYVPEEQAKGYRHVIEDLQLMLTTITGFDAACFQPNSGAAGEYTGLSVIRAYQRSIGQGHRNICLIPVSAHGTNPASAAMAGFTVIPVKCLNNGYLDMQDLKEKASKHADKLAAFMVTYPSTFGIFEPDVKEALEVIHEHGGQVYFDGANMNAMVGLCKAGDIGADVCHLNLHKTFCIPHGGGGPGVGPICVKKHLADFLPSHPVVSCGGKNGITSVSSSPFGSAGILPISWAYMRMMGLAGLRDASKAALLNANYMAKRLSSHYKLVYTNKNNLCAHEFILDAREFKATAGVDATDIAKRLQDYSFHAPTLSWPIANTLMIEPTESESMYEMDRFCDALISIRQEIREIEEGLQPKDNNLLVNAPHPQKDIASEKWDRPYTRERAVYPVPLLKERKFWPSVARLDDAYGDKNLFCTCSPVV

SEQ ID NO: 14589 - protein, 544 aa, Zea mays
PASPAEIAVVPLLVILPVLESQNIIEQSVWPILLAESLKALGGLGLLSLGGKYFIRRVFEFVAESRSSEAFVALCLLTVAGTSLITQKLGFSDTLGAFLAGAILAETNFRTQIEADMRPFRGLLLGLFFVTTGTSIDMQLLIREWPNVLSLLGGLIVIKTLIITAIGPRVGLTLKESVRIGLLLSQGGEFGFVVFSLANRLGVLPLELNKLLIIVVVLSMALTPLLNEVGRRVAGMIDERSEEKEKPAEMVNYGATEPVVILGFGEMGQVLAKFLSAPLSFGIEKDTEGWPYVAFDLNPVVVKSARKSGFPVLFGDGSRPAVLQSAGITFPKAIMVMYTGKEKTIESVSRLRQAFTAVPIYARAQDLSHLLDLKKAGATDVVLENAETSLQLGSILLKGLGVMSDDVSFLSKLVRDSMELQAQEALKDIGDQEVDIMKPLQVRVSDLVESNGNSSRMVAPEQSLSLSSRPDIKAIKPPVANGIPDMKVENDKTGYDFDRVDSENGVTYCLLESDDQSDEASSTSKEMIDQSADTRVNVNDKKIL

SEQ ID NO: 14590 - protein, 197 aa, Triticum aestivum
  misc_feature (49)..(49): Xaa can be any naturally occurring amino acid
  misc_feature (90)..(90): Xaa can be any naturally occurring amino acid
  misc_feature (109)..(109): Xaa can be any naturally occurring amino acid
  misc_feature (125)..(125): Xaa can be any naturally occurring amino acid
  misc_feature (138)..(138): Xaa can be any naturally occurring amino acid
  misc_feature (169)..(169): Xaa can be any naturally occurring amino acid
  unsure (1)..(197): unsure at all Xaa locations
MAWPPSSGCVKVAAYVSWNVTPRQAAKAAFGDTVTVNSARKCGAPVRNXIFSPIPAVRMNTYSTKEEQMNVYYLNERDRNSPDDLPVSAXHTQILVCDLVPFTNKADYXSLDKLICISAIICILXQNVSDHNVNRYDXSYSIYFSYYAHFAPDWTYLSYKDAYLELTGXSQDFEGAYGRSSFSPIVFPFYIFYTFYL

SEQ ID NO: 14591 - protein, 413 aa, Oryza sativa
METNTPPKSGTSFLKTCFNGVNALSGVGILSMPYALSQGGWLSLAIFITIAAICFYTGILLQRCIDSSSLVKTYPDIGELAFGRKGRIAVAAFMYLELYLVAIDFLILEGDNLEKLFPNASFFSSFHRIAGGTRQGFVLLFALLVLPTTWFRSLDLLAYVSLGGVLASAILVASVLWVGAADGVGFREGGVAVRWGGVPTAMSLYAFCFSGHAVFPMIYTGMRNRRMFPHVLLICFIICTLAYGVMGVIGYLMYGGSLRSQVTLNLPARKLSSSIAIYTTLINPFTKFALLITPIAEAIEGVLGLGTATTGGKPAQYRAAAVSVSVRTALVVSTTAVALAVPFFAYVVALTGSFLSATATMLLPCACYLRISSRASGKLGVLEIVACVGIIVLGLGVIVIGTYSSLKQIVQSF

SEQ ID NO: 14592 - protein, 461 aa, Methanosarcina acetivorans C2A
MDLNQNTGGSLIKIAMLSPIAWSTPPKKYGPWEYMVSLLTEGLVKRGIEVTLFATADSHTAGELHAVCPRPYEEDKDMVRKVYEGLHISEVFERANEFDIIHNHFDYLPLTYSGLVDTPVVTTIHGFSSRKILPVYKKYNNSTFYVSISDAYRCNELDYIATVRHGIDIETFPFNDRPEDYLLFISRIHREKGAKEAIEVAKKAGRKLRMAGFIADPEYFKNEVEPHIDNDQIVYEGHVSQERKKELLSNAYALLHMINYEEAFGLGVVEALACGTPIIAINRGAMPELIMDGETGFLVNNVTEAAEAVEKLNSISRRRCRESVEKRFSVDRMVEDYIRVYETILEKRKREAKRPWGFYEILAQKPGYKVKRITVLPQEQISLQRHAHRNEHWYVVSGEGLVTKNSDYLKVLVGDTVDIPVNEIHRIKNTGIQNLVFIEVAQGDYLGEDDIERLEDKYGRT

SEQ ID NO: 14593 - protein, 173 aa, Triticum aestivum
MFLRRILSGGGGLAAMRSARAVKETTGIVGLDVVSEARDVLIGLYTRTLKEIEAVPKDEGYRKAVESFTRYRLQICQEEEDWKRIEDRLGCGQVEELIEEAEDELRLIGKMIEWDPWGVPDDYECEVIEDDAPIPKHVPQHRPVALPEEFFKTLDAIKSDPALQGDSPPQVKS

SEQ ID NO: 14594 - protein, 510 aa, Sorghum bicolor
MAVFISSSGSPGRATATTTTTTTLLLAVLAAAAAAGLLLAPVAARGSPPEHDKQLQLQQQEDDRIPGLPGQPNGVAFGMYGGYVTIDDNNGRALYYWFQEADTADPAAAPLVLWLNGGPGCSSIGLGAMQELGPFRVHTNGESLLLNEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 14595 - protein, 165 aa, Oryza sativa (japonica cultivar-group)
MPMPILLLLLLLPQGQGHGGAGDICIVGSGISGSSTAFFFTNYTTALSGAQLRVFERRAKVGGRLATVTVSGDHFEAGGSIIHPRNLHVRRFADLLGLEAKTDGDDDWLGIWDGHRFVFQTLRPLPPGTSWLRRKLHTLVNSLRLFKRYGLSLLKMDRFVQVPPP

SEQ ID NO: 14596 - protein, 469 aa, Novosphingobium aromaticivorans DSM 12444
MATAKDILARIKDEEIEWVDLRFTDPKGKWQHLTMVSTVLGEDELEDGLMFDGSSIEGWKAINESDMILKPDLDAVYVDPFSASPMLIICCDIVEPSTGELYARDPRSTAKRAEAFVKTAGLGDTVYVGPEAEFFLFDDVKFYDGYDGNGFRIDDIELPTNSNKDIEGGNLAHRPRAKGGYFPVAPVDSCVDIRGEMVRTMLDMGLPCDKHHHEVASAQHELGLTFGTLVQTADRMQVYKYVVQQVAHAYGKTATFMPKPIKGDNGSGMHTHISIWDSGKPLFAGNGYAGLSDMCLYFIGGVIKHAKALNAFTNPTTNSYKRLVPGYEAPVLLAYSARNRSASCRIPYGAGAKAKRVEFRFPDAMANPYLCYAALLMAGIDGIKNKIHPGEAMDKNLYDLPPAELAEVPTVCGSLREALESLEADHDFLLQGGVFTKEQIESYIELKWPEVLRWETTPSAVEFDMYYSL

SEQ ID NO: 14597 - protein, 530 aa, Vibrio angustum S14
MEFIYILTAFVIGFIALRCKLPPLVGFLVAGFSLNSFGFTSTPTLETLANLGVTLLLFTIGLKLDVKSLLKKEVWGGATLHNLFSTALFTLCLLILKQLGLTMFSDMALSQLILIGFALSFSSTVFAIKLLQEKGELNAKYGTVSIGILVMQDIFAVIFLTISSGKMPEVYALGLFALPLLRPILYKILDKAGHGEVLVLYAITLALVLGAGLFELVGMKPDLGALLIGMLMAGHSKSSEMAKSLFNFKELLLVCFFLNIGLSETPTLNGLLMAFVLLLLLPLKGMLYYGIFHLCRYRVRTSMLATLTLFNYSEFGLIVGGVAYKLGLLPGTFLVAIAIAVSFSFLLAAPLNSMSHKLYTEASKWLKEFEPEKLNADDRLIDLGQSKVLILGMGRIGTGAYDELQARYGKQIIGVETREESAEQQRKEGRNVIQGDATDPDFWARVISKERVTLILLAMPHSQANVYALEQIKARHFQGKIAAIAQYNDDEELLYEQGIDAVFNIFNEAGSGFARNVCDHLKPDITAIKS

SEQ ID NO: 14598 - protein, 448 aa, Listeria monocytogenes str. 1/2a F6854
MAKHRYLPMTEQDEKEMLDVIGVKSIDDLFQDIPEKIRFKRDYDLKPAKSEPALLRELSKLASKNANTSEYASFLGAGVYSHYIPTVVDHVISRSEFYTAYTPYQPEISQGELQAIFEFQTMIAELTGMDLANSSMYDGGTALAEAAMLASGHTKRKKILISGAVHPESSNVLKTYATGQHIEVEVIPELDGKTDIEALKKALSDDIAGFVVQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFREKGFEVLFSDGFFNEFVVKLSKPIKEVNESLLDEGIIGGYDLGFYEGKYKHHMLVAVTEMRTKEEIDAFVASLEGAK

SEQ ID NO: 14599 - protein, 488 aa, Listeria monocytogenes str. 1/2a F6854
MNLEETMPLVFERSIPGRIGFSLPESDVPETNAGDYFDQAYIRSIPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHEAGGKLYYDGANLNAIMAKVRPGDMGFDVVHLNLHKTFTGPHGGGGPGSGPIGVKKELIPFLPTPVLTKKEDIYTFDYNYPDSIGRVKPYYGNFGINVRAYTYIRTMGPDGLKLVTEYAVLNANYMMRKLQEAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPILRYQKEV

SEQ ID NO: 14600 - protein, 240 aa, Hordeum vulgare subsp. vulgare
MKLVVLSALLLLSLVAVSSAEEFDFFYLVQQWPGSFCDTKKGCCFPDTGKPATDFGIHGLWPNYAECKTRGELDGALEMVTRRRKKCWPESCNSERLKLWEIRDLVTELDANWPTLACKGGKSFEFWTHEWEKHGTCSNLDQHGYLATALGFKARHNLTSILADAGIVPSDTETYFLSSIRDAIREGTGFTANLECNRGVDGETQLFQVYQCIDRDGENLIDCPLPMQGNCKDRVQLPAF

SEQ ID NO: 14601 - protein, 227 aa, Hordeum vulgare subsp. vulgare
MRPCCLSLALLVALSAVGSAAAQAADYDFFYLVLQWPGSYCDTKKSCCYPRTGKPAADFGIHGLWPNRDDGSYPQNCNPANAFDPSKVSDLLSSLRAEWPTLACPASDGLQFWAHEWEKHGTCAQNLFHEHGYFQTAAPPRPAPLLDALASAGVAPDGGYYTLSAVKGAIQQGTGFEPFVECNRDESGNSQLYQLYFCVDARASGFVECPVQPGGRPCGDRIEFPAF

SEQ ID NO: 14602 - protein, 396 aa, Bartonella quintana str. Toulouse
MAEVNVRNFNINFGPQHPAAHGVLRMVLELDGEVVERVDPHIGLLHRGTEKLMETKTYLQAVPYLDRLDYVAPMNQEHAFVLAIEKLLGVEVPKRGQLIRVLFSEIGRILNHLLNVTTQAMDVGALTPPLWGFEQRERLMIFYERACGARLHANYFRPGGVHQDLPESLIEDIGHFIDPFLISLSRLDALVTPNRIFKQRNVDIGVISIDEAWVRGFSGVMIRGAGVPWDLRKSQPYECYDEMEFDIPVGKNSDCYDRYLIRMEEMRQSARIMRQCVDRLLGSEKNGPVSSLNRKVVPPKRSEMKSSMEALIHHFKLYTEGFHTPPGEVYVAVEAPKGEFGVYLISDGTNKPYRVKLRAPGFAHLQAMDFLTRGHMLADATAILGSIDIVFGEVDR

SEQ ID NO: 14603 - protein, 273 aa, Photorhabdus luminescens subsp. laumondii TTO1
MERRKITLIGAGNMAHAIIAGLVKGGYPAELINVCAPSHTRRDALATEYGVNSGSDNIRYAQEADVVVLAVKPQVMVDVCQPLKENVDFSNKLVLSIASGISVARFDALLQDKLNIVRIMPNTPALIGQGVSGLFASEQVSQSDRDFTQALMNSVGKTYWVKDENGINDVIAAAGSAPAYFFLFMESMQQEAERLGFDNQTAREIILQTAIGSAALAASNVDLPFATLREQVTSKGGTTAEALRIFYEGKLPETISNAMQAAIRRAQEMEKQF

SEQ ID NO: 14604 - protein, 529 aa, Triticum aestivum
MPSIQEPLHFKPQEPKVVVAENENDKMVDVQDKEVTMEGLCSVAAYDQWTPLSVPGQRPKPRYKHGAAVVQEKMYVFGGNHNGRYLGDIQVLDFKSLSWSKLEAKVQSESAEPASVAPCAGHSLIPSGNKILSLAGHTREHTESLSVKEFDPQTCTWSILRTYGKSPSSRGGQSVTRVGDTLVVFGGEGGGRSLLNDLHVLDLETMTWDEFESTGTTPSPRSEHAAACYADWYLLIFGGGSHSTCFSDLYLLDMQTMEWSRPEQHGIIPEPRAGHAGVTVGDNWVITGGGNSKKGVPETLVLNMSTLVWSVVTSFEGRAPPTSEGSSLVLHTINGEDFLLSFGGYSGRYSNEVYALKTSLRPSVSSSRIDELETNGMTPLSAEVNSSREPIFEIEELRDDKNKKGGDISKTLVQAVKREKNQVEERLEQEKLQSFNLKKELADVENKNAELTKELQSVRDQLSDEAARASKLEDEVSEIQQRLQKMETLEKEFELLRSERGGGSDESGSGSNKRPSSVGFRRWYGDDER

SEQ ID NO: 14605 - protein, 608 aa, Rhodopseudomonas palustris CGA009
MASRSASQASDALSQHGCPFSVRAKAFHGGRCMHELIGDITLSILFAWLLGLAAHFFRQPLILAYLIGGFVIGPFGLGWVKSENSISVISELGLIFMLFMIGLEIDLKKIIRAGPVILVAAGGQIAGGVLLGLAFFVGIGLSLGGGHFDALYLTVACALSSTVIIVKVLYEKRELDTLPGRITLGILVLQDIFAILFLAVQPSLADLQISVLLLSIARVVALVATALALSRYVLPWLFHRIARTPELVLLGALAWCFLIGEIAERLHLSREMGALVAGVSLSTFPYALDVTAKVTTLRDFFITLFFVALGMTIPIPNGSVIGLALAIAVFTLASRLLTTFLPLYLMKQGLRASLLPALNLAQISEFSLVVIQTGVAAGHIGTQTASAASFAFVLLAVLSTFVIMRSDPITRRAIGTLTKFGFRDLGQQQSGAEAAAEAGHGAVHRIVILGFFRAASALVSEIEQHTPELLKQISVIDFNPMVYRTLTERGMHVIYGDISNVDTLLHAGVAKAEIIILSVPDSLLKGATNERLVRHVRALNPNAQIVATADLLADVEAMYQAGADYVTVTRLADARELFEVIEAADNGLLSDKRAALDARLAERREVLP

SEQ ID NO: 14606 - protein, 124 aa, Zea mays
  misc_feature (66)..(66): Xaa can be any naturally occurring amino acid
  misc_feature (106)..(106): Xaa can be any naturally occurring amino acid
  unsure (1)..(124): unsure at all Xaa locations
MSAYCGKSRLSSSRIAAYIGTPGKGILADDDSTVTIGKRLSSINVQNAEENRPALRELLFCCPGAXLQNIIGVILWEETLSHNTKDGKSSVRRLKDGSLLPVIKDXKGTILVLDPDTETPTHSH

SEQ ID NO: 14607 - protein, 220 aa, Thiomicrospira crunogena XCL-2
MTQDELKQQVAIAAIEYVVPDTFIGVGTGSTANFFIDELAKIKGKIKGAVASSEATAERLKDHGIPVMELNSVDELSVYIDGADEADPKLNLIKGGGGALTREKIVLAVAKQFVCIADDSKKVAVLGKFPLPIEVIPMARSYVAREVVKRFGGEPVLREGFTTDNGNVILDIHGLEITDPVAMETELNGIVGVVTNGLFAARNADIFLCGTANGVETIKA

SEQ ID NO: 14608 - protein, 426 aa, Thiomicrospira crunogena XCL-2
MSNSHTLFEAAQAHIPGGVNSPVRAFKGVGGDPVFFESAKGAYLTDADGKQYIDYVASWGPAILGHTHPDVIKAVQTQAEKGLSFGAPTEIETTMADMVCDLIPSMDMVRMVSSGTEATMTAIRLARGYTGRDKIVKFEGCYHGHSDSLLVKAGSGALTLGVPSSPGVPACLAQETLTLTHNDSEEVKKVFSEIGDQIACIIVEPVAGNMNCIPPEDGFLETLREVCDESGAVLIFDEVMCGFRVGLTGAQGRYNITPDLTTFGKVIGGGMPVGAFGGKKEVMQHIAPLGPVYQAGTLSGNPIAMTAGLKTLELISKPGFFEELEAKTTKLVNGLQKAADEAGIAFTTNQVGAMFGFFFSEEKDIRRFSQVAKGNMEQFKAFYHGMLDEGIYLAPSAFEAGFVSSAHTDQDIDDTIAAAKKVMATL

SEQ ID NO: 14609 - protein, 148 aa, Brassica napus
MFLRRILSGGGGLAALRAARAVKETTGIVGLDVVPKAREVLIGLYTRTLKEIEAVPKDEGYRKAVESFTRHRLQICQEEEDWKRIEDRIGCGQVEELIEEAEDELKLIGKMIEWDPWGVPDDYECEVIEDDTPIPKHVPQHRPVALPE

SEQ ID NO: 14610 - protein, 539 aa, Malus x domestica
MASINPYCSSTALSPSPGHTILYPGTSLAANGRLSGFVTPSVSWKLFFHSKGSIKARALLGEDGLLSYPNGNPTGSEIQPDALGFGTVSAETTPTFSGFSSENDEGDLDHPIHGFSSIPEAIEDIRQGKMVIVVDDEDRENEGDLIMAASLATPEAMAFIVKHGTGIVCVSMKGEDLERLQLPLMVTQNEEKLCTAFTVSVDAKRGTTTGVSARDRAATVLALASRDSTPEDFNRPGHIFPLKYREGGVLKRAGHTEASVDLAMLAGLDPVAVLCEIVDDDGSMARLPKLLEFARAENLKIVSIADLIRYRRKRDKLVERAGVARIPTMWGPFEAYCYKSLLDGIEHIAMVKGEIADGQEILVRVHSECLTGDIFGSARCDCGNQLALAMKQIEAAGRGVLVYLRGHEGRGIGLGHKLRAYTLQDAGRDTVEANEELGLPVDSREYGIGAQILRDLGVRTMKLMTNNPAKYIGLKGYGLAIAGRVPLLAPITMENRKYLETKRAKMGHIYGSKSNGHVNGTIDESSSKIDNQSNDVSET

SEQ ID NO: 14611 - protein, 289 aa, Populus alba
EENWAEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIKPSLAAEYQSQLLSILGIDKDKVEDCSKFLMEFALREHFKLLSNKRKFCSLPG

SEQ ID NO: 14612 - protein, 319 aa, Aspergillus oryzae
MSSGVSFKTSNGVTIPGVGFGTFANEGSKGETYKAVRHALKVGYRHLECAWFYANEDEVGQAIQDFLKENPSVKREDLFVTTKVWNHLHRYDDVLWSLEDSLKNLQLSYVDLFLVHWPIAAEKDEKHQPKLGPDGKYIILEDLTKNPEETWRAMEKIYEDGKARAIGVSNWRIEGLEYLNKIAKIKPQVNQIEIHPFLPNTELVNYCQKNGIVVEAYSPLGSQNQVPTTGEKVSENPTLNEIAKQKGCTLAQILIAWGLKRGYVVLPKSSNPARIESNFQSVELSDEEFKAINDVAEGRHFRFVNMKDTFGYDNWPEEA

SEQ ID NO: 14613 - protein, 513 aa, Myxococcus xanthus DK 1622
MTPAHKVLLCILDGWGIRQERDNNAIVLAGTPHLDKLASPYPFTELQTAGLAVGLPEGQMGNSEVGHTNIGAGRIVYQDLVRINRAAESGELAQNPVLRAALDGVKADGKALHLLGLVSPGGVHSSMDHLFALLKAAKERNVAHVYVHAFLDGRDTPPQSALGYVEELERFLHETHTGRIATVTGRFYAMDRDKRWDRVHQAYEALVFGRGPKAPDALSAIRASYAEKVTDEFVKPTVLAAGDGTPVGRIQDGDAVIFFNFRADRARELTQALAFPEFKEFDRGGLRLGRYVCMTQYDETFKLPALFEPDQPQDIFPELLSRQGLRQFRTAETEKYAHVTFFFNGGREVVYAGEDRHLVPSPRDVKTYDLKPEMSAYEVTAELVKRLDSGKYDFALVNFANPDMVGHSGRLDAAMKAVKAVDECLGALGKACERNGWVLAISADHGNCEQMVDLETGEPHTAHTLNPVPFHLIHPDFRGQKLRPGILADIAPTLCKVMGLPQSKEMNRQGLLP

SEQ ID NO: 14614 - protein, 141 aa, Pseudomonas syringae pv. tomato str. DC3000
MAVQRTFSIIKPDAVAKNVIGEITTRFEKAGLRVVASKLKQLSKAEAEGFYAEHSARGFFGDLVAFMISGPVVVQVLEGENAIALNRELMGATNPKEAAAGTIRADFADSIDANAVHGSDSEAAAAREISYFFAATEVTAR

SEQ ID NO: 14615 - protein, 311 aa, Streptococcus pneumoniae TIGR4
MKSYQAVYQILSKETDYISGEKIAEKLSLSRTAIWKAIKRLEQEGIEIDSIKNRGYKLMNGDLILPEILEENLPIKVSFKPETKSTQLDAKEAIDLGHEANTLYLASYQTAGRGRFQRSFYSPQGGIYMTLHLKPNLPYDKLPSYTLLVAGAVYKAIKNLTLIDVDIKWVNDIYLNNHKIGGILTEAMTSVETGLVTDIIIGVGINFTIKDFPQELKEKAASLFKATAPITRNELIIEIWRAFFETPAEELLYLYKKQSFILGKEVTFTLEQKDYKGLAKDISENGKLLVQCDNGKEIWLNSGEISLNSWK

SEQ ID NO: 14616 - protein, 224 aa, Prunus avium
MLKLLLLVLFSAASLQAITTHGQPYDYLQYVLQWPNTKCVKARCIPGIQKTEFTTHGLWPTNLSKILTCNSASKFSSTMLQNDATLVSKLKTSWPNLEQRVAQGKDNDMWFWAMEYEKHGTCAKFSSQNTYLSKACDLWEENKIKDIFAKHKIIPRNATYKDVLLTNAIQMETRSSPLLLCHRVNGGDLLWEVVLCYDDTAKKRMNCSDQSARQTNCGTDIYYK

SEQ ID NO: 14617 - protein, 79 aa, Arabidopsis thaliana
  misc_feature (68)..(68): Xaa can be any naturally occurring amino acid
  unsure (1)..(79): unsure at all Xaa locations
MAGYMLSSATMVDCSAQATMVAPLNGLKSCADLPVTRMANNDITFMTRNGGRVNCMHVWTSIGKKKWXTLSHLTDLTES

SEQ ID NO: 14618 - protein, 337 aa, Actinomadura madurae
MSIDELDARGGTPRAAGRVPPGPPRRATPNLLRMLATDRLGMMQAALRHGDAVRVGLGPKALYLFNRPEHAKHVLADNSGNYHKGIGLVQARRALGDGLLTSEGDLWREQRRVVQPAFQHKRIAGLADAVVEEAGALVARLRARAGGPPVDVVGEMTALTLGVLGRTLLDADLTAHTSLGRAFETVQDQAMFEMVSQGMVPMWLPLPGQLRFRRARRELDRIVRALVAERLREGGGAEDALSRLIESARREPDGRVGRRRLRDELVTLLLAGHETTASTLGWTFHLLDRHPLVRARVRAEARAVFGDGTPTLDDLSALSYTTMVVQEVMRMYPPVWI

SEQ ID NO: 14619 - protein, 283 aa, Streptococcus pneumoniae R6
MATIQWFPGHMSKARRQVQENLKFVDFVTILVDARLPLSSQNPMLTKIVGDKPKLLILNKADLADPAMTKEWRQYFESQGIQTLAINSKEQVTVKVVTDAAKKLMADKIARQKERGIQIETLRTMIIGIPNAGKSTLMNRLAGKKIAVVGNKPGVTKGQQWLKTNKDLEILDTPGILWPKFEDETVALKLALTGAIKDQLLPMDEVTIFGINYFKEHYPEKLAERFKQMKIEEEAPVIIIDMTRALGFRDDYDRFYSLFVKEVRDGKLGNYTLDTLEDLDGND

SEQ ID NO: 14620 - protein, 431 aa, Acidobacteria bacterium Ellin345
MSRKLDRSRELQKRAEALIPGGVNSPVRAFRAVGGEPPILVRGEGARVFDADGNGYIDYVLSWGPLILGHAFTPVINAIEKAAEKGTSFGASTPTEADLAEAVVHAMPAIEKIRFVSSGTEATMSAIRLARGFTGRKYIVKFEGCYHGHSDSLLVKAGSGVATLGIPGSAGVPDELAQLTLALPYNNVAAVEQAFTKFKGQIACVIVEPIVGNMGCVPPAADYLQALSDITKREGAVLIVDEVMTGFRVAYGGAQELYGLKPDLVTLGKIIGGGLPVAAYGGRKDIMDKIAPLGPVYQAGTLSGNPLAMAAGLAMLCHLRDNAMEIYPRLDQLSADLVNRVLDAAREAGVALTANRVGSMFTWFFTDKHVTDWDSAATCDTKQFGQFHGAMLDAGVWLPPAQFEAAFLSSAHTEQDIDDTVAAAREAFAIL

SEQ ID NO: 14621 - protein, 632 aa, Zea mays
EAAHGHRHALCRGRNIIRKPSRRGALSVPHTRAAASAVRTCLPPRLVVLVRYSPRARRGARGHQMAAAAEIGGFAAARVAVATLRPAAHPAPAAAPQQPRRAVAAQSLRTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGGMMSLAVKSKTTDTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 14622 - protein, 358 aa, Methanosarcina mazei Go1
MTTVIPFGPQHPVLPEPVALKLELDDDIVVGALPSIGYVHRGLEKFIDTKDYVQTTYICERICGICSALHGITYTRAVEKLFDLEPPERAQYIRVIVGELNRLHSHLLWLGLFADGFGFESLFYECWKYREGVQDAAERICGNRVIHSISKVGGVTRDLTKEHTDMLLKLCDTLEDQVKNIEKVFVNNYTVKKRTKGLGVMSKQVAYELGTAGPTLRGSDNAIDVRDIDDWAIYKDLGFKTAVEKDGDCYSRTKVRINEVLNSIEIIRNAISRLPNGDISVPVKGFPTGEAIMRTEQPRGEVVYYVKGNGTKNLERLKIRTPTFANIPSLLVMLPGVKLADVPIIVLTIDPCISCTER

SEQ ID NO: 14623 - protein, 284 aa, Bradyrhizobium japonicum USDA 110
MSAIDDLPPLREVIRQHALSARKSLGQNFLLDLNLTARIARAAAPLDNSTIVEIGPGPGGLTRALLALGARRVVAIEHDERAIPALQDISARYPGRLEIVHGDAMTFDPRPLLNGESAKIVANLPYNIATQLLINWLTTEPWPPWYDMMVLMFQREVGERIVAREDEEAYGRLGVLANWRCETKILFDIAPSAFVPPPKVTSSVVRLVPRAEPLPCDRKMLEQVAAAAFGQRRKMLRQSLKSLGVDPARLAQAAGVDATRRAETIPISGFVAMARELADIRSEG

SEQ ID NO: 14624 - protein, 261 aa, Arabidopsis thaliana
  misc_feature (163)..(163): Xaa can be any naturally occurring amino acid
  misc_feature (215)..(215): Xaa can be any naturally occurring amino acid
  unsure (1)..(261): unsure at all Xaa locations
RLRNSAPPSPPPPPHHSLCKKTKISSQICRTASKAAKSLLSSAKNARIYSEGRAIGAAAAVSASGKIPLYASNFARTSGSGVASKSWITGLLALPAAAYMIQGQEVLAAEMERTFIAIKPDGVQRGLISEIISRFERKGFGLVGIRVLVPSGGFAQKHYHDLXERPFFNGLCDFLSSGPVIAMVWEGDGVIRNGRKLIGAPDPQKSEPGTIRGDXAVTVGRNKTQGREGPETAKDEISLGLKPQELVSNTSNSEKWLYGDN

SEQ ID NO: 14625 - protein, 574 aa, Gloeobacter violaceus PCC 7421
MELSESHGVQPMNSRGFPGIPKEGSWTRKARRQAAGQDQVLVTPPPADWRPQPYLEGVGGLGEVLVTLKELVELPLKKPEVLEQLGLEPVRGVLLVGPPGTGKTLTARALAEQLGVRFLAIIGPEMMGKYYGEAESRLRGLFAKAARLAPCLLFIDEIDGLAPDRASTDHEADRRVVAQLLGLMDGVTKTPGVVVLAATNRPDHLDPALRRPGRFDREVRFGVPDRDGRLEILRILTRRMPFDETVDLEAVADRAVGLVGADLKGLCQKAAYRALRRQGGNLESAPGMSVSQSDFVAALKEVKPAVLRAVQVEAPAVAWEAVGGLEPVKQTLRESVEGALLYPELYRRAGAKAPRGILLYGPPGTGKTLLARAVASQARANFIAVKGPELLSRWVGASEQAVRELFAKARQAAPCVIFVDEIDTLAPERGSGGADSGVSDRVVGQLLTELDGLEEAGAVLLIGATNRPEVLDPALLRAGRLDLQLKIDLPDRESRLAILRVHNRERPLAGVDLEFWAGSTEGWSGADLALFSNQAALAAVRRHREAGHTDPARIVLGPDDFEAAYRTLKQQRGD

SEQ ID NO: 14626 - protein, 269 aa, Bartonella quintana str. Toulouse
MNMVYILSDFAQKQGYAVESYENVDSTNLIAQRRAYAGHRGYLWIVAQEQSQGMARRGRTWYSPKGNLYCSLLLIDDIVHQTAAQLSFVAGVSMVEAIKQFVKDENQANSIVSLKWPNDILLKESKSSGILLEIFKLTFQQYALVIGIGMNVNCHYEDAPYPTSSLKNIGLHVETEQLFTVLTEYFSKNYLLWKQPGGCDIIRKKWLLYSAHVGQHIKIINDKKVIEGIFDGLDSAFNCIIKQKNGQQVTITAGDVHFGLAASAKASRY

SEQ ID NO: 14627 - protein, 375 aa, Rubrobacter xylanophilus DSM 9941
MKSRAALLYGEGQEFRVEEIEVDDPKQNEVLVHLAATGLCHSDYHMVTGEYGPLHFPMIGGHEGAGVVEKVGPGVTRVSPGDHVLLTFIPACGHCRFCSMGLSFLCDRGAAILQGPQLDGTFRMHTADGQDAGQFCCISTFSEYTVVPEASIVPIDRDLDLTKVCIVGCCVPTGFGSAVNKADVQPGETVVVFGIGGVGINAVQGAAVKGASKVVAVDPVDFKLETAEELGATHTINPNERDPVQTVVDLTNGVGADKAIITIDNVLPEHVGQAFKAIRKGGRVVVTGVARYDHQHIDVPPYELTLFAKEVVGTMYGDSPVNADLARYLELYRTGKLKVDELITRTYSHDEINQGYRDMLDGKNIRGVIVYDWAR

SEQ ID NO: 14628 - protein, 998 aa, Gloeobacter violaceus PCC 7421
MSEPTIDRELDLHTFWQDASEPAPDTTIPAVALANGKGHLDYTDRFAGRHIGPDGREVERMLSTLGFESLDALIERAVPAQIRMERPLRLPKGLSEYEVLARLRAIAAQNRVFRSFIGMGYAECITPLVIQRNILENPGWYTQYTPYQAEIAQGRLEALLNFQTMVIDLTGLEIANASLLDEGTAAAEAMAMSFGIKAKGRAKRFFVSEHCHPQTIAIVQTRALPLGIDVIVGDHRAFDFQVQPCFGALVQYPATDGALFDYRAFVEAAHRAGALVTVAADLLSLALLVPPGEFGADIAVGNTQRFGVPMGYGGPHAAYFATRDAYKRQIPGRIVGVSTDAHGQRALRLALQTREQHIRRDKATSNICTAQVLLAVMAGMYAVYHGPVGLRRIAARIHRLTRTLAAGLVRLGHLLGSAPYFDTLRVELNGIDTRTIVERAEARRLNLRVLDERTIGVSLDEATSTRDLEDLLAIFALEGEPDFTIAELAAEVSQVQAPEVFGRQSAYLTHPVFNRYHSETELLRYMRRLESRDLSLTTSMIPLGSCTMKLNATAEMLPVSWPEFAKLHPFVPLSQARGYQILFEQLEAALAEITGFTAVSLQPNAGSQGEYSGLLVIRAYHHSRGEAHRDVCLIPQSAHGTNPASAVMAGMQVVPVACDEQGNIDVADLEAKATTHAARLAALMVTYPSTHGVFEEAIVRICAIVHGRGGQVYMDGANLNAQVGLCRPGDFGADVCHLNLHKTFCIPHGGGGPGMGPIGVASHLAAFLPRHPVVSQVGGQAGIGAVAAAPWGSASILTISWVYIFLMGGPGLTEATKVAILNANYIAHRLAPHYPVLYKGAGGLVAHECILDLRKLKTTAGIEVDDVAKRLMDYGFHAPTVSWPVAGTIMIEPTESESLEELDRFCEALIAIRHEIAAIERGEADRADNPLKNAPHTAAVLLADSWEHPYSRAQAAYPAPWLYQHKFWPVVSRIDNVYGDRNLICSCLPMEAYAQDGK

SEQ ID NO: 14629 - protein, 141 aa, Saccharophagus degradans 2-40
MAIERTLSIVKPDAVEKNIIGKVISRFEKAGLKIVAAKMMHLTEEKARGFYAEHEGRPFFAGLVEFMTSGPVVVQVLEGENAIALNRELMGATNPAEAAEGTLRKDFADSVGRNAVYGSDSPASAEREINYFFDASEICPR

SEQ ID NO: 14630 - protein, 464 aa, Bdellovibrio bacteriovorus HD100
MIPVILSGGSGTRLWPVSRQQMPKQFCDIFGEPLQTLTLKRCLRMGSPWIVTSKALQTLTELNLKANQGDGANQGEAVKVVYEPVGKNTAPAVAALCKLLLDQGKGDEIVGVFPSDHLITKEDAFLKVVEFASAVAKENRVVTLGITPSYPETGYGYIQTKTTSLKDQAGLKAYSVVKFHEKPDLKKAEEFISQGGFSWNAGIFVFKVSHMASLFEKHQPTLWNQISALKADASNLGDIYAQVQSISIDYAIMEKLSEAELACVPADFGWSDVGSWDAVAALQKGQDIINVKGKDNFVFGEPTKNYSMIGLEDVIVVDTKDALMLVKKGQSQDVRHVVETLTQAKSPLVKEHVYEYRPWGYFEILKDTENFKSKIIRVNPHSQLSYQSHAKREEHWTITQGSGEVVLNDQVIPVKAGSHVHIPLGAKHRMRNNSSEMLEFVEVQLGTYFGEDDIVRYQDDYSRN

SEQ ID NO: 14631 - protein, 80 aa, Brassica napus
MPQGDHIELHQKRHGKRLDHEERKRKREAREVHRRSKDARNLIGAKGKRFAKKRYAEKAQMKKTLKMHDESNKRQKVDDD

SEQ ID NO: 14632 - protein, 441 aa, Propionibacterium freudenreichii
MSVSDELFAEALKVMPGGVSSPVRAYRSVGGTPRFVKRALGSHIVDVDDKRYVDLVCSWGPMIAGHAHPEVVAAVLQAVADSTSFGAPSEVELRLAQAVVARMGGAIDKVRFTCSGTEAVMTAARLARGITKRPLLVKFVGCYHGHSDSFLVSAGSGVASLGLPDSPGVPKEVAGDTVALPYGRIDMVEELFAERGDQVAAIVTEGVPANMGVIVPPEGFNRRLHDIAHAHGALLIQDEVLTGFRLSPTGAWGLQGAKEGWTPDLFTFGKVIGGGMPLAAVGGSAQLMDYLAPEGPVYQAGTLSGNPAACAAGLATLALMDDAAYSRLDATADRVSAMADAALESAGVPHRINKVSNLFSVFLTDAPVTDFASASKQDTKAFSRFFHAALDAGLWLAPSGFEAWFCSTALDDDDLEVIDAGLHKAAQAAAQGLSSLEDVRR

SEQ ID NO: 14633 - protein, 374 aa, Sulfitobacter sp. EE-36
MQFETPGPVEAELADAIAPIEEIIEEARQGRMFVLVDHEDRENEGDLVIPAQFADADAINFMATHGRGLICLPMTEERVNTLGLPMMAVNNSARHETAFTVSIEAREGVTTGISAADRALTVKVAIDEDKGAVDIATPGHVFPLRARDGGVLVRAGHTEAAVDISRLAGLHPSGVICEIMKEDGTMARLPDLVAFCQQHDMKIGTISDLIAYRHKHDNLLVERDSRTVTSAYGGDWKMQIFTDEISGTDHVVLSKGDITTDAPVLVRTHAINALEDILGLGPSPADELPRAMQIIADEGRGAVLLFRDPDPRLRFEDEEDDRPRTVKRTGLGSQIMASLGLHKLILLTDNPDTRYLGLDAYDLSIVGTRPITQE

SEQ ID NO: 14634 - protein, 287 aa, Triticum aestivum
MAAAPPQPAAPAPGPANGGDAFRLGFVGAGNLAESIARGVAASGVLPASAVRTAPHRRPERGAAFASLGATILASNAQVVDGSDVIVISVKPQIVKQVLVELKPLLSEEKLLVSIAAGIKMKDLQDWSGQRRIIRVMPNTPSAVGQAASVMCLGETATEKDENRVKSLFSAIGKVWTAEEKYFDAVTGLSGSGPAYIFLAIEAMADGGVAAGLPRDLALGLAAQTVLGAATMVSETGKHPGQLKDQVTSPAGTTIAGVHELEKGSFRGTLINAVVAATTRCRELSKN

SEQ ID NO: 14635 - protein, 248 aa, Methanosarcina acetivorans C2A
MSYLIIVRHGESGWNVDGRFGGWVDVPLTGKGIKEALLCAAELEGIDLDVTFTSKLIRAQETLFLILSKQKKIGVFVHEEAGTGEDRTEREDGSRKDRKEKRYAYPPNTEKNLIPIHSNEALNERYYGILQGKKKDKMKAKYGEEQILHWCRSFDEGPPEGESLKDIYRRAVPYFEKEIFPILQDGKNVIVCAHQNSLRALIKHIEGISNEDIRKIRLANARPVIYTFSGGRLVRENAETDPSVKRNL

SEQ ID NO: 14636 - protein, 650 aa, Magnaporthe grisea 70-15
MVRAKDKSSVGLGNALMNDRFGKGKGTDRRKAGAVTRTNHATGEQYITNDREEAAWVKMRSVTEQGALDEFLSTAELAGTDFTAEKMNNVKIIHTDQKNPYLLSAAEERAVLGKHKTHKQRLTVPRRPKWDETTTPEQLDAMERESFLNWRRGLAELAESNDLLMTPFERNLEVWRQLWRVIERSDLVVQIVDARNPLLFRSEDLDHYVKSVDAKKENLLLINKADMMTLKQRQEWARYLKGAKIAFKFFSASYAKELNEARDLESESEDDEAEESSVADGGAKLNPDASVPQSAEKEESGDQEAEESSLEEEDSDTRIITVEELESIFLKHAPESSADPKQKMQVGLVGYPNVGKSSTINALIGAKKVSVSSTPGKTKHFQTIHLSEKVVLCDCPGLVFPNFASTKADLVCNGVLPIDELREFTGPAALVARRIPKAYLEAVYGINIKTRPAEEGGTGVPTAEELLVAYARARGFTKTGNASPDESKAARHILKDYVNGKLLYCEPPPTFESDAVDFNHELYIVANLPEKRRLAVTAALDAMSISAGDSVSLAGTDILALPQGPKSQKLDKTFFGTGRNAGHVSRPFNYKYTEQGMASGKQLSGRKAREMAAIENGIDPKDARLMSGKKHFKGGQKPKANRRLNKDDED

SEQ ID NO: 14637 - protein, 125 aa, Brassica napus
  misc_feature (6)..(6): Xaa can be any naturally occurring amino acid
  misc_feature (9)..(12): Xaa can be any naturally occurring amino acid
  misc_feature (14)..(16): Xaa can be any naturally occurring amino acid
  misc_feature (18)..(19): Xaa can be any naturally occurring amino acid
  misc_feature (22)..(23): Xaa can be any naturally occurring amino acid
  misc_feature (25)..(25): Xaa can be any naturally occurring amino acid
  misc_feature (28)..(30): Xaa can be any naturally occurring amino acid
  misc_feature (33)..(34): Xaa can be any naturally occurring amino acid
  misc_feature (36)..(38): Xaa can be any naturally occurring amino acid
  misc_feature (40)..(40): Xaa can be any naturally occurring amino acid
  misc_feature (44)..(44): Xaa can be any naturally occurring amino acid
  misc_feature (48)..(48): Xaa can be any naturally occurring amino acid
  misc_feature (52)..(52): Xaa can be any naturally occurring amino acid
  misc_feature (56)..(56): Xaa can be any naturally occurring amino acid
  misc_feature (63)..(63): Xaa can be any naturally occurring amino acid
  misc_feature (84)..(84): Xaa can be any naturally occurring amino acid
  misc_feature (87)..(87): Xaa can be any naturally occurring amino acid
  misc_feature (100)..(100): Xaa can be any naturally occurring amino acid
  misc_feature (110)..(110): Xaa can be any naturally occurring amino acid
  misc_feature (112)..(114): Xaa can be any naturally occurring amino acid
  misc_feature (117)..(124): Xaa can be any naturally occurring amino acid
  unsure (1)..(125): unsure at all Xaa locations
DQSSMXSSXXXXTXXXQXXMVXXFXVLXXXAAXXVXXXAXNDIXSIAXNGGXVSCXKVWPPVXKKKFETLSYLPDLTEVELGLXKSXTLLRNKCIPCVEXELEHGFCAPXSXXXPPXXXXXXXXM

SEQ ID NO: 14638 - protein, 304 aa, Oryza sativa
  misc_feature (286)..(286): Xaa can be any naturally occurring amino acid
  unsure (1)..(304): unsure at all Xaa locations
DSVEDITVSLDSGAGAGAGAGFDAGAYMAALRASRFGRWMLWSPRLASTHDLVTQNFAKLPVGVVCVADVQFKGRGRSKNVWESPPGCLMFSFTSQMEDARKLPLMQYVVCLAMTEAIKELCCAKGLSELDVKIKWPNDLYLKGLKVGGILCTSSYQPKVYNICTGIGLNVDNEEPTTCLNAALKEMNANLPTLKREDILASFFNKFEVLFEIFTNEGFQALEEQYYNSWLHSGQKVVVQDGPEAQHADSVVTIQGLTPAGYLYAIGEDGKSYELHPDGNSFDFFXRVSAKEDGNVVLHEYIHR

SEQ ID NO: 14639 - protein, 432 aa, Listeria monocytogenes str. 4b F2365
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDFASFKEALAVWGDQVAAVLVEPIVGNFGMVAPEDGFLEAVNELAHANGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAALKHGIAVTVNQIVGALTVYFTEDPVTNYAEAGATNGELFGRFFKGMLEEGINLAPSKYEAWFITSAHSEADILETIQAVDTVFGKMVQDN

SEQ ID NO: 14640 - protein, 173 aa, Zea mays
MFLRRILTGGGGLAALRAARAVKETTGIVGLEVVPNAREVLVGLYERTLKEIKAVPEDEGYRKAVESFTGHRLQICQEEEDWKRIEDRIGCGQVEELIEEAEDELKLIAKMIEWDPWGVPDDYECEVIEDDTPIPKHVPQHLPVALPEEFFKALDAVKSDPALQGDAPPQVKA

SEQ ID NO: 14641 - protein, 677 aa, Arabidopsis thaliana
MTGYVQNENFKKAIREFMPDKGLETKIIGALHACAYAGDQDLVARPGPLYLGILDGRYVVLGSKKVSVYMFSSYNNLRRLFLDIGDDEGIIPRTVVWVANRENSVTDATADLAISSNGSLLLFDGKHSTVWSTGETFASNGSSAELSDSGNLLVIDKVSGITLWQSFEHLGDTMLPYSSLMYNPGTGEKRVLSSWKSYTDPLPGEFVGYITTQVPPQGFIMRGSKPYWRSGPWAKTRFTGVPLTDESYTHPFSVQQDANGSVYFSHLQRNFKRSLLVLTSEGSLKVTHHNGTDWVLNIDVPANTCDFYGVCGPFGLCVMSIPPKCKCFKGFVPQFSEEWKRGNWTGGCVRRTELLCQGNSTGRHVNVFHPVANIKPPDFYEFVSSGSAEECYQSCLHNCSCLAFAYINGIGCLIWNQELMDVMQFSVGGELLSIRLASSEMGGNQRKKTIIASIVSISLFVTLASAAFGFWRYRLKHNAIVSKVSLQGAWRNDLKSEDVSGLYFFEMKTIEIATNNFSLVNKLGQGGFGPVYKGKLQDGKEIAVKRLSSSSGQGKEEFMNEILLISKLQHINLVRILGCCIEGEERLLVYEFMLSQCIDSRKRVEIDWPKRFSIIQGIARGLLYLHRDSRLRIIHRDVKVSNILLDDKMNPKISDFGLARMYEGTKYQDNTRRIVGT

SEQ ID NO: 14642 - protein, 494 aa, Pisum sativum
ETSLLLSFLIILSHFVVEIHGKNKQVEALDNLHKAEYIENSEIDKSEFEVQEIVYDIDAIADSQKGVKENDRIKKLPGQPFVKFSQFGGYVTLDKLSGSAFYYYFVEAHQSKETPPLLLWLNGGPGCSSLAYGAMQELGPFRVNSDGKTLHQNRYSWNYAANVLFLESPVGVGFSYSNKSTEYSSNGDKKTAIDNYLFLVNWLERFPEYKNRDFYISGESYAGHYVPQLAHTILYHNKKANKTIINLKGILIGNAVIHDTTDSTGMYDFLATHAIISDKAAYDVNKVCDFSSSDNLTAECNSAADEVNEDIAFIDLYNIYAPLCKNENLTSKPKKNTIVTDPCSKNYVYAYLNRQDVQEAIHANVTKLKYEWSPCSGVIRKWVDSSPTVLPLLHEFLNNGLRVWIFSGDTDGRVPVTSTKYSIKKMNLPVKTVWHPWFAYGEVGGYTEVYKGDLTFVTVREAGHQVPSYQPARALTLIKHFLDGTPLPSPKIKA

SEQ ID NO: 14643 - protein, 235 aa, Glycine max
  misc_feature (83)..(83): Xaa can be any naturally occurring amino acid
  misc_feature (142)..(143): Xaa can be any naturally occurring amino acid
  unsure (1)..(235): unsure at all Xaa locations
MASQVCKAASRAARSLLSASRASHGRAVGAATAVSLSCKVPLFYGKNGSGSGSASSSSSSWISGALALPAAAYMFQDQEVRAXELERTFMAIKPDGVQRGRISEIISRFERKGYKLVGIKVVIPSKEFAQKHYHDLKERPFXXGLCDFLSSGPVIAMVWEGQGVISYGRKLIGATDPQKSEPGTIRGDLAVVVGRNIIHGSDGPETAKDEIKLWFKPEELVSFTSNAEKWVYGVN

SEQ ID NO: 14644 - protein, 241 aa, Methanosarcina mazei Go1
MIITGHLILVRHGEPGLKPGERLSGWIDIPLSRKGIEEALECAKALENIEIDIAFASDLVRTQETLFIILSGQKKTGVVVHEKTEDKVPPEKLDWYSYPEKLGEDLIPVYTTPALNERYYGKLQGRKKQKMEEKYGAEQVANWRWNFEPGPPEGESLKAVYERTVPYFRKKVMPALEGGKNVLICAHQSSLRALVKYIEDISDKDIREVRLSTGELAIYHFSEGKLVRENEELGPELKRNI

SEQ ID NO: 14645 - protein, 368 aa, Selaginella apoda
  misc_feature (216)..(216): Xaa can be any naturally occurring amino acid
  unsure (1)..(368): unsure at all Xaa locations
LVCDNGSGMVKAGFAGDDAPRAVFPSIVGRPKHTGVMVGMGQKDAYVGDEAQSKRGIQALKYPIEHGIVTNWDDMEKIWHHTFYNELRIAPEEHPVLLTEAPLNPKANREKMTQIMFETFNVPAMYVAIQAVLSLYASGRTTGIVLDSGDGVKHTVPIYEGNAMPHGIFRLDLAGRELTDCLMKILTERGYTFTTTAEREIVRDMKEKLAYVALEXEQEIESAKNSSSLEKTFELSDGQVITIGSERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDDSGPSIVHRKCF

SEQ ID NO: 14646 - protein, 368 aa, Selaginella apoda
  misc_feature (138)..(138): Xaa can be any naturally occurring amino acid
  misc_feature (148)..(148): Xaa can be any naturally occurring amino acid
  misc_feature (169)..(169): Xaa can be any naturally occurring amino acid
  unsure (1)..(368): unsure at all Xaa locations
LVCDNGSGMVKAGFAGDDAPRAVFPSIVGRPRHTGVMVGMGQKDAYVGDEAQSKRGILTLKYPIEHGIVTNWDDMEKIWHHTFYNKLRVAPEEHPVLLTEAPLNPKANREKMTQIMFETFNVPAMYVAIQAVLSLYAXGRTTGIVLDXGDGVTHTVPIYEGYALPHAIXRLDLAGRDLTDALMKILTERGYSFTTTAEREIVRDVKEKLAYVALDFEQELETAKSSSSIEKSYELPDGQVITIGSERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWIAKTEYDESGPSIVHRKCF

SEQ ID NO: 14647 - protein, 471 aa, Salmonella enterica subsp. enterica serovar Montevideo
MITPIIMAGGNGSRLWPLSRTLYPKQFLCLDGSQSMLQTTITRINNLNASDPIVICNEQHRFIVAEQLKELSKSSGDIILEPVGRNTAPAVALAALKCLKKNALLLVLAADHIIKDEETFCKTIQDARKYAEAGKLVTFGIVPTMPETGYGYIRRGQALFSAENDCSLAFRVAEFVEKPNLETAQSYLDSGEYYWNSGMFLFRADRYIEELKIRPDIYKACSLAMESAVTDLDFIRVDEDSFCACPDESIDYAVMEKTNDAVVVPLNAGWSDVGSWSSLWEISDKDSNGNVTKGDVLSHNADNCYLHAETGLVTAVGVKDLIVVQTKDAVLVANTNCVQDVKKIVEKIKLENRHEHITHREVYRPWGKYDSIDFGERYQVKRITVKPGEGISEQQHYHRAEHWIIVAGTAKITIKGEVKILTENESVYIPVGVKHCLENPGKIALELIEVRSGAYLGEDDIVRFSDKYGRN

SEQ ID NO: 14648 - protein, 349 aa, Aspergillus nidulans FGSC A4
MTFLRIATKRAIYLHRPANPALPTSSILPVLHSTNVATRVPSPCAIRHSSHSPLGAAQANPRKKVTMQTLRNLYKKGEPITMLTAHDFPSAHVADAAGMDMILVGDSLAMVALGMQDTSEVTLDDMLVHCRSVARAAQSAFTVSDLPMGSYEVSPEQALQSAIRIVKEGRVQGVKLEGGEEMAPAIKRITTAGIPVVGHIGLTPQRQNALGGFRVQGKSTTDALKLLKDALAVQEAGAFMIVIEAVPPEIASIVTQKLSVPTIGIGAGNGCSGQVLVQIDMTGNFPPGRFLPKFVKQYANVWNEALQGIQQYREEVKSRAYPAEQHTYPIPKEELVEFQKAVDELPEEK

SEQ ID NO: 14649 - protein, 228 aa, Candida glabrata CBS 138
MWASIFGGKGNTNKELPKKAIIELREHINLLSKKQAHLQGQITAQENEARKFLTRGNKTMAKNALKKKKVYEGQLVKLESQMDSLEQQLFSIESANLNLETMRAMKQGAKAMKSIHSGLDIDRVDETMDEIREQVELGEEISDAISRPLYTGANEIDEDELDEELDMLAQETEPQVATKEQALPESKQALSMPNIPNTKIDESKTKIEEEEEDEDERALRELQAEMGL

SEQ ID NO: 14650 - protein, 356 aa, Clostridium acetobutylicum ATCC 824
MLYALVLAGGKGTRLYPLSRKESPKQFLKFIHNKSFLRNTVDRIKTLVDKENIYIVTNERYINKIQEELPEINRSNIFTEPENKETATCIGLSAVKLLKKDSDATMIVLPSDHYIENEKEFIDTLRQGVEVVERKRCLVTMGITPTRPETGYGYIQMGDKVINYESIYKVERFLEKPNIEVAKDLLSKGNYLWNSGMFVWRADTYLREMNKYLPKMYKAMMEIYENVGTKTEEETINEKYKIIDGISVDFGIMQKTRKAYVVKANFEWDDLGNFSSLARFLKSYEGGNTISDNVFLEDTENCSIFGSENLIICFGVKDLIVVDAGNVVLIMDKNRDQELKHLVEELKNKKEIEDYL

SEQ ID NO: 14651 - protein, 60 aa, Glycine max
EKVQELSVYEINERDRGSPVYLRLSYKSVNSLGDLVPFSNKLYTGDLQKRIGITSGICIL

SEQ ID NO: 14652 - protein, 820 aa, Agrobacterium tumefaciens str. C58
MINNLTAADLPRPAPRSSNPEIMAAEIIERLTYRIGKDVKVAKPHDWLTATILVVRDRIIDKWMASTRKAYADNSKRVYYLSLEFLIGRLMRDAISNIGLMHEIRDALSSLGVDLDVIAGLEPDAALGNGGLGRLAACFMESMATVDIPAYGYGIRYVHGLFRQQMADGWQVELPETWLAHGNPWEFERRESSYEIGFGGSVETIGGYEDPQRFVWKPAERVIAMAYDTPVVGWRGTRVNTLRLWSAQPIDPILLAAFNAGDHIGALRESNKAESLTRVLYPADATPAGQELRLRQEFFFSSASLQDILRRHLQQYPDFTSLPDKVSIQLNDTHPAISICEMIRLLCDVHGLEFDEAWRITQGTFSYTNHTLLPEALESWPVPLLERLLPRHMQIVYAINANTLLFARKEKKMADQQIRSISLIDEGGERRVRMGNLAFIGSHSINGVSALHTELMKETVFADLHSLYPERINNKTNGITPRRWLMQCNPGLTGLIREAIGDDFLDDAEKLIALDRFADDAGFREKFAEVKRLNKVRLANTVAQRMGIRVDPSAMFDIQIKRIHEYKRQLLNLIETVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGADNIVIFGMTAEEVSRARAEGHNPRAIIEGSAELSQALSSIASGVFSPDDRSRFSALMDGIYNSDWFMVAADFDAYADAQRKVDAIWSDQDSWNTKAVRNTARMGWFSSDRTIRQYATEIWRA

SEQ ID NO: 14653 - protein, 116 aa, Brassica napus
  misc_feature (15)..(15): Xaa can be any naturally occurring amino acid
  misc_feature (101)..(101): Xaa can be any naturally occurring amino acid
  unsure (1)..(116): unsure at all Xaa locations
AWKLSQLHHTSLWPXVKPLLKSSLPSSQSSCWLCNPRIPNLRISDGSSHVGLRIQALSHNDDAPSDEGDAAESSGLGLFPGDIFSLSQTSLALPQGCAGDXGGDRAGLYRTPISGG

SEQ ID NO: 14654 - protein, 425 aa, Triticum aestivum
MGNSQASPLSASSASFVMASRAFSKQALDELRAHFSSLAAQSGTQGRAISRPVFLDYFGVRGALGDRLFQLVAKESSVEDGVTFEGLIITKATYERGTKDEADEFIFQLCDVMGDSILTRSDLEAVFVSIHETIFADNNEAKEGSNKSTFEAFLNSAVFSKDAEGVSEKSMSLSDFRNWCIVMPKLRKFLGSLLMPPDSGRAGFQIPLLHYPENISSELLLLNKEYAWHIGGGFSQHDVQEWKLLYHSSLHGQSFNTFLGNVTNGDVQTVLVIKDAEGSIYGAYASQPWERHSDFYGDMKTFLFKLYPEASIFCPTGANKSLQWCAVNFTSENIPNGIGFGGKPHHFGLFLSAGFDQGHSFTSSTFTNPPLSNTSRFRPEVIECWGIQVKGSNDEKPELVKGTVLERFKEDRNMLKLIGMASASD

SEQ ID NO: 14655 - protein, 269 aa, Novosphingobium aromaticivorans DSM 12444
MTKTFLQFGCGNMGGAMLKGWLAGGLAPETFTVVDPYLEAAPHGVRLLEAAPAGEDAFDIVLLGFKPQQLPDAAQAVRPFVGPRTLLLSILAGVDLATLRRTFPEARAIVRVMPNLAAALGKSPIALFGDADEAARAETDALMAPLGQAEWLSGEDQMDLVTALAGSGPAFVYRFIDALAEGAAALGLPRDQADRLALSMVEGSAMLAAASEHSPGELARRVASPGGVTQVGIDILDAERRLARLVEDTLRGARDRSAEMTEQARARQQ

SEQ ID NO: 14656 - protein, 236 aa, Arabidopsis thaliana
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSVHYRFLDVFRFFRFLEKSRFDGIAFVCL

SEQ ID NO: 14657 - protein, 308 aa, Frankia sp. CcI3
MALLGRGRSERGSDRGSGKNRGSGKDEDGVGKDRSVKGAAGSKGAAGVKGTGRRTLVAGNWKMNLNHLEAIALVQKIAFDLKPAELETVEVVVLPPFTDLRSVQTLVDGDKLAIAYGGQDLSPYASGAHTGDISGAMLAKLGCDYVVVGHSERRADHHEDDALVAAKAKAAFSVGLTPILCVGEPEEIRAAGTQVEHVLRQLERSLAGITAEQAATIVIAYEPVWAIGTGRTASAQDAQDMCAAVRGQLASQYGDEIAAGIRVLYGGSVKAANAGELFTMPDVDGGLVGGASLVAEEFVGIVRSGPPA

SEQ ID NO: 14658 - protein, 490 aa, Neisseria meningitidis MC58
MNQTSRDLTRISHNTKIVATLGPGSNNVELLEDMIRVGGLNVVRFNFSHGTPEFHQENALIVREAAKRAGQEIAIIADLQGPKIRVGKIAGGGIELNKGETLVLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 14659 - protein, 513 aa, Physcomitrella patens
MAGLPVASSLVAPHIDCSSTASLSSKDVKCTGLAWAAMEPCAGSLLPVRSSAASPGIRTPVGLGRTAGLNDIIFRRSNYGRNEEKSGRVTEIVQQFTPSPSSLPEGNPKPCQNPLRSWGSRAAFTIVQATSSSDYLEDDSQLNSVKDYNSALLNCVKDGRMRDAMTIFKRFEGAGLKPDVVSYTALIQGFGKLKSYNKVTDVFSRMQRNRCPPDLKLCTVLISTYGNGGLPVLAESAMQYAQAQGLQPDAIAYTALVHAYAQEGLWEEAEKTLSDMLDVGIVDDRPYAALVAAYGKAGLTDNVNKILETMKASGVEASTTLYNTLINIHSKAEAPEKARAVLQLMQADGCQCDEITYTSVMEAYSRNKQPLMAESMMGEMKRAGIQPGPVSYGVLISAYCRAGRLGDAERILRAMQNAKCKPTVEIYNMMISGYASAKMRSQAERMFQTMQDCGLRPDAAEDCYIRMQQLGCKPNAVTYKILLKAYTDYNNSIDAERIRLDMRKAGISLETLS

SEQ ID NO: 14660 - protein, 297 aa, Staphylococcus aureus subsp. aureus MRSA252
MLDNKDIATPSRTRALLDKYGFNFKKSLGQNFLIDVNIINNIIDASDIDAQTGVIEIGPGMGSLTEQLARHAKRVLAFEIDQRLIPVLNDTLSPYDNVTVINEDILKANIKEAVENHLQDCEKIMVVANLPYYITTPILLNLMQQDIPIDGYVVMMQKEVGERLNAEIGSKAYGSLSIVVQYYTETSKVLTVPKSVFMPPPNVDSIVVKLMQRTEPLVTVDNEEAFFKLAKAAFAQRRKTINNNYQNYFKDGKQHKEVIIQWLEQAGIDPRRRGETLSIQDFAKLYEEKKKFPQLEN

SEQ ID NO: 14661 - protein, 338 aa, Sinapis alba
MADKKIKIGINGFGRIGRLVARVILQRNDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESQGKLKGILGYTEDDVVSTDFVGDNRSSIFDAKAGIALSDNFVKLVSWYDNEWGYSTRVVDLIIHMSKA

SEQ ID NO: 14662 - protein, 366 aa, Cosmarium botrytis
QDNGSGMVKAGFAGDDAPRAVFPSIVGRPRHQGVMVGMGQKDAYVGDEAQSKRGILTLKYPIEHGIVTNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTEYLVTILTERGYSFTTSAEKEIVRDIKEKLAYVALDYEQEMSTAKSSSSLEKTYELPDGQEITLGSERFRCPEVLFNPSLVGKEAAGIHETCYNCIMKCDVDIRKDLYGNIVLSGGTTMFPGIADRMTKEITALAPNSMKIKVVAPPERKYSVWIGGSILASLSTFQQMWIAKGEYDESGPSIVHSKCF

SEQ ID NO: 14663 - protein, 140 aa, Bradyrhizobium japonicum USDA 110
MAIERTFSIIKPDATARNLTGAVNAVIEKAGLRIVAQKRIRMTKEQAETFYAVHKARPFFGELVEFMTSGPVVVQVLEGENAVAKYRDAMGATDPSKAAEGTIRKLYAKSIGENSAHGSDAPETAAIEIAQFFSGNEIVG

SEQ ID NO: 14664 - protein, 465 aa, Rubrobacter xylanophilus DSM 9941
MAIATVNPATGEELKRFEALDREQIDEKIERAVGAFRGWRETPVQERCRLMARAAEVLEERAEEFGRLITTEMGKPLAAAVAEVRKSARGCRYYAQNAARFLADEEVELEGARAFVRYQPLGPVLAVMPWNFPFWQVFRFAAPALTAGNVGLLKHASNVPQSALAIEEVFRQAGFPEGVFQTLLIGASQVRDVISDPRVRAATLTGSTPAGRDVGGEAGRNIKPSVLELGGSDPFIVMPSADLDRALDTAVTSRTLNNGQSCINAKRIIVHRQIAEEFTRRFVEKMASLKVGDPMDETTDMGPLAMPSILEGVDEQVRRSVEAGAKVLTGGKPLDGPGYFYPPTVLAEIPEGAPAREEEIFGPVASLFTARDIDEAIRLANETPFGLGSSAWTNDPEEQERFVDEIEAGMVYINRLVESTPEVPFGGVKSSGYGRELSHFGIREFVNVKTVWIDASGGERGRGVE

SEQ ID NO: 14665 - protein, 661 aa, Aspergillus nidulans FGSC A4
MATSYDATTTASELADHLSADIKGKVVLTTGPSPASIGAMFVESIARGLPALIILAGRSTTKLQQTAGAIAQAQPVVKVRLLHLDLGSLASVREAARELASWEDVPRIDVLVNNAGIMGTKFALSPEGVESQFTTNHLGHFLLTNLIIGKILKSDTPRVVNVSSDGHRLSPIRWADYNFQEGEIYNKWLAYGQSKTANMLMAVSLAEKLGSRGLLAFSLHPGVIISTSISGGLDNMDEDLAALKALDRMLGNAEGWRDFKVKTRQQGAATTVYAAFYPGLKESNGAYLQDCHVADPWTDTVKPWGTDKVEAERLWKLSEKLSMEWTVEAGLLAGGYGKSLQMCIQKPKTGDHYFHFVIYGENQLVPGNNTIRIPSVRMTMADDITHFRSIPWVSDLLNDPTFVTHPIPSRKIKASTEDSLFSTTLNSRSTISSCLLQYRILSSNATPLYRNAIPTNEVRIFCTLGSDLNGYPGILHGGIVATLLDEFMGLILSMSRAGGEPGMEGPVTAYLNTRFVRPVMTPGTVVVSGRIVEAKEERKWKIVGNIKDTSNKTSPAWPQYMPRISHATALLLSTATESFLKVELQMPALLILALALLLVCLSNMIGSYSSFAAAATFHLDSGIYFSGIGFEQPCFGNAGNCLERALGKGKPRGLKKNLGLI

SEQ ID NO: 14666 - protein, 329 aa, Bacteroides fragilis NCTC 9343
MDKIIGLGNALVDVLATLKDDTLLDEMGLPKGSMQLIDDAKLQQINERFSRMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 14667 - protein, 658 aa, Aspergillus oryzae
MVLAKSKNSVGLGNSLMKDRFGKGKASNMKKASHNQAVARKDMNGETYITNAKEDAAWVKMRSITEQAALDEFLSTAELAGTDFTAEKMNNVKIIHADQKNPYLLSASEEKSAVKKHQKNRGRLTVPRRPKWDSTTTRQQLDVMERESFLSWRRGLAELQENHDLLMTPFERNLEVWRQLWRVIERSDLVVQIVDARNPLHFRSEDLESYVKEIDPKKENLLLVNKADMLTEKQREAWADYFDRNNISFRFFSAQLAKEKIDAQLAEQGDSEDEEVAEKLAETTIEEQSTEAPQEEHDGGLKLPGSSRSRRTEILDVDELEELFLSNTPDTLPENDDPENPRKQKTVIGLVGYPNVGKSSTINALLGAKKVSVSATPGKTKHFQTLYLSPEIMLCDCPGLVFPNFATTKADLVVNGVLPIDQQREFTGPATIIAQRIPKHFLENVYGVTIHTRPIEEGGTGIPTGSELLRAYARARGFSTQGLGQPDESRAARYVLKDYVNGKLLFCHPPPVPEGQTPIDPNEFNVELYDIAHLPARRQEQLLKAMQAEQLAEDIDSDILSMSRQPVQGSRSRNLDTGFFGDASKGSAGRLTLPFNAQYTEQGQQMRQQLTGRKERLMVALERGIDVTEVRGGSSKKHFKGNKKQAKKKRAVTADDDY

SEQ ID NO: 14668 - protein, 1531 aa, Debaryomyces hansenii CBS767
MGRYRDRNRETDENDDTNRQATMTTTLVQQHSRQSLGKFVNPSPTKYESTENMDKVVQSVTNATKRLSQISTNTNSSAKKRKTQNRIGPWKLGRTLGRGSTGRVRLAKNVNSGKLAAVKIVPKSNFKKLENPKYKRNSVDSSGSVKDRLPYGIEREIIIMKLISHPNIMGLYDVWENKNDLYLILEYIEGGELFDYLIKKGKLQEFEAISYFKQIINGIHYLHQFNICHRDLKPENLLLDFNKNIKIADFGMAALEVREKLLETSCGSPHYASPEIVAGKNYHGAPSDIWSCGIILFALLTGHLPFDDENIRKLLLKVQNGKFLMPNNLSSESKDLISKMLKVNPSERITIDAILQHPLLTKYPEPSVRKDKVTEYSDLNIRPIDSINNIDKEILKNLSVLFHNRDEQTIISKLLSPEDCSEKTFYYLLVKYRNEHLTASNNTINNYEDDPDLTGSESKQTITRSTSIVKTTTTDPLTGEKHTTIRKIPNSTSNFSNRSRSPKKKPEVLGNITNTAPTFKASTSFNKKKTLMNNNVISRNNSSKSLRKRPPQQQPPKLSRKISGMPDLNDLRLEKTQLNSLYKQQKLNGSFGNKSLFNFESVCQEIFGNAEQHEGDRKIEPKENLRKDKQMDGRTGKLSNIEKCERELAAKVHEKNDARALKLQHQQKEEDAKLQHKKQLESKKRDQSKLLQEKQRQALEKLGSQIQDNNDNNRRGIAHRTQQRHVTEPAPTSSLDPKLGGGAKSLLRAKSLASPSSYVSLRQNTHTSDNTSKVLQTLGIEVAPLKTSTKFNSNLKTSSSKNLSDYLDNETLYSRSDKSIEHQKENISMNKFNEKEKVNQSIAKPNYSRTSTSKLQPLAISRTTTLNSIGYRSLLDGIDENKVQKDLPKRPNGEKDYDTTLSTIETRKNGLIPNPRFSRFSFNGLLNSRFDNPDVTIQNNLVSSGTVVRKSVNQKEPISSRIIEEDPQTSHLKLETGSLKKSSTNLLGLGIVQNHQGKTSRKVSQNSEYCDSNFISVNLSDTADDSQDNTTLEENAISLSHANSVLKDDHANTTVSNTTISKQQEVLNTNVDQRNKRKSSYLGNLEGSKETLVENDKEDKSFQDSIKSMYKDYAKLYNDKKPKSETNTQELGETDDNIPSEKQTRERQSILRDDRINSIDSDNDLSFAADGSSNIDILDSSSIADTNMIENRSEIQLNDNKYSPTITDNQKDFGDEYEDEIDDQFSQHGDQQEYNHEYDHENNHEYNQEDGQEQHEHDHNQQNDQQLQDSDRLQTGTDLRKSTASTQIFSTMNLPKIRDKNSVVEENKEIKHSEVKSEESNQRHNSIFNKLKPKREAPKPPGFKWDDEKSQGHNRFSRISVSSKFDKQQKLNDNYNDSSKSNWFMKFINSLTANSKTPKGEKRKSLIRKFNSDKLDDNETKNFCVLDSTLQSSELTRVIKDTLELKKIEGSVSKVDIDEDFGMISGVIPARYSGGRRLRFKIEIINLKNSSSLHLSKLKGTDKGFKNLTNTVKFIVSKEEQNINRMSSVEA

SEQ ID NO: 14669 - protein, 648 aa, Aspergillus oryzae
MVIPAWAAAAWTSLTTALILPGIPGAAAENKQALCLARHWSEVEAEFIQWPICVESRWERTAPRITQDTTRSPDQTVSVTVSEGAPSTTAIPAPGGQPDHELDTDSPLDNSNFLSFEDWKKQNLAKVGQSAENVRGNRHAAGKEDRRRPTGINNALDSLGEDTEIDLDFGGFGAEASDAAKPTSWGSSIPTAGITGTAAGASAGDMEAAVSADLRKGASRGKDAGTTCKERFNYASFDCAATVLKTNPECKGSSSVLVENKDSYMLNECRAKNKFLILELCDDILVDTVVLANYEFFSSIFHTFRVSVADRYPAKTDQWRELGVYEARNTREIQAFAVENPLIWARYVKIEFLTHYGNEFYCPLSLVRIHGTTMLEEYKHDGETNRGDEEAAAEALEPSPHPVDVEVKDVAQQPLTTVALPDEPTNGPTATIEAQGSCSHHETVRQDAAHESEIKSVSSPKEESSIPSESVRPSGTQPPSSNPTTQESFFKSVNKRLQMLESNSTLSLLYIEEQSRILRDAFSKVEKRQLAKTSTFLENLNVTVLNELRQFREQYDQVWKSVALEFEHQRIQYHQEIHSISAQLGVLADELVFQKRVSVIQSIMILFCFALVLFSRVPLGTYIDIPRKKNFEQSAANHSANSEAEMQK

SEQ ID NO: 14670 - protein, 510 aa, Vibrio parahaemolyticus RIMD 2210633
MSAKKPLALVILDGYGYREDTASNAIANAKTPVMDALIANNPHTLISASGMDVGLPDGQMGNSEVGHTNIGAGRVVYQDLTRITKSIADGEFEQTPALVEAIDAAVKAEKAVHIMGLMSPGGVHSHEDHIYAAVEMAAARGAEKIYLHCFLDGRDTPPRSAENSLQRFQDLFAKLGKGRVASLVGRYYAMDRDNNWERVQVAYDLLTQAKAEFTAETAVAGLEAAYARDENDEFVKATAIKAEGQEDAIMQDGDAVIFMNYRADRARQITRAFVPGFDGFERAVFPAINFVMLTQYAADIPLATAFPPASLENTYGEWLSKQGQTQLRISETEKYAHVTFFFNGGVENEFEGEERQLVASPKVATYDLQPEMSSPELTEKLVAAIKSGKYDTIICNYPNADMVGHTGVYEAAEKAIEALDESVGKVVEAIKEVGGQLLITADHGNAEMMIDPETGGVHTAHTNLPVPLIYVGDKAVEFKEGGKLSDLAPTMLSLAGLEIPAEMSGDVLVK

SEQ ID NO: 14671 - protein, 594 aa, Methanocaldococcus jannaschii DSM 2661
MEIINKFLDLEALLSPTVYEKLKNFDEEKLKRLIQKIREFKKYNNAFILLDEKFLDIFLQKDLDEIINEYKDFDFIFYYTGEEEKEKPKEVKKEIKKETEEKIEKEKIEFVKKEEKEQFIKKSDEDVEEKLKQLISKEEKKEDFDAERAKRYEHITKIKESVNSRIKWIAKDIDAVIEIYEDSDVSGKSTCTGTIEDFVKYFRDRFERLKVFIERKAQRKGYPLKDIKKMKGQKDIFVVGIVSDVDSTRNGNLIVRIEDTEDEATLILPKEKIEAGKIPDDILLDEVIGAIGTVSKSGSSIYVDEIIRPALPPKEPKRIDEEIYMAFLSDIHVGSKEFLHKEFEKFIRFLNGDVDNELEEKVVSRLKYICIAGDLVDGVGVYPGQEEDLYEVDIIEQYREIAMYLDQIPEHISIIISPGNHDAVRPAEPQPKLPEKITKLFNRDNIYFVGNPCTLNIHGFDTLLYHGRSFDDLVGQIRAASYENPVTIMKELIKRRLLCPTYGGRCPIAPEHKDYLVIDRDIDILHTGHIHINGYGIYRGVVMVNSGTFQEQTDFQKRMGISPTPAIVPIINMAKVGEKGHYLEWDRGVLEVRY

SEQ ID NO: 14672 - protein, 459 aa, Listeria monocytogenes str. 4b F2365
MNQNPVEEGQKFPLTIRRMGINGEGIGYFKKAVVFVPGAITGEEVVVEAVKVRDRFTEAKLNKIRKKSPNRVTAPCPVYEACGGCQLQHVAYSAQLELKRDIVIQSIEKHTKIDPTKLKIRPTIGMEDPWRYRNKSQFQTRMVGSGQVETGLFGANSHQLVPIEDCIVQQPVTIKVTNFVRDLLEKYGVPIYDEKAGSGIVRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIENVYYEVGKAEDVLPKWVNEGFRPDAVIVDPPRSGCDQGLIKSLLDVEAKQLVYVSCNPSTLARDLALLAKKYRIRYMQPVDMFPQTAHVETVVLLQLKDK

SEQ ID NO: 14673 - protein, 273 aa, Nostoc sp. ATCC 53789
MLEDLQIAFIGGGTMGEMIMARLLSTKIVPKPDLIIVSDPVSARCLHLESEYGVSTTTCNIEAVVGASIVILAVKPQVLAEVLAILKGKISPDALVISIVSGASIPYLCEGLNHPAVVRTMPNIAVQVGHGTTVWSASSSVTEIQRSHTQVILQALGKEFPTQNEHYLDMATALSSAGTGFIFLYIEAMIDAGVQMGLTRTQAQELTLHTIAGSVELMFQTDEHASSLTKQGTSPGGVTAVGLYELEKGGMRTLISNAVLAALSRTQQLGTGV

SEQ ID NO: 14674 - protein, 447 aa, Arabidopsis thaliana
  misc_feature (393)..(393): Xaa can be any naturally occurring amino acid
  misc_feature (439)..(439): Xaa can be any naturally occurring amino acid
  unsure (1)..(447): unsure at all Xaa locations
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSVYNIPTGSSDYPTPGTENGVNIDVKARPSPYMLCSETAYLGGLQKLRLSTLLQPPPSPWTNPRLDVNVAYVDGRDEPERGNSNQQFTQDSFVPSSGKRKRDDSSAHYQNGGSIPQQDGASDAIPEANFECAALRITYVGDRKIPRDLIGSSSKIPQVDGPMPDPYDEMLSTPNIYSYQGPNEEFNEARTPAPNEIQTSTPVAVPNDIIEDDEELLNEDDDDDELDDLESGEDMNTQHLVLAQFDKVTRTKSRWKCSLKDGIMHINDKDILFNKATGXSSTSDLDTSNASRKVRVLQMSDTDLRVRDMIIYGNMYSGWLVVQKXEQTFPAEE

SEQ ID NO: 14675 - protein, 471 aa, Rubrobacter xylanophilus DSM 9941
MLGNLIRDKGRPGRRGYTLPRPDVEPVSPEEVVPERLLRRERPRLPEADEPTVVRHYTNLSRRNWGIDTSFYPLGSCTMKHNPRANEAAAAHPGFAGLHPLQPEEQVQGALQVMYELQGFLAEISGFPAVSLQPLAGAQGELTSILMIRDYFRDAGDTGRRVVLIPQTAHGTNPATAAMAGFEAREIGLDARGCVDVGELRRLADESTAALMITNPNTCGVFERNMEEIAGILHSVGAFLYMDGANMNANMGRMRPADAGVDIMHFNLHKTFSTPHGGGGPGSGAIACSERLAPFRPDPVVERRGEGYRFARPEKSIGRVAAFHGNFGPMLRAWNYIRMHGPELREVTDLAVLNANYVRARLKGTYRLPYEGPCKHEVVVQPPKGIRALDVAKGLIDHGFHPPTIYFPLVVKEAMLIEPTETESKETLDDFVGAMLELAEAKPEELEEAPTRAPTRRLDEARAARNLKARW

SEQ ID NO: 14676 - protein, 427 aa, Zea mays
PRVRSRVAPPDLDEFKTRAIAERGPGISSQPGNIIHRREPSGKLYNYAAASKGAKVLDFNKEAKGASNILDKDKDKYLRNPCSAEGKFVIIELSEETLVDTIAIANFEHYSSNPKEFELLSSLTYPTENWETLGRFTAANAKLAQNFTFLEPKWARYLKLNLVSHYGSEFYCTLSVLEVYGMDAVEKMLENLIPVENKKTEPDDKTKEPIEKIYLKDPAGGKEFSQETLDEDEFELEDDKPNGDSLKNGANDPVSEARTLQAGRIPGDTVLKVLMQKVQSLDVSFSVLERYLVELNSRYGQIFKDFDADIDSKDVLLEKIQSELKNLESSKDNIMNEVDGFLSWKLVASSQLNQLVLDNALLRLEFEIFRQKQTDMENRSLAVIFLSFVFACLALAKLSIGIMSRFCRFYNFEKFHNVRSGWLVLLL

SEQ ID NO: 14677 - protein, 352 aa, Pseudomonas aeruginosa UCBPP-PA14
MKALRWHAARDLRLSELERQAPRPGEVELEVAYCGICGSDLHEYQSGPHSIPQAEAHPLSGCRAPLTLGHEFCGVVAALGPGVEGLRIGDRVAVEPEYRCGECRYCREGRYNLCESMGFIGLMGDGGFAERARVPAYMLHRLPDAVGFRQAAVLEPAAVALHALRRSSLAPGQRCAVFGLGPIGLLLVMLARLRGIEDIAAVDVSPERLALAGEFGASRALDARDGDTAARLREGGALDCAFEAAGSQASLDAALASLRKGGELVLVSLMGEVRLDAFDLVNRELRLLGSVGYRDAYPELIALLADGRLDLARAVTRSVPLEQAVEHGFEALLRDKSQVKVLVNPNPALADA

SEQ ID NO: 14678 - protein, 429 aa, Rubrobacter xylanophilus DSM 9941
MARFTPHTEADIREMLDAIGVGSVDELFEDVSPRFEGELGLPPALSEYEALREVERLAARNRAGLPVFLGAGAYDRITPAAVGAIISRGEFMTSYTPYQPEVSQGHLQAIFEFQSVISELTGLEVANASVYDAASAVAEAALMTARLTKRDPKVALSAGLNPRYREVLETYGVEVAGLPFEGGATDFSGVPRDASGVIVQSPNFFGVVEDVGAAAEAAREVGALAVAVCDPIALAVLEPPGRLGADIAVGETQPLGVPLMFGGPYAGYMATRQRFVRQLPGRIAGETVDREGRLAYVLTLRAREQDIRRARANSNICTNQALTALAATIYTALLGPEGLREVAELSISKAHYLAGRLGEAGLRLRYPEAPFLWEFAVEMPDVKGANEALLEAGIVGGLDLGDGAMLVAVTEKRTKEELDAFVEVVANAG

SEQ ID NO: 14679 - protein, 843 aa, Candida glabrata CBS 138
MTYSFKCCDDGSGIASGSILRFDNVTILLDPGWSSYKVSYEDSVAFWSNIIAEVDIILISQPTTECLGAYTFLYYNFISHFISHIQVYATLPVANLGRVSTIEFYVTKGIIGPYQTNQLDIDDVEKAFDFIDVLKYSQLVDLRSKYDGLSLFAYNSGYAPGGAIWCITTYSEKLIYAPRWNHTRDTILNAANLLDNTGKPLSSLMRPSAIVTNFDHFGSSQPFRKRAKSFKDILKTKLSNNGNILIPVDIGGKFLDLFVLVHDFLYENGRNNKLANIPIVLLSYTKARSLTYAKSMTEWFSSISAKTWENRNQKTAFDLDTPFSVVDSNELANLKGPKICFVSNVETLVNDALSILGSDNNTLLVLTTDNRQEVPALHTIYDYWKENNTESSIESANVLKLNQKITINTTTFKELQNEELDAYLSKLEQRKRKQLITEITTRKGLKKGAAVALPTNLASDEGQKTEVDLVDDITNTEDLEKLLEEEEEDEDEDNEDNLINILEDEDRADGIEESIPVDIIITPGVNNKHKIFPFQPLRQKKDDYGIVVKFDQFVPAEDKDDITPSKRHINGDNEEDMDDDYVIKEASNKKIKSDSVNQPTKETKFSDDINHLRNSNRPGIREFKATEVNLNMSLTFINMESLVDRRSCGVIWPLFKSRKLILMGPSNVQDKHVTGIITSKTMEVTSLAYNQSIDFDTTIKALDITISPELDALLKWQRISNDYTLAHVTGRLVKESAHQSSAVPVTDNTTSSGREKYVLKPLNGNVGVQTNGSLAIGDVRLIKLKQNLNATNHTAEFKGEGILVVDDKVIIRKISDSETIIDGPPSALFYSVKKLVMDMLAKI

SEQ ID NO: 14680 - protein, 380 aa, Methanosarcina acetivorans C2A
MTSARLKRVEESATIRISNIATRMIKEGTDVINFSLGEPDFDTPKNICDAAAKAMYEGKTHYAPSAGIPELRAAIAEKLKTENHLEVTEKDVLVTPGAKQAIFEIMMGALDDGDRALLFDPAWVTYDACIRFSGANTVWVPTVPERGFLPDNFAEYINDKTKLIVVNSPGNPTGGVFGKKTLQCIADLAIDHDLLVVSDEIYEKIIYDREHISIGSFDGMQDRTITVNGFSKAYAMTGWRLGYLTAPPEIFKLLQKIQSHSVSSATTFVQYGGLEALQGPQDGVKAMVDRFKMRRDILIDGLNKIGIECKKPDGAFYAFANVSEYGNGTEVAERLLKEAHVAVTPGIAFGASGEDFIRISYATSIDRIREALERLEKIFA

SEQ ID NO: 14681 - protein, 568 aa, Ehrlichia chaffeensis str. Arkansas
MHDSKYLLDIITLLSAAIVIVVLFWKLNISPVLGYFVAGTLIGSNGLNLVESSVIIQNLGEFGVVFLLFLIGIELTFERLIAMRLHVFGFGTLQVIVTALAIWYISSQFGVDSKGSIIIGGALALSSTAIVLQVLQEKGYQSTQVGRLSIAVLLLQDFAVVPLIVLLPLLTGESHHSIPISLLYSFVKAAIALTLIFITGRLLLRPLFNTIAAMKSNEIFIATTLLIVLGAAFITENFNLSMALGAFVSGLLVAETEYRHDVEQVVLPFKRLLLGLFFMTVGMSIDIKFVLNKLPIITLASISLIALKSFIIFILCRFFRFQLAAAIQAGLLLSQGGEFAFILFGLAAEKNVLSSDLAQTLMMITTVTMAFTPLLATLGDWISKLITKKKISLNSQELILDTKDLDQHVIVVGFGRVGRMVAKVLVAEHVNYIASDIQPKIVKDGIDEGFPVYLGDLTKLNTLQSMAISRARMIIIAINNEVTIKKIISLVAKNFPHIIIIVRLPDLSNVEIYKELGAHYLIPETYEVGLQLGAVALSNNGFSNHAISLLKDRFRMVNYDAVKNKEDE

SEQ ID NO: 14682 - protein, 571 aa, Oryza sativa
  misc_feature (203)..(203): Xaa can be any naturally occurring amino acid
  unsure (1)..(571): unsure at all Xaa locations
MATAPPRVSCGSLLQELQVLWGQIGQNEAERDRMILQLEEDCLNVYRKKVEQTRKQKEDLIEELSFGELDIEKILSALGERESFSRVEKLGGTLLEQLAKVEPVLEDLRRRRDERVEEFMVVQAQIVRLHAEISGTIENGDPVPPLVDETNLSLRRLAEFKSQLKELQTEKNLRLQKIDVQINCIHEICNMMSLDLQKELYDXVHPSFVELGRTTSMSISDSTLERLAGKVHSLNQEKKQRLRKLQDLGSTLIELWNLMDTPTAEQKCFDHVTSLISVSPSTKMPQGCLARELIEKVEVEVKRLNCLKASKMKELVLKKMIELEEIYKSVHMDIDSDYEGRILNDLIDSGKADLSDLLTGMDGRITKAREHALSRKEILEKVEKWTLASEEESWLDEYEKDQNRYNAGRGAHKNLKHAEKARMLVSKIPSLLENLTAKIKAWEKENGVPFMYDKIRLLDSLEEYTSRRQQKDEEKRRSRELKKLQEQYAAEQGATFGTKPSPARPPSARKPLGQSSNANIISGTPTSRRVCTPMARKGGLSSGKVKEAGKTAFIPANYVALPKDCSDNSNL

SEQ ID NO: 14683 - protein, 454 aa, Burkholderia thailandensis E264
MKNLQRHLSARHIRFLALGSAIGTGLFYGSASAIRLAGPAVILAYIVGGAAVYMVMRALGEMAVREPVPGSFGHYASENLGPFAGFVTGWTYTLEMVIVAIADITAFGIYMGFWFPDVPQWIWVLAIVAIICGLNLCHVKVFGELEFWLSIVKVGAIVAMIGGGAAILFSGMKLGSGGAPALANLWSHGGFLPNGVGGLVASLSVVIFAYGGIEVIGMSAGEAKEPERVIPRAINAVPMRILLFYVLTMVVLMSIFPWTGVGANGSPFVQIFSALGVRSAAEILNLVVISAAISAINSDIFGAGRMMYGMALQGQAPRALASMSARGVPWVTVLVMAGALLVGVVLNYLMPKDVFLMVAAIATFATVWVWLMILLSQVAMRRRLSAAETAALKFKVPFWPIGPAITIAFMAFVIAMLGYFDDTRIALFVGAAWLALLTLVFYTRVRPRLAAVAR

SEQ ID NO: 14684 - protein, 299 aa, Methanosarcina mazei Go1
MDRIISVVGHTALDYIVDVENIAGKNESSPVIDYEEYPGGGAANIAVAIAKLGGKSQLISPVGTDFSSSGYEKLLKEAYVDLSRLYTIEDRKISKAFIFTDREDNQTTYFYWGASSKFKELEPEPVDFVHLATADCVYNAKIAQIAGFVSFDPGQDLVTYSKENLETILAHTDILFANKHEIKRVSEMTGKSFSELRDMIDVIVVTYDAEGSIIYRGGDQWSIPVVSVKALDPTGAGDAYRAGFLLAYTREYSLPTCGKIGSTVASFAVQSRGCQTSLPTWEEMKSRYEASFGNLGAEI

SEQ ID NO: 14685 - protein, 279 aa, Bacillus anthracis str. 'Ames Ancestor'
MKNLQSTTKLHNGVEMPWFGLGVFKVEEGPELVEAIKSAIKTGYRSIDTAAIYGNEAAVGEGIRAGIEATGISREELFITSKVWNADQGYKETIAAYEESLKKLQLDYLDLYLVHWPVEGKYKDTWRALETLYKEKRVRAIGVSNFQIHHLQDVIQDAEIKPMINQVEYHPRLTQKELQAFCKEQGIQMEAWSPLMQGQLLDNETLQAIAEKHGKTTAQVILRWDLQNGVITIPKSTKEHRIIANADVFNFELTKEDMEKIDALNENHRVGPDPDNFDF

SEQ ID NO: 14686 - protein, 458 aa, Geobacillus stearothermophilus
MSGPNDIDEAVQAAKEAQRQWALVPAPKRAEILYKVGMLLKERKEQLARLLTMEMGKVIEEARGEVQEGIDMAFYMAGEGRRLFGDTTPSELKDKFAMSVRTPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQEFERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 14687 - protein, 494 aa, Gibberella zeae PH-1
MAENYHKEVISGLKNKSLFIQDAFINGQWVAKENKFDVFEPSTATVLGQVANCALEDFQTAIKSADVAQTKYFDSTTGASRGAMLRKWYDLVLANQEDLAKILSLENGKTYSEALGEVIYSASFISWFAEEATRSYGVTIPSSAPHTTLMTIREPVGVCGIITPWNFPAAMITRKIAPALAAGCSVVIKPPSETPYSALAFTKLAIEAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGGGLDKTTTQGPLVNKSAIDKVKEHIADATSKGAKIATGGSTPDSPGFFHQPTVLTGVTQEMAVAKDETFGPLAPVFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 14688 - protein, 421 aa, Magnetospirillum magnetotacticum MS-1
MKRSRRTKIVATLGPASDTPEMIEKLFHAGVDVFRINMSHLAREKLPERIEVIRTIEREAKRPIGILVDLQGPKLRLGTFLGDAAHIENGQTFVLDSDPTPGNANRVYLPHPEILTALEPDHAVLIDDGKLRLVVTEVSEGRAVTRVEVGGRISNRKGVSLPHTVLPLPAMTDKDRGDLEAGLAAGADWIAVSFVQRPEDVAEVKKVAAGRAQVMAKIEKPQALSRLDEIIEISDGIMVARGDLGVEMPLEQVPGVQKRITRGARRLGKPVVVATQMLESMITSPVPTRAEVSDVATAVYEGADAVMLSAESAAGEFPVEAIATMNRIAEQVERDALYWSILMAQRSEPEPTASDAIAAAAHQIVDALGLRAIMAWTHSGSTVLRLARARPNASVIALTPKRETARRITMAWGVHPITQST

SEQ ID NO: 14689 - protein, 739 aa, Bdellovibrio bacteriovorus HD100
MQHLPAMIHDLALILGTAGLVTLLFKKLNQPIVLGYLVAGFLVGPKISIFPTVIGVASINLWAEIGVIFLLFALGLEFSFKKLLRVGGSASFTALFEVSLMILFGFTTGRLLGWSTMDSLFLGGILSISSTSIIIRTVEELGMKNMKFVGMVFGVLVIEDLVAVLLMVLLTTVALTRDFSGTEMLGAVLKLSFFLSIWFVAGIFLLPSFLKRTQKLLSEETVLVVAVGLCLMMVVFASNVGFSSALGAFITGSILAETIEGERIHHLIAPIKNLFSAVFFISVGMLIDPQVISIYWKEVLLLSAVVVVGKTLSVTLGSVLSGQTFKSSLQSGMSLAQIGEFSFIIATLGLSLKVISEKIYPIAVAVSVLTAFTTPYMARSAEKTYAWLEKILPARFIQSIDSYSVLSFSMSGNREWREQVRAYVLKVLLNAVVVVAVFLTMARVFLPFLLERQMEEGPAKFLTLSATLVMSAPFLWALAFGRTKQFEALLVEQGKGSHNYVFLVSRIMLAVGLLGAMVGQFVPLMWAVAITLWMVVVVGYVLSQKLQDIYGWFERRFLTNLNDDVKKVHARKNSRSLAPWDAHITEFLIPPEAPYVGVPLHQLSIREKYGVTVALIERGRRRITAPGRVECLMPHDHVFVIGTDEQLILFKGFIQSEVPEVALTEPEAEYSLEQYLLTEESPFLNKSIRECGLREITHGLVVGIEREGGRILNPDSSETLKRGDLLWIVGDREKILQLT

SEQ ID NO: 14690 - protein, 455 aa, Rubrobacter xylanophilus DSM 9941
MKTRHGQGILELEALRSAVQEGSIDTVLVAMTDMQGRLQGKRLTAEHFLEEVVEHGAEGCNYLLAVDVDMNTVGGYAMSSWERGYGDFVFKPDLSTLRVVPWLEGTALVVCDLAWEDGSPVAASPRQILRRQLERLAGLGLRAFVGTELEFIVFRDAYEDAWRKGYRDLEPANLYNVDYSLLGTTRVEPLLRRIRNSMAGAGLQVENAKGECNLGQHEINFRYDEALVTADGHSIYKNGAKEIASQEGCSITFMPKFNEREGNSCHIHLSLRTDDGEPVFSGGHGFSKTFEHFLAGQLACIRELMLFLAPNINSYKRYAPGSFAPTAIAWGKDNRTCAFRVVGHGPSLRVECRIPGGDVNPYLGISAMIAAGLYGLENELPLEEEFVGNAYGAQDKPHVPRNLYEARELFANSEVARRAFGEEVVEHYLNMARVEIEAFESAVTDWERYRNFERL

SEQ ID NO: 14691 - protein, 123 aa, Triticum aestivum
MAEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVES

SEQ ID NO: 14692 - protein, 388 aa, Oryza sativa
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGRDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPAIMFLSGGQSEVEATQNLNAMNQGPNPWHVSFSYARALQNTCLKTWGGQPENVKAAQDRLLLRAKANSLAQLGKYTSDGEAAEAKEGMFVKNYVY

SEQ ID NO: 14693 - protein, 358 aa, Oryza sativa
MSAYCGKYKDELIKNAAYIGTPGKGILAADESTGTIGKRFASINVENVEDNRRAFRELLFCTPGALQYISGVILFDETLYQKTKDGKPFVDILKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 14694 - protein, 899 aa, Candida glabrata CBS 138
MSPTSSSTTNDMITEEPSNHRQVPRLTRRLTGFLPQEIKSIDATIPLKSRALWNKHQVKKFEKPDDFQDRFIDHVETTLGRSLYNCDELAAYEATSMSIRDNMIIDWNKTQQKLTTRDPKRVYYLSLEFLMGRALDNALINMDNGEDKANEQPRKVIKGALDELGFKLEDVLDQEPDAGLGNGGLGRLAACFVDSMATENIPAWGYGLRYQYGIFAQKIINGYQVETPDYWLNFGNAWEIERNEVQIPVTFYGYVDRDGKDTTTLSPSQWIGGERVLAVAYDFPVPGFKTSTVNNLRLWQARPTTEFDFAKFNNGDYKNSVGEQQRAESITAVLYPNDNFAQGKELRLKQQYFWCAASLHDILRRFKKSKRPWSEFPDQVAIQLNDTHPTLAVVELQRVLVDLEKLDWHEAWDIVTKTFSYTNHTVMQEALEKWPVGLFGHLLPRHLEIIYDINWFFLQDVAKKFPKDVDLLSRISIIEESSNERHIRMAYLAIVGSHKVNGVAELHSELIKTTIFKDFVKFFGPSKFTNVTNGITPRRWLKQANPKLAELISEILKDPSEDYLLDMAKLTELNKYAEDPEFQQKWNEIKQYNKLRLADLIKRENDGVDLIDRAHISDTLFDIQVKRIHEYKRQQLNVFGVVHRYLAIKEMLRNGASLAEVEKRYPRKVSIFGGKSAPGYYMAKLIIKLINSVGDVINNDKEIGDLLKIIFIAEYNVSKAEIIIPASDLSEHISTAGTEASGTSNMKFVMNGGLIIGTVDGANVEITREIGEDNIFLFGNLAENVEDLRYNHQYNGHEIPESLSKVLEYIESGELTPENPNEFKPLVDSIKQHGDYYLVSDDFESYLTTQDLVDEVFHSQKKEWIKKSILSVANCGFFSSDRCIEEYADTIWNAEPVKP

SEQ ID NO: 14695 - protein, 222 aa, Zea mays
IQRTSGEYLARNGVRIYACSETVKFGHVTFFWNGNRSGYFDQNLEKYEEIPSDAGIPFNVQPKMKALEIAQKARDAILSQKFDQVRVNIANGDMVGHTGDIEATIVGCKAADEAVKIILDAVEQVGGVFVVTADHGNAEDMAKRDKSGEPLRDKDGKVQTLTSHTLNPVPIAIGGPGLAPGVRFRTDLASAGLANVAATVMNLHGFQAPDHYEPTLIQVVDE

SEQ ID NO: 14696 - protein, 361 aa, Zea mays
MSAFVGKYTDELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNVEGLARYALICQENGLVPIVEPEILTDGGHDIGTCAAATERVLAALYKSLSDHKVLLEATLLKTNMVTPGSDSPKVSAEVIAEYTVAALRRTVPPAVPGVVFLSGGQSEEEATQNLDAMNKLEVLKPWTLSFSFGRALQQSTLKKWVGKKENVAAAQATFVIRCKANSEAALGKYAGSGAGDAAASESLYVKGYKY

SEQ ID NO: 14697 - protein, 91 aa, Methylobacillus flagellatus KT
MSQITIEHNPSEEKLKELGVANWSIWEKEVSKFPLDFGIKETAYILEGEILVTPKGGEPVRIVPGDLVVFPVGLQSNWEVVKPLRKHYKHG

SEQ ID NO: 14698 - protein, 771 aa, Candida glabrata CBS 138
MDVKERSNQFRFFSLGGGNEVGRSCHIIQFKGKTIMLDAGIHPAYQGMASLPFYDDFDLSIVDVLLISHFHLDHAASLPYVMQKTNFKGRVFMTHPTKAIYRWLLRDFVRVTSIGSQSSNAEDDNLYSNEDLIESFDKIETIDYHSMIDVNGIKFTAFHAGHVLGAAMFQIEIAGLRVLFTGDYSREIDRHLNSAEVPPLPSDILIVESTFGTATHEPRLHREKKLTQLIHSTVNKGGRVLMPVFALGRAQELMLILDEYWSQHKEELGSNQIPIFYASNLARKCLSVFQTYVNMMNDNIRKKFRDSQTNPFIFKNIAYIKNLDEFQDFGPSVMLASPGMLQNGLSRDLLERWCPDEKNLVLITGYSVEGTMAKYLLLEPDTIPSVSNPEVTIPRRCRVEELSFAAHVDFQENLEFIEQINASNIILVHGEPNPMGRLKSALLSNYASFKGTEDEVHVHNPRNCYELDIECKGVKVAKAVGNIVDEIKRTEEEVVKPENDAGQSKEGIEEFTGKTQDVRKDAEGEGAIISSILVSDEKNFDLNLVSLSDLREHHPELSTTVIRERQTIQVDCKKELIYWHICQMFGDVSVLIDDDNVTNTKETKLETSRGMLVLQIMGAIRLTVQHNKAILEWTQGLISDTIADSIIAILMSVDSAPVSVKKSSNSCSHGHEHATPILSQPSETDKIKQVAELFKTQFGDSFTLILNKDDDNDTAEEKEDDEFVKGLITIGKNTASINFTDMCVVECNSNPLKGRVESLLKIGIDMVSSLC

SEQ ID NO: 14699 - protein, 148 aa, Arabidopsis thaliana
MEKKREGVIEGMSRIVSDPYYFLHFMAFFSYLPIRSSAAPYTSHRLFDREIQAFLAFLMFSAIKMVREETWEAFVADSLLYAKIFLIAVSLIMDYRVAVWIRIIFSGIYLLAQQPAFSKLGTAKKLTPMQLEDLLSEGNTTKYWLIDS

SEQ ID NO: 14700 - protein, 247 aa, Methanosarcina mazei Go1
MSENMAYECLKYSNENINRALEALRAGKMIQIYDSDSREGETDLVIPAKAVTYTDVKWMRKDAGGLICVAVDPVASKQLKLPFMADLVREASKTSDSLGEVVEKDGDLKYDAHSSFSLWVNHRDTRTGIPDIERALTIRKIGEITEESLSGNGVRFGNEFRTPGHVALLRAAEGLLDERMGQTELSVALARMAGITPAMVVCEMLDDDSGKALSKEKSKEYGKEHGLVFLEGREIVEAYLLWAGTDC

SEQ ID NO: 14701 - protein, 393 aa, Pseudomonas fluorescens Pf-5
MRYSPFVQRISGESVSAWDIHYAAIEARGRGEDVIVLSVGDPDFATDERISAAASAALEQGDTHYTHVLGRPALREAIAAKQRRLLGIEVSADNVALVAGAQNGLFATSLCLFSSGDEVLVPEPMYLTYEACIHASGAQIACVQQPAANGFRLTAAALEAALTDKTRGIALATPCNPTGNVYSREELEAVAEVARKHDLWVISDEVYGQLTYDREHLSIASLPGMAERTVILNSLSKTHAMTGWRVGWVIAPPALVGHLDNLLLCMLYGLPGFIQEAALKALELDEEVIGSAREVYRRRRDLVVAGLKQVQLLDCREPEAGMFMLVDVRRTGLSSMDFAWQLFRATGVSVLDAQAFGASAEGFVRISFTVADEVLKDACQRIAGFVETLGAQR

SEQ ID NO: 14702 - protein, 338 aa, Burkholderia thailandensis E264
MSITRRTTLSKYLIEQQRETHNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPDGQQATEQSFLQPGTEQVAAGYAVYGPQTVFVLTTGNGVNCFTLDREVGSWVLTQSNLRIPEDTREYAINASNARHWYDPVKRYVDELNAGAEGPRGENFNMRWIASMVADVHRILNRGGIFMYPADKRTPDRPGKLRLMYEANPMSFIVEQAGGAATTGLKRILDVQPTGLHQRVPVILGSKNEVERVARYHQEAQS

SEQ ID NO: 14703 - protein, 214 aa, Lycopersicon chilense
MVKPQLTAALLIVLFALSPAYGDFDSLQLVLTWPASFCDSNNCKRIAPKNFTIHGLWPDKEGTVLQQCKPKPNYVNFKDKMLNDLDKNWIQLKFDEDYGRDKQPLWVYQYLKHGSCCQKMYNQNTYFSLALRLKDRFDLLRTLEMHKIFPGSSYTFQEIFDAVKTATQMDPDLKCTKGAPELYEIGICFTKKADALIPCRPSNTCDRTGNIFFR

SEQ ID NO: 14704 - protein, 399 aa, Methanosarcina mazei Go1
MEKAEFRVSRIQSKQNSEDIIYGTLGGHNLKEIKFSENVSRIDTSGIRKIFEAAGSNAINLGLGQPDFDTPDHIKAAAIKAINEGFTGYTAGPGIPELREALSQKFKEENCFSVSPQEIIVTSGASEALTIALTALLNRGDEVLISNPGFVSYNALTEMLYGKVVNVPLGEDLTMKPEDVLERITPKTKAIILNSPSNPTGAVSSRADIKALAEIADDHRITIISDEVYEYFIYEGEHVSPASYSDNVVTVNATSKSYAMTGWRLGYLAARNEYISQMLKVHQYIQACANSIAQKAAYAAVTGPKDSVSAMREEFRKRRDVLVKGLNDLGMECALPKGAFYAFPRVSNSAEVASKMISNGVVVVPGTAFGSEGDGYIRISYAASMKDIEKSLSIMEKVL

SEQ ID NO: 14705 - protein, 546 aa, Oceanicola granulosus HTCC2516
MIDLWYKNAVVYCLDVETFMDADGDGVGDFRGLADRLDHLEGLGVTTVWLNPFYPTPNRDNGYDVTDFYGIDPRLGSAGDFVVFLRAARDRGMRVLVDLVANHTSIDHPWFRSARASTDSPYRDWYVWSEEEPEDLTEGIIFPGVQEAVWTWDETAQAWYLHRFYAHQADLNIANPAVREEILRIMGYWLELGVSGFRVDAVPFLVEYKGLKEEPDREPLLLLSEMRDFLSWRRAEAILLAEANVERDRAPLYFGGRAFGEDERMQLLFDFPLNQALWLAFVRHDPAPVVAALRSRPEEDGLQAQWAVFLRNHDELSLDKLGEAEREEVFAACAPDEGMRLYDRGIRRRLAPMLGGDARRVALAQSLLFALPGTPVMWYGDEIGMGEDLDLPERDPVRTPMQWSDEPHGGFSDAAETVRPAVAEGPLGYHETNVTAQEGRPASLLGQVQALVRARRACPAIGWGSWRVIEGLPEGVLGLACAWRGSEVVTLHNFTDRDVQVPLSELGTEPLAQIVGPPDTEPGPVDGHLALRPYDYRWLRAGRTRK

SEQ ID NO: 14706 - protein, 134 aa, Lycopersicon chilense
IHGVWPDSEAGELNFRNPRASYTIVRHGTFEKRNKHWPDLMRSKDNSVDNQEFWKHEYIKHGSCCTDLFDETQYFDLALVLKDRFDLLTTFRIHGIVPRSSHTVDKIKKTIRSVTGVLPNLSCTKNMELQEVGI

SEQ ID NO: 14707 - protein, 135 aa, Lycopersicon chilense
IHGVWPDKEGTLLQYCKPKPKFRLIKDQLLDDLDKNRIQLKYPQTHARNKQPLWEHEYLKHGTCCQKVYDQNTYFRLALRLKDRFDLLRTLQIHRIVPGSSYTFKEIFDAVKTVTQTHPDIKCTKGALELTEIGI

SEQ ID NO: 14708 - protein, 400 aa, Prototheca wickerhamii
MALEKIITAPKYKNFTINFGPQHPAAHGVLRLVLEMNGEVVQRSDPHIGLLHRGTEKLIEYKNYLQALPYFDRLDYVSMMCQEHAYSLAVEKLLNISKDIPLRAQYIRVLFSEITRILNHLLAVTCHAMDVGALTPFLWGFEEREKLMEFYERVSGARMHAAYIRPGGVALDLPLGLCEDIYKFSKQFASRIDEIEEMLTSNRIWKQRLVDVGVVSAEQALDWSFSGVLLRGSGIAWDLRKTQPYEVYDRMKFNIPVGTRGDCYDRYLIRVQEMRESLRIVMQTINEMSKGIIRLDDRKITPPTRDQMKQSMESLIHHFKFYTGGFVVPAGETYTAVEAPKGEFGVYLVSNGTSKPYRCKIRAPGFAHLQGLDFMARNHMLADVVTIIGTQDIVFGEVDR

SEQ ID NO: 14709 - protein, 138 aa, Lycopersicon chilense
IHGAWPDNVSTELNYCGRKKDNYRIITDDRETNDLYDRWPDLTIEKDICLDKQNFWRYEYNKHGTCCEATYNQEQYFHLAVALKDKFDLLKSLGNHGIIPGSKYTVQKINNTIKTVTQGYPNLSCTRGKLMELQEIGI

SEQ ID NO: 14710 - protein, 274 aa, delta proteobacterium MLMS-1
MSKEAYKLAFIGGGQMAGALLKGILAADLYRAGEIVVAEPEAARRELLAREFGVAVVAGAADFPAACPVVVLAVKPQVLGKVLESYRGRLAGERLLISIAAGISLAFIEECLAPEPVRVIRVMPNTPALVQAGASALAPGSRADADDLEVGRRLFAAVGSVVILEERQLDAVTGLSGSGPAYVFTFFEALVEAGVKVGLSREVATELARQTISGSMQLAAADQQQNPAALRAMVTSPGGTTIAGLHVLERGGFRGLLMDAVETATRRSVELGRG

SEQ ID NO: 14711 - protein, 139 aa, Lycopersicon hirsutum
IHGVWPDNKSTMLNNCDFDGEYDDITEPHKLKELEDQWPDLTSMDGDIKKHQDFWGYEFTKHGSCSIDLYNQEAYFDLALKLKNMFDLLKILKNHGIIPGKIYTVKNVEDAIKAVSTKAPNLNCIGRYTQTMELPEIGI

SEQ ID NO: 14712 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVSFIAFKPPGCEESGKA

SEQ ID NO: 14713 - protein, 328 aa, Saccharophagus degradans 2-40
MPTYQIYGLGAALVDTEIEVTDLDLKDLRIDKGVMTLVDEARQAQLIRTLSKHVAASKRASGGSAANSIIAASYFGAKTFYSCRVANDENGKFYLNDLAEAGVSYYEKNGEPSGTTGKCLVFITPDAERTMNTFLGISETLSVDDIDEQALAESEWAYIEGYLVTSATGRPAAIKLRELAEAKGVKTALSLSDPAIVNFFKDGLVEMIGDGVDMLFCNEAEALQYTGCDTVETAAEALKQCAKAFAITQGAKGALLFDGEQFITVAAHKVTPVDTNGAGDMFAGAFLYGLTNNMSFQQAGDLASKAASVVVSQFGPRLRPEQHKELLG

SEQ ID NO: 14714 - protein, 557 aa, Bdellovibrio bacteriovorus HD100
MSEVQKNWWKEAVVYQVYPRSFKDSNGDGMGDLQGLISKLDYLKELGINVIWICPMYKSPQDDNGYDISDYQDIHHEFGTMKDFDQLLQQVHARGMKLIIDLVVNHTSDEHPWFIESRSSRNNPKRDWYIWRDGKNGKEPNNWESIFSGSAWKYDELTQQYFMHIFSSKQPDLNWENLDMRKAVYDMINWWLDKGIDGFRVDAISHARKEPGLADMPNPNNLEYVPSYDKHMNVNGIQEYLKDLCTNTFNKYDIMTVAEANGVSAENAEEWVGREQKKFNMIIQFEHVGLWDANPERRVDLAKLKSVLGRWQKGLEGRGWNALFVENHDVPRITSKWGDIQNFWRESTTSIATMYFMMQGTPFIYQGQEIGMTNTVFNGPEDFNDVSAKNIFTIRRKQGATDAEITADLASASRDNARTPMQWDSSEQGGFTTGRPWLKVNPNYKNINVAAQDKDPTSVLNFYRNLIRLRKAHSVFIYGVYDEVLSKHDQIYAYTRTDGNEKMLVMANMTGKPAKFDLPGFSLSSANLLMANYAVADHSSITGGELRPFESRIYKIN

SEQ ID NO: 14715 - protein, 243 aa, Gloeobacter violaceus PCC 7421
MGATFGGTFMDKKLAVVTGGNRGIGFEVSRQLANFGHRVILTSRDPEQGKTAAEKLQSEGLDVLFHPLDVTDPASAEALAGFVRERFGRLDILVNNAGILQDGGADAARLLDADLDMLRTTFETNTLGPVLVAHALVPLMQGRGRVVNVSSGAGQLADMGSGYPAYRVSKTALNAVTRILANELADTKILVNALCPGWVKTDMGGPGAARTPEQGADTVVWLATLPDNGPTGGFFRDRKPIPW

SEQ ID NO: 14716 - protein, 489 aa, Burkholderia mallei ATCC 23344
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLAEAKGEIGYAASFLEWFAEEGKRVYGDTIPTPAADKRIVVTKEPVGVCAAITPWNFPAAMITRKVGPALAAGCPIVVKPAEATPFSALAMAVLAERAGVPAGMFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGPGTEAGVVQGPLINGAAVRKVEAHIADALDKGARVTTGGQRHPLGHGFFEPTVLTGVTPDMKVAKEETFGPLAPLFRFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 14717 - protein, 268 aa, Lactobacillus sakei subsp. sakei 23K
MKIGFIGVGNMAQAIIKGLVKADQIATTDILVHGAHPANYEAFAAEQHITPVADNIAVVAQADIVFLAVKPYIVPLILEETGAAFKEKQPLMVSMAAGLSLAKLSQQVDADNLPILRIMPNVNVANRAGITAVVGNAQVSADQLKSVKDVLSQLGGVVEIGEKDFTTFSALAGSSPAFVYLFIDSMARAGVKHGLTKKAATEIAAQAVLGSAQNVLLSDDSPWDLIDKVSSPGGTTVVGLLAMEEAGLMSAVVKGIDATIEKDLESQK

SEQ ID NO: 14718 - protein, 478 aa, Agrobacterium tumefaciens str. C58
MHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 14719 - protein, 622 aa, Magnaporthe grisea 70-15
MGCIPLDLQTDASNRLYGKLPWWKDAVFYQVYPASFVDSNGDGWGDIPGLVTKLDYLANLGVDCVWLSPVFDSPQADMGYDVSDYQSIYAPYGTVADVDALLAGCHARGMKLILDLVVNHTSVEHSWFKEGRSSRASSKRDWYIWRPARYDPITGGRLPPTNWRGYFAGSTWTWDEQTQEYYLHLYAPEQPDLNWDNEDCRMAIYKDTMNFWLDRGVDGFRIDTVNKYSKRDYVDVPVTDPSSYTQPAPDMWCNGPCIHEYIREMAAETLHRYPGAVSVGELSNMTKGPSQVLEYVSASRSELDMVFEFSAIRLGTGDGFGAKYIYTPFPLSHLKRITETWQAFIEGTDGWTTAFVENHDNGRAVSRFGDDRSPEAWRASARCIALWQATLTGTLFLYQGQEIGMTNMPENWDIDEYKDVESQGFYKEAVGSGDVDSIKKTMHGLRILARDHSRLPMRWDGGAPNAGFGQSTDGCKPWMRVVQDAECRGGGAEVSVAAQTGRKESVLEFYRLVLALRKKHRELMVHGSFRLLDPEDEYIFAYVKEASQGVNAKENDRTVKKCVVVLNFSGEAQECVDVAAAMGCGLTDVRLLVDTIVGEPEDGRVISIPALGAWEGRVYVNF

SEQ ID NO: 14720 - protein, 323 aa, Oryza sativa (japonica cultivar-group)
MAVVVPEAVLRHGDARPMPAVGMGVAEYPSTPERTRDAVLAALEAGFRHFDTASLYRTEAPLGEAIAEATRRGLLASREEAFVTTKLWCTQCHPDLVLPSLRESLRNLQMEYVDLYLIHLPISVKPGPMVFPVKKEDVVPFDFGGVWRAMEECHRLGLAKAIGVSNFTTKHIDKLLAVATILPAVNQVEMNPTWQQRTVREYCDAKGIRVTAYSPLGGQNWGGSANYVMESSVLTEIARARGKSIAQVSLRWIYEQGVTPIAKSYRKERLKENLEIFDWELTDEDRLKISQIPQRKRVTAASLFSPDGEFTSVDLPDIEIVEE

SEQ ID NO: 14721 - protein, 269 aa, Ehrlichia chaffeensis str. Arkansas
MNILLIGCGNLGSILLNKWSHSDQISKVTVVQPSLSKKDTFNNITKVVFVKSHEEVDKDFIPQIVVIAIKPQLVSDVMPNYRIYSESASFISLCAGIDINFLKTCLSPTATIIRVMPNIAMSLGKSVNLSYIEEELPHEKQKVSTIFNNTGLIYWIQKEDIFDKLSPITGSGPAYFFSLAEELVKNTIAAGINEEDAIKLVSQTFIGSAKLLETRQNTISHLISSITSRGGITQAALQVLNLHLPQTISSCLKAAMERLLYLKGLDKNK

SEQ ID NO: 14722 - protein, 131 aa, Eremothecium gossypii
MSGKGGKAGSAAKASQSRSAKAGLTFPVGRVHRLLRKGNYAQRIGSGAPVYMTAVLEYLAAEILELAGNAARDNKKTRIIPRHLQLAIRNDDELNKLLGNVTIAQGGVLPNIHANLLPKKSAKATKASQEL

SEQ ID NO: 14723 - protein, 381 aa, Novosphingobium aromaticivorans DSM 12444
MTPAEISPIEDIIREAVEGRPFILVDADDRENEGDIIIPAQFATPAQISFMACHARGLICLAITQERSSQLQLRPMAPRNESGYGTAFTVSIEAKEGVTTGISAHDRARTIAVAVDPTKGVDDLVTPGHVFPLTARDGGVLVRAGHTEAAVDISRLGGLTPAGVICEVMNDDGTMARLPDLKIFAAKHGLKIGTIADLIAYRRSSEQLVEEMASAPFQSHFCPSPMTVHVYRNKIDGGEHVALVKGEIRADQDTLVRVHQVDLTTDVLGWNTASPEYLRRALRFISDHSGPGVVVLVRDPDPESISRRVAGGRREYHEKNANRDYGIGAQILIDLGVRQMTLLTSSKAKLAALQGFGLTINGRTELRENRPDSPIRVRSDF

SEQ ID NO: 14724 - protein, 404 aa, Sinorhizobium meliloti 1021
MTEVTELMRPEGEALNTKEVLLNLGPQHPSTHGVLRLVLQLDGEYVERVDPHIGYLHRGTEKLAESFTYTQIFPLTDRLDYLCPPSNNLAFALAVEKLLGIEAPIRAQYIRVMMAELARISGHLLITGALPMDLGAMTALLYAMREREMIMDLLEMITGARMHTSYCRVGGVREDLPDGFLPKIREFCEIFPNRIRDYERLIENNRVFLSRTQGVGVISATDAIDLGLSGPNLRASGVDWDIRRDEPYEIYDRLDFDVITREEGDCYSRWLCRVDEMRESIRLIEQCMEQMPEGPFQVDIPTIAFPVDKERVHCSMEALIQHFDLSAYGFDVPAGEVYSVIEAPKGELGFYIISDGSPKPFRMKVRAPSFVNLQALFGVTNARYLADMIAVLGSLDPVMAEVDK

SEQ ID NO: 14725 - protein, 471 aa, Burkholderia vietnamiensis G4
MSKTVADVMQLVKDEDVKFVDFRFTDTRGKEQHVSVPVSAFDEDKFESGHAFDGSSIAGWKGIEASDMLLMPDPTAAFIDPFYEESTLVMTCDVVEPADGKGYERDPRSLAKRGEAYLKSTGLGDTAYFGPEPEFFIFDSVQWNTDMSGCFVKINSEEAPWSAGKEFEGGNTGHRPGTKGGYFPVAPVDTFQDMRSEMCLLLEQLGIPVEVHHHEVAGQGQNEIGTKFSTLVQRADWTQWSKYIIHNVAHSYGKTATFMPKPVVGDNGSGMHVHQSIWKDGQNLFAGNGYAGLSEFALFYIGGIIKHARALNAITNPTTNSYKRLVPHFEAPVKLAYSARNRSASIRIPHVSNPKGRRIETRFPDPMANPYLCFTALMMAGLDGVQNKIHPGEAADKNLYDLPPEEDAKIPTVCAGLDQALEALDKDREFLTRGGVFTDGMIDAYLALKEQELAKFRMTTHPIEFEMYYSL

SEQ ID NO: 14726 - protein, 471 aa, Frankia sp. CcI3
MPRRAKIVCTLGPATSSPEKVRALVDAGMDIARLNFSHGTHEQHAVTYARVREAAEAAGRSVGTLADLQGPKIRLGNFADGGVTLLPGQRFTVTIRDVPGDQHQVGTTYPGLPGDVAAGDRVLVDDGRLVLQIDGVTDTDVHTTVVVGGPVSDHKGMNIPNAALTVPALTEKDAADLRFALNLGVDMVALSFVRSAVDAAAVHAIMDEVGIRVPVHAKIEKPQAVAELDEIIEAFDGLMIARGDLGVELPLEDVPLVQKRAVSQARERAKPVIVATQVLESMVSAPRPTRAEASDCANAVLDGADAIMLSAETSVGAYPIEATATMARIIETAEADLGRIPPLRTEPRTLGGALAQAAASVGAAVGARYLVAHTLSGDTARRLARYRTEVPVLAFTPIPAVRNQMALFWGVETFLVPFADSTDEMVRQVDSALFHIGRCKPGELVVVVAGTPPGVAGMTNMMRVHRIGEAI

SEQ ID NO: 14727 - protein, 445 aa, Burkholderia vietnamiensis G4
MQSELSEFLRQHRITEVEAIIPDMAGIARGKIIPRNKFESGESMRLPQAVMVQTVTGDYPEDGSLTGVTDPDMVCVPDPSTICLIPWAVDPTAQVIHDCVHFDGSPVEISPRYVLRRVLDLYEAKGWKPVVAPELEFYLVDMNADPDLPLRPPVGRTGRAETGRQSYSIEAVNEFDPLFEDIYEYCEMQGLDIETLIHEVGAAQMEINFMHGDALSLADQVFLFKRTVREAALRHNMYATFMAKPMEDEPGSAMHIHQSLADARTGRNLFADEGGDVSPMFQSYLAGLQKYTPALMPIFAPYINSYRRLSRFMAAPINVQWGYDNRTVGFRIPQSAPAARRIENRIPGVDCNPYLAFAATLAAGYLGLTQQLAPTEPIASDGYDLPYQLPRNLEEGISLMAACTPLAGILGDKFVKAYLALKETEYEAFFRVISSWERRHLLLHV

SEQ ID NO: 14728 - protein, 214 aa, Lycopersicon parviflorum
MVKPQLTAALFIVLFAISPAYGDFDSLQLVLTWPASFCHMNDCVRIAPKNFTIHGLWPDKEGTVLQNCKPKPNYSNFKEKMFNDLDKHWIQLKYDEDYGEKEQPLWFYQYLKHGSCCQKMYNQNTYFSLALRLKDKFDLLRTLQTHKIFPGSSYTFKEIFDAVKTATQMDPDLKCTKGAPELYEIGICFTPKADALIPCRQSNTCARTGKIFFR

SEQ ID NO: 14729 - protein, 423 aa, Saccharophagus degradans 2-40
MSQAFENAQQYIPGGVNSPVRAFKAVGGEPVFIKRAKGAYLYDINDKRYVDYVLSWGPMILGHADDDVLAAVTEKLQYGLSFGAPTEIETELAKKICNIMPGMDKVRFVSSGTEATMSAIRLARGYTGRDKIIKFEGCYHGHSDSLLIKAGSGALTFGVPSSPGVPACLAEHTVTLTYNNIEQVKQAFAEIGDQIACVIVEPVAGNMNCIPPIAGFLETLREECTKAGSLLILDEVMTGFRLGITGAQGYYGVQPDITTLGKVMGGGMPVGAFGGSKEVMDYIAPTGPVYQAGTLSGNPVAMAAGLATVQKLENPDFYAPLFAKTKTLCEGIQTLAKEAGIPLTGNYVGTMWGLFFTEEEKVTNYQQVMACDIPRFNKFFHGLLEEGVYIAPASYEAGFLSAAHTDADIDFTLQAAKNVFARI

SEQ ID NO: 14730 - protein, 323 aa, Oryza sativa (japonica cultivar-group)
MAAVPEVALRHGAGRPMPAVGVGTADSAATSPETKRGAALAALEVGFRHFDTAALYGTEAPLGEAIAEATRRGLVASREEVFVTTKLWCTQCHPGLVLPSLRESLRNLQMEYVDLYLVHWPISVKPGPPMLPVKREDAVPFDFEGVWRAMEECHRLGLAKAIGVSNFTTKHLDKLLAVATIPPAVNQVEMNPVWQQRTVREYCAAKGIRVAAYSPLGGQNWIGEGNDVMESPVLADIARARGKSIAQVSLRWIHEQGVTPIPKSYNKERLKQNLEIFDWELTKEDRLKISQIPQKKIVTAARMFSPDGEFASVDLSDMEIVEE

SEQ ID NO: 14731 - protein, 403 aa, Silicibacter sp. TM1040
MDGSKFDDAQTGEQKIRNFNINFGPQHPAAHGVLRLVLELDGEIVERCDPHIGLLHRGTEKLMESRTYLQNLPYFDRLDYVAPMNQEHAWCLAIEKLTGVEVPRRAQLIRVLYSEIGRILNHLLNITTQAMDVGALTPPLWGFEEREKLMIFYERACGARLHAAYFRPGGVHQDLPDELLDDIDLWAMEFPKVMDDIDGLLTENRIFKQRNCDIGVVTEDDIQKYGFSGVMVRGSGLAWDLRRAQPYECYDEFDFQIPVGKNGDCYDRYLVRMEEMRQSLSIIRQAIAKLREATGDVLARGKLTPPKRGDMKTSMESLIHHFKLYTEGFHVPEGEVYAAVEAPKGEFGVYLVADGSNKPYRAKLRAPGFLHLQAMDYVAKGHQLADVAAIIGTMDIVFGEIDR

SEQ ID NO: 14732 - protein, 107 aa, Arabidopsis lyrata subsp. lyrata
MFEIIQAVFAAGAALALLTFSAITLGGSVVAFAISTPLFVVFSPVLVPATIATTLLASGFTASGSFGATAFSILAWIYKRRTGRDLPKIPGLTPPAAPASNPAGSGV

SEQ ID NO: 14733 - protein, 640 aa, Saccharomyces cerevisiae
MPPKEAPKKWKAPKGPKPTHRKNKNKLELGRAIKYARQKENAIEYLPDGEMRFTTDKHEANWVKLRSVTQESALDEFLSTAALADKDFTADRHSNVKIIRMDSGNDSATSQGFSMTNEQRGNLNAKQRALAKDLIVPRRPEWNEGMSKFQLDRQEKEAFLEWRRKLAHLQESNEDLLLTPFERNIEVWKQLWRVVERSDLVVQIVDARNPLLFRSVDLERYVKESDDRKANLLLVNKADLLTKKQRIAWAKYFISKNISFTFYSALRANQLLEKQKEMGEDYREQDFEEADKEGFDADEKVMEKVKILSIDQLEELFLSKAPNEPLLPPLPGQPPLINIGLVGYPNVGKSSTINSLVGAKKVSVSSTPGKTKHFQTIKLSDSVMLCDCPGLVFPNFAYNKGELVCNGVLPIDQLRDYIGPAGLVAERIPKYYIEAIYGIHIQTKSRDEGGNGDIPTAQELLVAYARARGYMTQGYGSADEPRASRYILKDYVNGKLLYVNPPPHLEDDTPYTREECEEFNKDLYVFDRLPDTRKEQVQNAAKAKGIDIVDLARDLNQLTFSAHTGGDTQKEAKSVTHGGKQAALYNAAEDLDRDFFKMNNVEGRLSTPFHKVQNSSAGKRHNKKNKSKNAKSKVFSIENN

SEQ ID NO: 14734 - protein, 238 aa, Magnetospirillum magnetotacticum MS-1
MRFEVAPASEGPATARCFILVTPDGERTMNTYLGACQALSPDDVDEATVRAARVTYLEGYLWDPPAAKDAFRKAVKIAHSAGNAVALTLSDAFCVGRYREEFLELIRNGSIDIMFANIGELQSLYQTDDPEAAIAALRDERDAQGKHMLGLVTRSAEGALVVRGGEVRSVEAFPAREVIDTTGAGDLFAAGFLAGYTRGIDYVASARLGALAAAEVIEHIGARPQRDLLALAREHKLV

SEQ ID NO: 14735 - protein, 809 aa, Arabidopsis thaliana
MGETGDDAGPSEQGPSNQTWWPSEFVEKFGSVYLGSQEETSSTKDSPRNLGQDGLPSSTASNILWSTGSLSEPIPNGFYSVIPDNRLKQLFNNIPTLEDLHALGDEGLKADVILVDFQKDKKLFRQKQLITKLVSGLNSKPATIIKKIAGLVADVYKQSTLQSPAKSTQSFENCGIQLLGQIKHGSCRPRAILFKVLADTVGLQSRLVVGLPSDGAAESVDSYSHISVTVLLNSVEMLVDLMRFPGQLIPLSTKAIFMSHISAAGESDSAENDSCDSPLEPNSPMFGYPEKFDHENAEKDENLSLHRKLDGSPNTSGPPSRNMLLRSASALERKLSFSQSESNMANEFWRQSRRKVIADQRTASSSPEHLSFRARTKSMLSGDKNLARDFTGDVATSSCKSVGGAKMETKRIRRRSISITPEIGDDIVRAVRAMNEALKQNRLSKEQGDDDSSPNSPNDRTESSHLQKNVSGFHLDAHDQVSGGRSTLSREPLDPQKAISLPSSPQNYRSQYEQSGSSHRNISHIWDKVLGSPMFQNKPLLPYEEWNIDFSELTVGTRVGIGFFGEVFRGIWNGTDVAIKVFLEQDLTAENMEDFCNEISILSRLRHPNVILFLGACTKPPRLSLITEYMEMGSLYYLLHLSGQKKRLSWRRKLKMLRDICRGLMCIHRMGIVHRDIKSANCLLSNKWTVKICDFGLSRIMTGTTMRDTVSAGTPEWMAPELIRNEPFSEKCDIFSLGVIMWELCTLTRPWEGVPPERVVYAIAYEGARLEIPEGPLGKLIADCWTEPEQRPSCNEILSRLLDCEYSLC

SEQ ID NO: 14736 - protein, 114 aa, Brassica napus
  misc_feature (92)..(92): Xaa can be any naturally occurring amino acid
  misc_feature (98)..(98): Xaa can be any naturally occurring amino acid
  unsure (1)..(114): unsure at all Xaa locations
MNVSHASVHPVEDPPPATATPVENHPPRVRMDDIEGMPGTLLGVALRFFQFLFAAASLSVMASTSDFPSVTAFCYLVAATGLQSLWRLSLAXVDVYAXIMVKRSLQNRRLVSVF

SEQ ID NO: 14737 - protein, 253 aa, Hordeum vulgare
MGRKFFVGGNWKCNGTVEQVEAIVQTLNAGQIVSPDVVEVVVSPPYVFLPIVKAKLRPEIQVAAQNCWVKKGGAFTGEVSAEMLANLGVPWVILGHSERRSLLGESSEFVGEKVAYALAQGLKVIACVGETLEQREAGSTMEVVAEQTKAIAGKIKDWSNGVVAYEPVWAIGTGKVATPAQAQEVHANLRDWLKTNVSPEVAESTRIIYGGSVTGASCKELAAQADVDGFLVGGASLKPEFIDIINAAAVKSA

SEQ ID NO: 14738 - protein, 622 aa, Candida glabrata CBS 138
MSTPVDEERQPLNPRGSRSQVRYISIPLARNPDLEAVDGDTSGYAVQDSSFTNHEPQPMGRRQSILDQPIGSFRGVNSLSRFATSLRRANSFRNIEVKPEVERTYFNDDYDELFDPSTLAPAPHGRSLSIALQSANATLQVSGKPSIPNIDAQSTHSISQQELEDFRSIRTTSFSMDNNGILRPTLSMNEMLTGSTPFDTNDVDSMVIKQVEGKDGTVVTLLAGQSTAPQTIFNSINVLIGIGLLALPLGMKYAGWIPGLIMLSIFAFGTFCTAELLSRCLDTDPTLISYADLGYAAFGSRGRAFISALFTVDLLSCGVSLVILFGDSLNALFPQYSVTFFKIVCFFVVTPPVFIPLSILSNISLLGILSTTGTVLVIFICGLFKRDAPGSLIEPMPTHLWPTDFKSLCLSIGLLSASWGGHAVFPNLKSDMRHPQKFKKCLKTTYQITSVTDIGTAVIGFLMFGDLVKDEITKNVLLSDGYSNTVHVLISALMTVIPIAKTPLNARPIVSVLDIMFGIHEAEKEYTGKKLKFAQFGQFFNRIFVNFMFVLIAIIFPQFDRIIAFMGAGLCFAICFILPCLFYLRICGEANIVKPWERLACKATIVVSVVLSVLGVSAAMFS

SEQ ID NO: 14739 - protein, 484 aa, Agrobacterium tumefaciens str. C58
MKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 14740 - protein, 558 aa, Zea mays
TREKEMAKKKEKAVNVSGKPRHSNDVNRPNDKKGAGGGAGGGSRSAATVRRLKMYKTRPKRDRSGKVLRNDFQSKELPNTRIEPDRRWFGNTRVVGQPQLEMFREELQSRLSDNFSVILKERKLPLSLLQDHQKQAKAHLLEVEPFEHAFGPKGKRKRPKLTALDYESLLKRADDSQDVFEQKYASSKLPREEEEDGLRDLVRHTMFEKGQSKRIWGELYKVIDSSDVVVQVLDARDPMGTRCYHLERHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLADAAEHIGEVLSRVKKEHLQRAYKIQDWSDDNDFLVQLCRTTGKLLKGGEPDLTTAAKMVLHDWQRGKIPFFVPPPQQSDGGASESAEQPIGITKEDGVSSDRTAAAMKAIAGIISSQQNMNVPCHKENNADNEDTENADNEDIESSDNEDNDDIEPAERSE

SEQ ID NO: 14741 - protein, 397 aa, Bacillus clausii KSM-K16
MFESIDEAITQLKAGGMILVVDDEDRENEGDFLALAETASPETINFMATHGRGLICVPLTEEQAERLQLGQMVSHSTDPHGTAFTVSVDHSHTTTGISAFERAETVRALADANAQPSDFKRPGHVFPLVAKNGGVLRRAGHTEAAVDFAKLCGAKPAGVICEVMNEDGSMARVPELRIIADQHNLPLVTIKDLIAYRRKTEKVVTREVAISLPTEYGDFKAVGYTNTIDGKESVALVKGDVGNGEPVLVRVHSECLTGDVFGSKRCDCGPQLHAALKQIEAEGRGVLLYMKQEGRGIGLINKFRAYKLQEEGYDTVEANERLGFPADLREYGIGAQILRDLGIRDMRLLTNNPRKIAGLEGYDLNIVERVPLQMEAVAENERYLHTKREKLGHMLNL

SEQ ID NO: 14742 - protein, 424 aa, Silicibacter pomeroyi DSS-3
MIRLNSQADWVERARAVLPAAGFGNFDPAVVIARGQGARVWDQDGREYVDYLIGSGPMLLGHGDPEVMEAVLEQLPLGTTFFANNTKGIELAEAIVQAVPCCEQVRFVTSGGEADMYAIRLARAFTGKPRIVKFEGGYHGMSAEAQMSLAPARAVNFPTPVPDSAGIPPGVADQVLVAPFNDLEAVASLLAEHDDIAAIIAEPLQRIIAPAPGFLQGLRALCDRHGVLLIFDEIVTGFRLSYGGAQEHYGVTPDIVTLGKVIGGGFPLAALGASARIMAHFDKGAVGGEGWLMQLGTLSGNPVAAAAGLKTLEILRRPGQYARLRDLGERLMAMHERALGAQGIAHRLSGDATLFDVYFTDAACTDYRTARHAAPELAQVWNAVLRAEGVLKSPGKLYPSLALGEEELERTEAALNRAAAAVTG

SEQ ID NO: 14743 - protein, 285 aa, Symbiobacterium thermophilum IAM 14863
MDLANPGALKALMAQYGLRPQHRLGQNFLIDGRVLDGIVSAAGLEPTDVVLEIGPGLGTLTQRLAAKAGRVVCVELDRGLVQVLHDTVQKAYDNVEVIHGDAGRIDLHKLLGERLAPGQKAKVVANLPYYITTPLVMRLLEEELPLSHVVVMVQKEVADRMVSPPGSKAYGALSVAVQYYTEPRIVLRVSRASFMPQPEVDSAVVSLRYRERPPVDAPPEAFFRVVRAAFGQRRKSLVNALTSLGVEKAAVHAALEAAGIDPGRRGESLSLEEFAAVARTLWQRT

SEQ ID NO: 14744 - protein, 250 aa, delta proteobacterium MLMS-1
MRTPLLAGNWKMHLDQAAAAELAAAVAKVAAACPEREVMIAPPFTALAAAGQAAGQQVILAAQNVCWEAQGAFTGEIAPPMLRELGCGMALVGHSERRQLFHEDNSMINRRLGGALAHGLVPVLCIGETLAEREADRTMEVLASQLREGLAGISLDDPRQLVVAYEPVWAIGTGKTAGPEQAQEAHQFVRGLLAELYQKNIADGVRILYGGSVNAANVDTIMAQPDVDGALVGGASLDIASFERIIRFQV

SEQ ID NO: 14745 - protein, 102 aa, Boechera stricta
MFEIVQAVFAAGGALALLTFAGITLGGSVVAFVISTPLFVIFSPVLVPATIATTLLATGFTASGSLGSTAISILMWLYKKRTGKDPPKIPGLTPDSAPGKYD

SEQ ID NO: 14746 - protein, 323 aa, Streptomyces coelicolor A3(2)
MDTRPLVSTPFTASSTADEVLEDVDLTGVRAIVTGASSGLGIETARALTAAGAEVTLAVRNTAAGASAAETIARSTGAAPPRVVRLDLADRAGVTRFVDAWDGPLHLLVNNAGVVTGGLERTPEGWELHFATNHLGHFALATGLHQALARGAAERGGARIVSVSSTAHMRSGIDFDDLHFERRSHDPQTAYAQSKTANSLFAVEATRRWGSAGIVANAVNPGGVATGLQRNFTPEQKASLDAAEAAGVFTYKTVEQGAATSVVAAVAPEFAHSGGHYLDDGQEAYTVPNDADLAQHPHGVKEWALDPAAAKRLWTVSTDLLRS

SEQ ID NO: 14747 - protein, 359 aa, Aspergillus nidulans FGSC A4
MSSQTPTAQNLSFVLEGIHRVKFEDRPIPKLKSPHDVIVNVKYTGICGSDVHYWDHGAIGQFVVKEPMVLGHESSGIVTQIGSAVTSLKVGDHVAMEPGIPCRRCEPCKAGKYNLCEKMAFAATPPYDGTLAKYYTLPEDFCYKLPESISLPEGALMEPLGVAVHIVRQANVTPGQTVVVFGAGPVGLLCCAVAKAFGAIRIIAVDIQKPRLDFAKKFAATATFEPSKAPATENATRMIAENDLGRGADVAIDASGVEPSVHTGIHVLRPGGTYVQGGMGRSEMNFPIMAACTKELNIKGSFRYGSGDYKLAVQLVASGQINVKELITGIVKFEDAEQAFKDVKTGKGIKTLIAGPGAA

SEQ ID NO: 14748 - protein, 397 aa, Gibberella zeae PH-1
MTSTPKTSFMRAVQWEGELRHMSVNIIPRPKLIDPEDAVVRITTSAICGSDLHIYHGLFGTDEKFGVGHEAVGIVEEVGPAVDFLKPGDRVLVTGFSEDGNLLPKAALVPTDLDMVGVGFGSSFHSEGGLQAEYVRMPWADSSLAKIPHGLDDKEWLPLTDIFPTGWTALTRSGFQPGDTVAVFGAGGVGLMCAYSAIIRGASLVYVIDHIPARLALAASIGAQPINFTRGGKASEQILALRPAGVNRAIDCVGQFCLNENLKPQPDFILREAVKITTNGGGIGIAGVYQAGGPEGYKPEINFAIPELWFKSLQVGSGLVDIEGNIRALVDLVKNGRARPGFVFSNEYSLEEAPLAYRRFEQHQETKVMLKGSRKLEDDSSLDMIIGRNGVSDANGA

SEQ ID NO: 14749 - protein, 510 aa, Bacillus clausii KSM-K16
MSKKPVALIILDGFGLREEEKGNAVAHAQKPNFDRYWNEFPHATLRADGENVGLPEGQMGNSEVGHLNIGAGRIVYQSLTRVNLSIREGDFFKNETFIKAMDHVKEKQSALHIYGLLSDGGIHSHIDHIYALLDMAKQQNVERVYVHGFLDGRDVGPTSAEVYLKGLQDKFDEVGLGKLATVHGRYYAMDRDKRWDRVEKSYRAMVYGEGPSYKNGLELLDDSYKNNIVDEFVIPSVITEEDGTPVATVKDDDAVIFCNFRPDRAIQLSQVFTNEDFRGFDRGEKMPKRLHFVCLTKFSETVKGFVAFKPTNLDNTLGEVLSQQNYTQLRIAETEKYPHVTFFFSGGREDEFPGEERILINSPKVATYDLKPEMSAYEVTDALVKEIEGEKHDVIILNFANPDMVGHSGMLEPTVKAIEAVDECLGRVVDALLQKGGAAIITADHGNADEVVTLDGKPMTAHTTNKVPVIVTEKGITLREDGILADLAPTVLDLLGADKPKEMTGKTLKQ

SEQ ID NO: 14750 - protein, 251 aa, Bacillus clausii KSM-K16
MRKPIIAGNWKMNKTIGEAVDFVEAVKANVPAQATVDSVVCAPALFLDRLLQAVKGTELKIGAQTMHFEDNGAFTGEISPKALSDMGVHYVIIGHSERREMFAETDETVNKKVHAAFAHHLVPIMCCGETAEEREAGKMEAVVKEQVENGLAGLSEEQVKQTVIAYEPIWAIGTGKSATEKDANEACAYVRQTVAANFSEEAAEAIRIQYGGSVKPGNIKDYMAQPDIDGALVGGASLDADSFLELVGAAK

SEQ ID NO: 14751 - protein, 448 aa, Glycine max
MESKNPARFTLGKQSSLAPERHNKEAELQKDGEVVDQGVRLMYSAFEGDVDGIREALESGVSVNYKDIDNRTALHVAACEGFTDVVDLLLQKGAEVDPKDRWGSTPLADAIFYKKNDVIKLLEKHGAKLLMAPMHVNHAREVPEYEINPKELDFTNSVEITKGTFCIALWRGTEVAVKKLGEDVISDEEKVKAFRDELALFQKIRHPNVVQFLGAVTHSSPMMIVTEYLPKGDLRDFLKRKGALKPSTAVRFALDIARGVGYLHENKPSPIIHRDLEPSNILRDDSGHLKVADFGVSKLLAVKEDKPLTCHDTSCRYVAPEVFRQEYDTKVDVFSFALILQEMIEGCPPFSAKQDNEVPKVYAAKERPPFRAPAKHYSYGIRELIEECWNENPAKRPTFRQIITRLESIYNTISHKRHWKVIISLMFPPPPHQIFVLAYACSKLCRPD

SEQ ID NO: 14752 - protein, 831 aa, Debaryomyces hansenii CBS767
MPDDKKNLLDASGAQTAEDRTATAILRRKKKDNALIVDDAENDDNSVITMSSNTMELLQLFRGDTVLVKGKKRKDTVLIVLADDDMDDGVARINRCVRNNLRVRLGDIVSIHPCPDIKYANRISVLPIADTVEGITGSLFDVYLKPYFVEAYRPVRKGDLFTVRGGMRQVEFKVVEVDPEEIAIVAQDTIIHCEGEPINREDEENNMNEVGYDDIGGCRKQMAQIRELVELPLRHPQLFKSIGIKPPKGILMYGPPGTGKTVMARAVANETGAFFFLINGPEIMSKMAGESESNLRKAFEEAEKNSPSIIFIDEIDSIAPKRDKTNGEVERRVVSQLLTLMDGMKARSNTVVIAATNRPNSIDPALRRFGRFDREVDIGVPDAAGRLEILRIHTKNMKLNDDVDLEAIASETHGFVGADIASLCSEAAMQQIREKMDLIDLEEETIDAEVLDSLGVTMENFKFALGNSNPSALRETVVENVNVTWNDIGGLDTIKNELKETVEYPVLHPDQYQKFGLSPSKGVLFYGPPGTGKTLLAKAVATEVSANFISVKGPELLSMWYGESESNIRDIFDKARAAAPTVVFLDELDSIAKARGGSHGDAGGASDRVVNQLLTEMDGMNAKKNVFVIGATNRPDQIDPALLRPGRLDQLIYVPLPDEVARLSILQAQLRNTPLEPGLDLLEIAKITNGFSGADLSYIVQRSAKFAIKDSIEAHIRLQKSKADSKQGDDVEMTEESKPAGDEEEEEEEDPVPYITRAHFEEAMKTAKRSVSDAELRRYEAYSQQMQASRGQFTNFRFSEGEGNEGAQSNSTGNENAAAFGNVEEDDDLYS

SEQ ID NO: 14753 - protein, 335 aa, Bacillus clausii KSM-K16
MATKIGINGFGRIGRNVFRASLKNPNVEVVAINDLTDANMLAHLLKYDSVHGVLDAKVEAKDNSLVVDGREISVSAERNPAEIGWDKYGVEVVVESTGFFTKRADAAKHLEAGAKKVIISAPASDEDITIVMGVNEDKYDPANHHVISNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKDVTAEEVNGALKEAAEGDLKGILAYSEEPLVSGDYNGNPHSSTIDALSTMVMEGNMVKVISWYDNESGYSHRVVDLLDYIAGKGL

SEQ ID NO: 14754 - protein, 131 aa, Brassica napus
MKEMQTSSVPPGRSLYLNLIVVVLALFASITMAESTGEASSEAKVHIIYTEKPTDEEPKDYHLRTLSSALGSEEAAKDALIYSYKEAASGFSAKLTPEQVTEISKQPGVIQVVPSQTYQLHKPVGAGFKLT

SEQ ID NO: 14755 - protein, 425 aa, Clostridium perfringens ATCC 13124
MDRNKEIFEESKKYMPGGVNSPVRSFGSVGINPPVIKSGKGAMIKDENGNEYIDFVLAWGPMILGHCDEDVVKAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYDHIEKIGSKLEKGVLEIAKKKGLGLVVNRQGGMMTLFFTDLKEVKCYDDVKTCDGERFKRYFLHMLNKGFNIPPSQFEAMFLSVKHTEEHIDKFLEAFESFEG

SEQ ID NO: 14756 - protein, 379 aa, Shewanella oneidensis MR-1
MSNEKPQFIKSKAAVAWGPRQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLKEICLLGCGVTTGMGAVMNTAKVEAGATVAIFGLGGIGLSAIIGATMAKASRIIAIDINESKFELARKLGATDCINPKNFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 14757 - protein, 453 aa, Listeria monocytogenes str. 4b F2365
MEASLLKKNQSIELTIEDLTHDGSGVGKIDGYPLFIPNTLPGEKVTAKIIKLNKNYGFARMENIETVSADRVEPPCAVYSKCGGCSLQHLSYDGQLEFKRNQVEETMKRIGKLNVEVPETLGMENPWRYRNKSQVPVGFVNGKLTAGFYQKRSHAIIDMSTCLIHNEQGDFAVQKTREILAKYGTEPYDEQTGKGDIRHIMTRFAHTTGQLMIVLVTTKERMPFKEEIVRELVEQLELTSIVQNINPHKTNVIFGDRTKTLWGKDIIEDTIHGIRFAISARSFYQVNPIQTEVLYQQAIDAAELTGEETVIDAYCGIGSISLCLAKKAKHVYGVEIVDQAIQDARANAELNELANTTFETGKAEEVIPAWYKAGIVADVLVVDPPRKGCDEKLLETILAMKPKKVVYVSCNPGTLARDMKILTDGGYVAKKVQPVDMFPMTTHIEAVTVLHLN

SEQ ID NO: 14758 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGEQAGVIKSHDRVVVCQKVGDASVVKIIELED

SEQ ID NO: 14759 - protein, 424 aa, Methanosarcina mazei Go1
MVSEITLEKSRQMYEKAKTLIPGGVSSPVRAIKPYPFYTASANGSKIRDLDGNEYIDYCLAYGPAILGHNHPVIKEAIRQQLDRGWLYGTPTELEVTLAEKVASYYPSIDMLRFVSTGTEATMSALRLARGFTRRNKFIKIEGGFHGAHDAVLVKAGSGATTLGEPDSLGIPADFTKHTLQAPYNDIETMTSLVEKNRDDLAAVIIEPVLGNIGPVLPLPGYLEELRKLTEENDVLLIFDEVITGFRLAMGGAQEYFGVVPDMTTLGKIVGGGLPIGVFGGKREIMEMIAPSGAVYQAGTFSGSPCSVAAGIAMVDYLNEENIHAKLNSAGDYMRAALSEIVEDEGLDYHVCGIASMFKIFFGDEPHNYQEVLKCDKEGYLAFFHRMLASGVFLPPSQFETNFISAVHSDEDIEKTLEAYSENL

SEQ ID NO: 14760 - protein, 386 aa, Gibberella zeae PH-1
MATQTMKAVNYQGPYKVTVEDVELPKLEHPDDVIVKVTTAAICGSDLHMYEGRTAAQPGITFGHENMGIVEQLGEGVTLLKKGDRVVMPFNVADGRCRNCEEGKTAFCTGVNPGFAGGAYGYVAMGPYRGGQAQYIRVPYADFNALKLPAGKEHEADFILLADIFPTGWHGVEISGFRSGESVAVFGAGPVGLMAAYSAVLRGASRVFVVDRVPERLQAAEKIGCTPIDFSKGDAVDLIIKANGGEEVDRSVDAVGYQAVGNSGDTEQPNIVLENMIRVTRPCGGLGIPGLYVPSDPGASDEASAKGMISLSFGKLFEKGLTIGTGQCNVKSYNRYLRDLIISGRAKPSFVVSHEINIDEAEVAYEKFDKRIDGYTKVLIHPNGGF

SEQ ID NO: 14761 - protein, 336 aa, Petroselinum crispum
MKMKIGINGFGRIGRLVARVALMSDDIELVAVNDPFITTEYMTYMFKYDSVHGQWKKDELKVKDSKTLLFGDKPLTVFGVRNPEEDPWGEAGAEYVVESTGVFTDKDKAAAHLKGGAKKVVISAPSGNAPMFVVGVNEKEYKKDIDIVSNASCTTNCLAPLAKVLNDKFGIVEGLMTTVHSITATRKTVDGPSMKDWRGGRAASFNIIPSSTGAAKAVGKVLPALNGKLTGMAFRVPTVDVSVVDLTARLEKAATYDEIKAAIKHESETSLKGILGYTEDDVVSTDFVGDSRSSIFDAKAGIALNGNFVKVVSWYDNEWGYSNRVIDLIRHMASVA

SEQ ID NO: 14762 - protein, 191 aa, Triticum aestivum
MFLRRILSGGGGLAALRSARAVKETTGIVGLDVVPEARNVLIGLYTRTLKEIEAVPKDEGYRKAVESFTRHRLQICQEEEDWKRIEDRLGCGQVEELIEEAEDELKLIGKMIEWDPWGVPDDYECEVIEDDTPIPKHVPQHRPVALPEEFFKTLDAIKSESSSAGRLSSASEVMKLELFKMHHFSPVAVCS

SEQ ID NO: 14763 - protein, 324 aa, Oceanospirillum sp. MED92
MTIRSLLSILADGKFHSGSELGEKIGISRSAIWKHIRRLEEGGLEIYSVKGRGYRVPGGLNLLDVGQIEQALKSDVRHQLQEIDLQLTIPSTNALAMKESQRGDCHGRIYLAEQQTEGRGRRGRTWVSPFARNLYFSLVWRFEQGAAAIEGLSLLVGLAMVKAMEKLKIDAVQLKWPNDLLSQGRKLAGILLEVHGEASGQCQVVIGVGVNVEMPRDLGEQIDQPWIDLKTVSGRPVDRNLLLAEILNELVLRLNQFERNGFAEFVDEWHGYHAMQSQPITLQVGSKAIEGVCQGIDTSGALLLESEDGLRAYHGGEVSIQRAT

SEQ ID NO: 14764 - protein, 510 aa, Listeria monocytogenes
MSKSPVAIIILDGFGKRAETVGNAVAQANKPNFDRYWADFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 14765 - protein, 251 aa, Listeria monocytogenes
MRKPIIAGNWKMNKTAAKAGQFAEDVKNNVPSSDAVESVVAAPALFLQELVRLTEGTDLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 14766 - protein, 364 aa, Photobacterium leiognathi
MALSSAKEIIDDIRQGRMVILMDDESRENEGDLIIASEMVTPEAINFMATHGRGLICLTLSKARCKTLNLPLMLQGNNDNFSTPFTISIEAAKYVTTGISASDRAKTVLAAVAPNAKSTDIVMPGHIFPLMAQHGGVLIRAGHTEAGCDVARLAGLEPSSVIVEILNEDGSMARRPQLEIFAEKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESPKTLFEKLDMYAKEQPNSPHSGIVQSRNIGLGSQILADLGVKKIRLLSNSNQGYRALSGFGLEVVEYIYD

SEQ ID NO: 14767 - protein, 249 aa, Zea mays
  misc_feature (24)..(24): Xaa can be any naturally occurring amino acid
  misc_feature (124)..(124): Xaa can be any naturally occurring amino acid
  misc_feature (128)..(128): Xaa can be any naturally occurring amino acid
  misc_feature (132)..(132): Xaa can be any naturally occurring amino acid
  misc_feature (144)..(144): Xaa can be any naturally occurring amino acid
  misc_feature (151)..(151): Xaa can be any naturally occurring amino acid
  unsure (1)..(249): unsure at all Xaa locations
KDKEDILGWGVPNDIDMIALSFVXRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEXTDVXNAVXDGTDCVCQCEVXLDLPEVXVKIMARICIEAESSLDHEAVFKAMIRSAPLPMSPLESLASSAVHGTARHSLIYRGVIPILWEGSRKVFELVNEEGEDSIDVSGNKICIYGVQLKGFST

SEQ ID NO: 14768 - protein, 300 aa, Arabidopsis thaliana
MRTSSDRNRIASTDISPMSSLTVRRVQNLIERCLQLYMNQKEVVDTLLEQAKIEPGFTELVWQKLEEENREFFKAYYLRLMVKHQIMEYNELLEQQINHMRQMHPTAGASVRNRNGSHVPPMNQQQLLYERKEPDQSSPNLSSPYLNGGSAINTNIPSYVDFSSHSRRVDPSPNSLSLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQGEHLKLC

SEQ ID NO: 14769 - protein, 139 aa, Mycobacterium smegmatis
MTERTLVLIKPDGVKRQLVGEILSRIERKGLTLAALELKNVSDDLARQHYAEHADKPFFGSLLEFITSGPLVAAIVEGPRAVAAFRQIAGGTDPVEKAVPGTIRGDFALITQDNLVHGSDSPESAAREIALWFPGEATA

SEQ ID NO: 14770 - protein, 134 aa, Metarhizium anisopliae
MYNLNPLTKNNWRASLVPHRGNSSSNSSDSPYSGGVFFLAIHFPTDYPFKPPKVSFTTPIYHPNINSNGSICLDILRDQWSPALTISKVLLSICSMLTDPNPDDPLVPEIAHVYKTDRPRYEATAREWTRKYAV

SEQ ID NO: 14771 - protein, 1845 aa, Arabidopsis thaliana
MSSQLVQFSTVPQIPNPPSRHRHFLSERNYIPANVYEHPAALLLERCSSLKELRQILPLVFKNGLYQEHFFQTKLVSLFCRYGSVDEAARVFEPIDSKLNVLYHTMLKGFAKVSDLDKALQFFVRMRYDDVEPVVYNFTYLLKVCGDEAELRVGKEIHGLLVKSGFSLDLFAMTGLENMYAKCRQVNEARKVFDRMPERDLVSWNTIVAGYSQNGMARMALEMVKSMCEENLKPSFITIVSVLPAVSALRLISVGKEIHGYAMRSGFDSLVNISTALVDMYAKCGSLETARQLFDGMLERNVVSWNSMIDAYVQNENPKEAMLIFQKMLDEGVKPTDVSVMGALHACADLGDLERGRFIHKLSVELGLDRNVSVVNSLISMYCKCKEVDTAASMFGKLQSRTLVSWNAMILGFAQNGRPIDALNYFSQMRSRTVKPDTFTYVSVITAIAELSITHHAKWIHGVVMRSCLDKNVFVTTALVDMYAKCGAIMIARLIFDMMSERHVTTWNAMIDGYGTHGFGKAALELFEEMQKGTIKPNGVTFLSVISACSHSGLVEAGLKCFYMMKENYSIELSMDHYGAMVDLLGRAGRLNEAWDFIMQMPVKPAVNVYGAMLGACQIHKNVNFAEKAAERLFELNPDDGGYHVLLANIYRAASMWEKVGQVRVSMLRQGLRKTPGCSMVEIKNEVHSFFSGSTAHPDSKKIYAFLEKLICHIKEAGYVPDTNLVLGVENDVKEQLLSTHSEKLAISFGLLNTTADLKENSFEHMGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNVGPTWAFFNNSQDSWKNGLEPQEISGLTFFEMNTIRAATNNFNVSNKLGQGGFGPVYKGTLSDKKDIAVKRLSSSSGQDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHRDRDKKTMLKRDCSSVVGSERERDGSSLALKRHCSSVVKLLLPHDVVGLILERLPVESLLRFKCVSNQWKSTIESQCFQERQLIRRMESRGPDVLVVSFADDEDKYGRKAVFGSSIVSTFRFPTLHTLICYGSCEGLICIYCVYSPNIVVNPATKWHRSCPLSNLQQFLDDKFEKKEYDFPTPKLAFGKDKLNGTYKQVWLYNSSEFRLDDVTTCEVFDFSNNAWRYVHPASPYRINDYQDPVYSDGSVHWLTEGKESKILSFHLHTETFQVLCEAPFLRERDPVGDSMCILDNRLCVSEINGPAQLIWSLDSSGGNKC

SEQ ID NO: 14772 - protein, 321 aa, Zea mays
  misc_feature (241)..(241): Xaa can be any naturally occurring amino acid
  unsure (1)..(321): unsure at all Xaa locations
MRLDEQALLVICGLLRLPALLVSRGIHRSLSSDAARKIELQLHFVDTVVGIEMNESAVSDAHRNALINGIKNCRFVCGKAEDVMGPLLTEYLGSPQQQAAASKSNSEIDDTRKTEDMIGCASYDGENIDSSKQRHDNAEGQQPMDTSVDHPTCASEVDGMDVVDCNHDENNVASGEQNCREASLINGKPIETSSDNSLEQGKACKDGSSSPNNNVLAANACQFKNVVAIVDPPRVGLHPTXYISCNPDSLVANGIELCTPTPENQEKTKGNRGWRSMSSAGLARQRTKSMPNSEPFIPKRAMAVDLFPHTPHCEMVMLFER

SEQ ID NO: 14773 - protein, 279 aa, Streptococcus pneumoniae TIGR4
MLERHGFTFKKSFGQNFLTDTNILQKIVDTAEIDDQVNVIEIGPGIGALTEFLAERAAQVMAFEIDHRLVPILADTLRDFDNVTVVNEDILKVDLAQHIQNFKNPDLPIKVVANLPYYITTPILMHLIESGIPFCEFVVMMQKEVADRISAQPNTKAYGSLSIAVQYYMTAKVAFIVPRTVFVPAPNVDSAILKMVRRPEPAVAVEDENFFFKVSKASFTHRRKTLWNNLTGYFGKTEEVKDKLTKALDQAGLSPSVRGEALSLAEFAGLADALKGQGL

SEQ ID NO: 14774 - protein, 337 aa, Petunia x hybrida
MAKIKIGINGFGRIGRLVARVALQRDDVELVAVNDPFISVEYMTYMFKYDSVHGQWKHHELKAKDDKTLLFGEKPVTVFGIRNPEEIPWGEAGADYVVESTGVFTDKDKAAAHLKGGAKKVIISAPSKDAPMFVVGVNEKEYKSDLTVVSNASCTTNCLAPLAKVINDRFGIVEGLMTTVHSMTATQKTVDGPSAKDWRGGRAASFNIIPSSTGAAKAVGKVLPALNGKLTGMAFRVPTVDVSVVDLTVRLEKEATYDEIKAAIKEESEGKLKGIPGHTEDDVVSTDFIGDNRSSIFDAKAGIALSKNFVKLVSWYDNEMGYSTRVVDLIKHIASVE

SEQ ID NO: 14775 - protein, 486 aa, Burkholderia pseudomallei K96243
MYLEHALKDPSLLRHQAYIGGEWQAADSDATFEVFDPATGESLGTVPKMGAAETARAIEAAQAAWAGWRMKTAKERAAILRRWFDLVIANSDDLALILTTEQGKPLAEAKGEIAYAASFIEWFAEEGKRVAGDTLPTPDANKRIVVVKEPIGVCAAITPWNFPAAMIARKVGPALAAGCPIVVKPAESTPFSALAMAFLAERAGVPKGVLSVVIGDPKAIGTEITSNPIVRKLSFTGSTAVGRLLMAQSAPTVKKLTLELGGNAPFIVFDDADLDAAVEGAIASKYRNNGQTCVCTNRFFVHERVYDAFADKLAAAVSKLKVGRGTESGATLGPLINEAAVKKVESHIADALAKGASLMTGGKRHALGHGFFEPTVLTGVKPDMDVAKEETFGPLAPLFRFASEEELVRLANDTEFGLAAYLYSRDIGRVWRVAEALEYGMVGINTGLISNEVAPFGGVKQSGLGREGSHYGIDDYVVIKYLCVAV

SEQ ID NO: 14776 - protein, 99 aa, Zea mays
MAWRASLSRSLKEIRVGGGQCSPASAAAREFVKKNYGDIKARNPSLPFLVRECSGVQPQLWARYDMGVERCVNLDGLTEAQIDKKLEELAKAGESLKTK

SEQ ID NO: 14777 - protein, 398 aa, Oltmannsiellopsis viridis
MAIEAIIKPKQVKNFTLNLGPQHPSAHGVLRLVLELNGEVIERADPHIGLLHRGCEKLIEYKTFVQALPYFDRLDYVSMMAQEHSYCLAIEKLVDCELPLRAQYIRVLFSEITRILNHLLALSCHALDVGALTPFLWAFEEREKLLEFYERASGARMHAAYFRPGGVAQDLPAGLCDDIHQFAKQFASRLDEIEEMLTNNRIWKQRLVDIGTVTAKEALDWGFSGVLVRGSGIPWDLRTAQPYEVYDRMKFSVPVGIRGDCYDRYLIRVEEMRQSLQIIMQALNQMPNGCVKVDDKKLTPPSRSQLKQSMESLIHHFKLYTEGFNVPASETYAAVEAPKGEFGVFLVSNGTNKPYRCKIRAPDYNSLQGLDFMARKHLLADVVTIIGTLDVVFGSIDR

SEQ ID NO: 14778 - protein, 223 aa, Glycine max
MDSNSVVSWPRLPENIDGFGIKQKQSEEVHVLAVDDSIVDRKVIEHLLKVLACKVTAVDSGLRALQLLGLLDEQKIPSETNGFGGLKVDLIITDYCMPGMTGYELLKKIKESSSFKETPVVIMSSENVLPRIDRCLEEGAEDFIVKPVKLSDVKRLKDFMTTKEVIRGELSQEEREGINKRKLLDTSDVSPSSPPSISSSPLPSSPSSVIDSPIRRLKMTGTD

SEQ ID NO: 14779 - protein, 540 aa, Methanosarcina mazei Go1
MLKFSISCLSYLSGEIDMKVLVSDSLSNEGLEILKEHFDIDVCTGLCEDELVEKIKGYDALVIRSGTQVTQRIIEAADNLKIIGRAGVGVDNVDVDAATKKGIIVANAPEGNMISAAEHTIAMMMSMSRNIPQANASLKAREWKRNKFMGVEVKGKTLGVIGLGRIGSEVAKRAAGLEMNLMGYDPFISEKRAMELGVKLATVNEIAKEADYITVHTPLIKETRNILDDEQFALMKKGVRVLNCARGGIINEEALARALESGKVGGAAIDVFVEEPPFSSPLLNFDNVIVTPHLGASTQEAQVNVAIDIAKEVVSVLTGGSAKNAINIPSVKPEAMAVLAPYIRLSELMGKIAGQLVDSNYEKVEIAYNGEISGKDTRPLTVSALKGLLEMAVGSGVNYVNAPILAKSRKIAVVESKSESAEEYSSTVSIRLSSGESTKMVAGTVVGDEPKIVSIDDDKVDIFPAGRMIFAKHINKPNVIGPCCMVLGKNNINISGMQVGRSEVGGVTMMVLNVDTDVSDAILDEVRQVPGILNAKLVTL

SEQ ID NO: 14780 - protein, 478 aa, Prosthecochloris aestuarii DSM 271
MTLRDIYRKGELVELTIADIAEKDQCFGTLDNGAGVLVRGMLAVGDRVSAKVLKVKPRYLEAVLDELLEPSEDRVEPVCSVFGVCGGCKWMHVSYDAQLHYKKKKVADALEHIGGMHDIAVQPVLPAPEAFHYRNKVEFSCSSKRYLLPHELSMETLDKSKDFALGFHAPGNFEKVLEIDTCYLAKPSMNEALSATRAFALDRGLEPYAARAHTGFLRNLMLRYSEEHDELMVNIVTSWYDRELMEAYRDHLLERMKGRRMTIVNNVTTRKNTVSTGEKEYVVYGDGTLRERLGDLHFRISANSFFQTNTRQAEALYEGIMRMAGLKQDDVVYDLYCGTGTITLYLAERCRQAVGLEVVESSIIDAAENAGANGIENAAFYQVDLKDFHTLVPTLEQYGMPRVIVTDPPRAGMHPKALETLLRLQPETIVYVSCNPANLARDGKEIVQQGYRLEEVQPVDMFPHTSHVETLACFRRTV

SEQ ID NO: 14781 - protein, 152 aa, Triticum aestivum
  misc_feature (85)..(85): Xaa can be any naturally occurring amino acid
  unsure (1)..(152): unsure at all Xaa locations
MAAGARAVAAMSSSSSVLLAAAVALALLVASASAQSGCTSVLIGLYPCMNYISGSGTAPTKSCCSQLASVVQSQPQCLCSALGGXSSSLGGITINKTRALELPNACNVQTPPASKCNGSGGGSAPGASVSTPAVPAVQTPGRFRYQKRTPPP

SEQ ID NO: 14782 - protein, 289 aa, Bacteroides fragilis NCTC 9343
MERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLWGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 14783 - protein, 494 aa, Suaeda japonica
MAASGMELMQERDVFKKYWVEHTVDLTIEAMMLDSQASDLDKEERPEILSMLPPLEGKCLLELGAGIGRFTGELAEKAGQVIALDFIESAIKKNEVINGHYKNVKFMCADVTSPTLSFPPHSLDVIFSNWLLMYLSDEEVENLVERMLKWLKPGGYIFFRESCFHQSGDHKRKSNPTHYREPRFYTKAFKECHLQDGSGNSYELSLLSCKCIGAYVRNKKNQNQISWLWQKVDSKDDKGFQRFLDTSQYKCNSILRYERVFGPGYVSTGGYETTKEFVSMLDLKPGQKVLDVGCGIGGGDFYMAETFDVEVVGFDLSVNMISFALERSIGLKCAVEFEVADCTKINYPDNSFDVIYSRDTILHIQDKPALFRSFYKWLKPGGKVLISDYCKKAGPPSPEFAAYIKQRGYDLHDVKEYGQMLKDAGFVDVLAEDRTEQFIRVLRKELETVEKEKDVFISDFSEEDYNDIVGGWNDKLRRTAKGEQRWGLFVAKKK

SEQ ID NO: 14784 - protein, 692 aa, Zea mays
  misc_feature (326)..(326): Xaa can be any naturally occurring amino acid
  misc_feature (337)..(337): Xaa can be any naturally occurring amino acid
  misc_feature (365)..(365): Xaa can be any naturally occurring amino acid
  misc_feature (381)..(381): Xaa can be any naturally occurring amino acid
  misc_feature (398)..(398): Xaa can be any naturally occurring amino acid
  unsure (1)..(692): unsure at all Xaa locations
MTTVAHHHHLAAATVLFFVAFTMAPLAAGDPVGQLCGTSGNYTLNSTYQGNIRRLAATLPKNTSTSATLFATDTFGAVPDIVYALALCRGDTNASACSGCVAAAFLDAQQLCAYNKDATMFYDPCLLRYSNQNFLADPSSDGRGTALILMNTQNVTARFKVFDAAVAALLNATAAYAAANSSKRFGTGVEAFQNFDSNRPRIYGLAQCTPDMTPADCQSCLSGIIQTGPKYFSGKQGGRILSVRCNYRYEQYPFFTSTPLLQLAEPTVGAPAPAPAVVNGTPTPPTTGGARGTTGNKTGRVLAITLPIVAAVLATIVLCSCLWRKXETPGESALPDXTNPEDIQSIDSLIIDVSTLRAATENFAXSHKLGERGFCSVNKGXLPDDQEIAVKRLSQTSXRRGWRAEKPSSGLVAKLQTQDLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAFCFPKSGFNSEINSEVYPPGAYQSASRSPMSLNDVSITELEPR

SEQ ID NO: 14785 - protein, 395 aa, Triticum aestivum
  misc_feature (294)..(294): Xaa can be any naturally occurring amino acid
  misc_feature (338)..(338): Xaa can be any naturally occurring amino acid
  unsure (1)..(395): unsure at all Xaa locations
MHPTRWELSHMVDLQAAALVISVVAAEVGAGGKYKEMMDAYREMLTYIKSAVTRNYSEKCINNIMDFVSGSASQHFNLLQEFYQTTLKALEEAKNERLWFKTNLKFCKIWFDMGEYGRMSKILKELHKSCQKEDGSDDQKKGTQLLEVYAIEIQMYTETKNNKKLKELYQRALSIKSAIPHPRIMGIIRECGGKMHMAERQWADAATDFFEAFKNYDEAGNHGESQCLKYLVLANMLMESEVNPFDGQEATPYKNDPEILAMTNLIAAYQKNDIMEFEKILKSDRRTIMDDPFXIRNYIEDLLKNIRTQVLLKLIKPYTRIRIPFISQELNVPEKDVXQLLVSLILDNRVQGHIDQVNKLLECGDRSKGMRKYQAIDEWNTQLKSIYQTVSNRVG

SEQ ID NO: 14786 - protein, 452 aa, Lactobacillus sakei subsp. sakei 23K
MTYAPQKLTREKVFRDPVHNYIRVDYQVILDLIDTPEFQRLRRIKQLGTTSSVFQGAEHSRFTHSLGVYEITRQICDQFQINYPTKQPGDGLWNDNERLVALCAALLHDIGHGAYSHTFEHIFDTDHESITRQIIMTPETKVNQILSQVAPDFPAKVASVIDHTYPNPQVVQMISSQIDADRMDYLLRDAYNTGTKYGEFDLTRVLRVMRPYANGIAFLANGMHAVEDYIVSRFQMYQQVYFHPVSRGMEVVLQKLLQRAKFLYEQPDHHQSLAPQLLIPFFEHDFTLRDYLKLDDGVLNTYFIYWLDYPDTVLNDLADRFLSRRPLKSVKFNPSTEDCLPEMRALTEQAGYNATYYTAVNNSFDLPYDAYDPSAKSPKTQIEIIQSDGQLNELSSISNLVAAISGKFSGDERFYFPKEMSDTANLEVFAPIYQQFNSYINNGAIQAHPHNQ

SEQ ID NO: 14787 - protein, 549 aa, Methanosarcina acetivorans C2A
MATIGYFSMEIGLRNEIPTYAGGLGVLAGDTIRSASDLKIPLVAVTLVSNKGYFRQSLDVMGNQTEKIEEWTPSSFMTRTPQEVSVKIQDREVKIQAWQYNCKSLTGGCVPIIFLDTNVEGNAWEDRGITDFLYGGDHTYRLKQEIVLGIGGVRMLNALGFKVRKYHMNEGHSSLLALELLKCNNKDATKVKDLCIFTTHTPVEAGHDKFDYRLVDDLIRDKNDVEILRRFGGEDRFDTSLFALNLSNYVNGVTKRHSRVSSELFPGYSIQAITNGVHSYTWTSPFFRKLFDHYLPGWANEPELLVRIGGIPDDEIWQARRNAKKALIDEVNKRTGAGMDYETLTIGFARRMAEYKRATLILSDLERLRKINRRGRIQLIFAGKSHPNDGAGKQLIRDIFRSIETLRNEIKIVFLENYDMELAAKMVSGVDVWLNTPTRPYEASGTSGMKAAHNGVVNFSVLDGWWIEGWIEGVTGWSIGPKPEEHLSGEEARLAELDDLYNKLYYIIVPTYYERRDEWFKLINNSIGMIAYYFNSHRMMRRYVTHAYL

SEQ ID NO: 14788 - protein, 397 aa, Agrobacterium tumefaciens str. C58
MAGRKTGLPQNPAISGLRWRKPFWHGHCTFSGIKCHRGENMRALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQGVVVQTGLHPHENPIDWFQVTFRDLEIKGSWAYPTHYWPRVIRLIASGLLPATKIVTKRITLDTAVTEGFDALLDPAGTHLKILIDLSK

SEQ ID NO: 14789 - protein, 314 aa, Phaseolus vulgaris
MDKAVLDDVIRRLLEGKGGKQVQLSESEIRQLCVHARQIFLSQPILLELRAPMRVCGDIHGQYQDLLRLFEYGGYPPAANYLFLGDYVDRGKQSLETICLLLAYKIRYPDKIFLLRGNHEEAKINRIYGFYDECKRRFNVRLWKIFTDCFNCLPVSALIDDKILCMHGGLSPELESLDQIKEIQRPTEIPDSGLLCDLLWSDPDSSIEGWAESDRGVSCTFGPDVVAEFLDKNDLDLVCRGHQVVEDGYEFFAKRRLVTIFSAPNYGGEFDNAGALLSVDDSLVCSFEILKPADRASGSSSKMNFKKPPKMGKI

SEQ ID NO: 14790 - protein, 404 aa, Salinibacter ruber DSM 13855
MSSSPHSVRFNDRVAAMQPSATLAMKSRAEERRRQGHPVVALSAGEPDFETPKPISDAGVQAIRNGFTNYTENPGTLELREAICSKLDRDNDLSYTPEQVVCSNGAKQSLALAIHALCDEGDEVLIPAPYWVSYPEMARFSGAEPVPVPTDVDNGYRLTPAALEKAITERTRLLILCTPSNPTGTVYSPDELAALADVLRDHDGIYVVSDEIYEYVLYDAEHRAFASLPDMKERTVTVNGFSKGFAMTGWRLGYMAAPGPIAEAAGKIQGQFTSAPSSITQKAGVAALEMDKEPVEEMVSAFRRRRDVVLERLRAIDGVQCPTPEGAFYAYPDVSAFFGATAPDGSTIEDGGDLCFYLLEEQDVALVPGPAFGEPDGLRLSYASSMEDLETGLDRIEAGLAALR

SEQ ID NO: 14791 - protein, 314 aa, Triticum aestivum
MGAGDKTAAGMPRIGMGTAVQGPKADPIRRAVLRAIQIGYRHFDTAAHYETEAPIGEAAAEAVRSGAVASRDELFITSKLWCSDAHRDRVVPALRQTLRNLQMEYVDLYLVHWPVSMKPGRFKAPFTPEDFVPFDMRPVWEPMEECHRLGLAKAIGVANFSCKKLETLLSFATIPPTVNQVEVNPVWQQRKLREFCRGKGIQLCAYSPLGAKGTHWGSDAVMDAGVLQEIAASRGKSVAQVCLRWVYEQGDCLIVKSFDEARMRENLDVDGWELTEEERRRIAEIPQRKINLGKRYVSEHGPYKSLEELWDGEI

SEQ ID NO: 14792 - protein, 483 aa, Debaryomyces hansenii CBS767
MSIVSQVIPPISVKTILACLLWYLISSITSQLTKLILVKFTYPLFLSQFQFLISTLLSFTFITIARRFPEVQQHFPLGSLPNNSNKPIFDKSILITVLPLGIFQFTGKYFSLNATSLIPLSTVSSIKALSPLLIVAGYRVIYNVKFPSITYLSLTPLVGGVVLIIASESMNNDPGSKSTLLKNDKDEFDYKQIKGLIFCLISTIVFAAQSIYGKKLFTWNNSSTSNNPASLALNTEASKPGTPAIEQNGFAFSPPDNKVFDFSPKKSKKFIRQRTNSIKLPFSTSDLRLDEKNEEIVRQQLPYTRAVQNNDTITNPFASFTNDSLEDNNKKPDRMTTIFYCSMIGFFFSFGGFIINELSSIFKELTDPVEIIGGIPNQTTDIVTVLCLIFLDSLSHFSQMILAFHLLGLIPALSYSIASMMKRIVIITVSIILAIGSTQSHERDSSKWFGKINTQQLYGLILIAIGLYCYDRWGSRSLKANRI

SEQ ID NO: 14793 - protein, 561 aa, Bacillus subtilis
MSEWWKEAVVYQIYPRSFYDANGDGFGDLQGVIQKLDYIKNLGADVIWLSPVFDSPQDDNGYDISDYKNMYEKFGTNEDMFQLIDEAHKRGMKIVMHLVVNHTSDEHAWFAESRKSKDNPYRDYYFWKDPKSDGSEPNNWGSIFSGSAWTYDEGTGQYYLHYFSKKQPDLNWENEAVRREVYDVMRFWMDRGVDGWRMDVIGSISKYTDFPDYETDHSRSYIVGRYHSNGPRLHDFIQEMNREVLSHYDCMTVGEANGSDIEEAKKYTDASRQELNMIFTFEHMDIDTEQNSPNGKWQIKPFDLIALKKTMTRWQTGLMNVGWNTLYFENHDQPRVISRWGNDGKLRKECAKAFATDLDGMKGTPFIYQGEEIGMVNRDMPLEMYDDLEIKNAYRELVVENKTMSEKEFVKAVMIKGRDHARTPMQWDAGKHAGLTAGDPWIPVNSRYQDINVKESLEDQDSIFFYYQKLIQLRKQYKIMIYGDYQLLQENDPQVFSYLREYRGEKLLVVVNLSEEKALFEAPPELIHERWKVLISNYPQERADLKSISLKPYEAVMGISI

SEQ ID NO: 14794 - protein, 729 aa, Arabidopsis thaliana
MSGAVLVAIAAAVGNLLQGWDNATIAGAVLYIKKEFNLESNPSVEGLIVAMSLIGATLITTCSGGVADWLGRRPMLILSSILYFVGSLVMLWSPNVYVLLLGRLLDGFGVGLVVTLVPIYISETAPPEIRGLLNTLPQFTGSGGMFLSYCMVFGMSLMPSPSWRLMLGVLFIPSLVFFFLTVFFLPESPRWLVSKGRMLEAKRVLQRLRGREDVSGEMALLVEGLGIGGETTIEEYIIGPADEVTDDHDIAVDKDQIKLYGAEEGLSWVARPVKGGSTMSVLSRHGSTMSRRQGSLIDPLVTLFGSVHEKMPDTGSMRSALFPHFGSMFSVGGNQPRHEDWDEENLVGEGEDYPSDHGDDSEDDLHSPLISRQTTSMEKDMPHTAHGTLSTFRHGSQVQGAQGEGAGSMGIGGGWQVAWKWTEREDESGQKEEGFPGSRRGSIVSLPGGDGTGEADFVQASALVSQPALYSKDLLKEHTIGPAMVHPSETTKGSIWHDLHDPGVKRALVVGVGLQILQQFSGINGVLYYTPQILEQAGVGILLSNMGISSSSASLLISALTTFVMLPAIAVAMRLMDLSGRRTLLLTTIPILIASLLVLVISNLVHMNSIVHAVLSTVSVVLYFCFFVMGFGPAPNILCSEIFPTRVRGICIAICALTFWICDIIVTYSLPVLLKSIGLAGVFGMYAIVCCISWVFVFIKVPETKGMPLEVITEFFSVGARQAEAAKNE

SEQ ID NO: 14795 - protein, 437 aa, Glycine max
MPMAGEQGDRFSSITIPLLDDEKLHQVNGSDEALVAKTCDLHTPHVDNTSFFKTCFHLINALSGVGIISMPYALASGGWLSISLLFVIAIACCYTGMLVKRCMDMDPDIKNFPDIGQRAFGDKGRIIVSIAMNSELFLVVTGFLILEGDNLNKLVPNMQLELAGLTIGGTTIFTMIAALVILPTVLLEDLSMLSYVSASGALASSIFLLSIFWNGTIDGTGFHAKGTIFRLSGIPAAVSLYAFCYSAHPILPTLYNSMRDKSQFSKVLSACFTVCTLGYAAAGVLGYLMFGQEVESQVTLNLPTGKFSSHVAIFTTLVNPITKYALMLTPVINAVKNKVSWHYNKRFTHMFVSTSMLISTLIVAVAIPLFGYLMSLIGALLSVSTSILMPSVCYLKISGAYKRFGSEMIINYSIIIMGVTIAVVGTYTSLVDIVHNL

SEQ ID NO: 14796 - protein, 652 aa, Oryza sativa
MRGAVVAAAAAAVGNMLQGWDNATIAGALLYMRRDLPALQAHPALQGLVVATSLIGATIVTTFSGPLSDSRGRRPMLIASALLYSLAGLLMLWSPNVPILLLARLVDGFAIGLAVTLVPVYISETAPPDTRGLLNTLPQLTGSTGMFLSYCMVFLITLAPIPNWRLMLGVLLLPALLYLLLTIFFLPESPRWLVSKGRMKEARTVLQMLRGRQDVSAEMALLVEGLTTGRDTAIEEYVVGPTDEAKVTLYGGMSSGLAPGSMFGSAVTLASRQGSMLDHLKDPVVALLDSLHDMNPPAGGTTDVPNLGSMIGVHDRPPIDWDEENSGDDDGDIAAPLLTMEGEAATSTVGIGGGWQLAWKWTEGVAADGTRQSTVKRMYLHEEQAEGVHAAALVSQSALCTKKEAEAEVEGGWREVLEPGGVRHALVCGVAIQILQQFSGISGVLLYTPQILEQAGVGVLLSRLGLRDDSASILISGVTTLLMLPSIGVAMRLMDVSGRRSLLLWTIPLLVASLAVLVAASVAPMAAAAHAAVCTGSVVVYLCCFVMGFGPIPNILCAEIFPTRVRGLCIAICSLAFWLADIAVTYTLPVMLASLGLAGLFAIYAAVCCVALVFVALRVPETKGLPLEVIIDFFNVGAKGTLPNLHDDDDHY

SEQ ID NO: 14797 - protein, 322 aa, Vibrio vulnificus YJ016
MRKEHVVKLHLLKRLADGQFHSGETLGHELGISRAAISKHINALQDWGVDVYRIQGRGYQLAQPMTLLDEHQLVEQSANSVELIPVIDSTNQYLLERIENLQTGHVCLAEYQSQGRGRRGRQWFSPFGSNLYMSMYWRLDAGMAAAMGLSLVVGIAAVEALETLGVQGVKLKWPNDVYYQDKKLAGILVEMTGQAGGAAHLVIGMGLNMQMQADCHSIDQPWTALSQIESGARLDRTELALTLMAKWREALSEYEQCGLNGFIERWNRLDNFKGRQVKLLIGPREIHGEVQGIDSQGGVILKTVEGIQTFVGGEISLRANDQ

SEQ ID NO: 14798 - protein, 533 aa, Bacillus clausii KSM-K16
MNQVAEPKTAQFHILVADTMSEEGLLPLLEADHVEVTQASVDNAGPLEQYDALLIRSATTVTEELLSRMPRLKIVARAGVGVDNVDIQAATKHGVVVINAPDGNTISTAEHTFAMMCALLRNIPQANASVKSGKWDRKAYQGTELRGKTLGIVGFGRIGTQLAKRAKAFEMGVLVYDPFLTAERAEKLGIAQGELDHVLSVADIITVHTPLTKDTKGLLNMETIAKTKPGVFLINCARGGIIDEQALKHYLNNGHVAGAALDVFTEEPATDKELIGHPSVVATPHIAASTKEAQLNVAAQVSQEVLQFLNGEPALNSINLPAMPKDVYEKIKPYYDLARTMGSVLSQLMRIPVQEIEVFYSGTTAEQNTSVLTRSLISGFLQPRVDAAVNDVNASLIAKERGISFGEKHVTKTFGYSNLIQAVVHGEGRQFEMKATYIHEYGPRIVSINGFSVDVVAEGHILYIQHFDRPGVIGKMGQLLAKHDVNIATMQVGRKSAGGEAIMIVQVDKHVDQTVIDGLLTFDEIAIANVIDL

SEQ ID NO: 14799 - protein, 304 aa, Synechococcus sp. CC9605
MVAGAVGTTGVALWLRRDRRYESSESVASAYDAWTEDRLLEQLWGEHVHLGHYGTPPGSFDFREAKEAFVHELVRWSGLDQLPAGSRVLDVGCGIGGSARILARDYGLDVLGISISPAQVERATQLTPSGLSCRFQVMDALDLQLPDQSFDAVWSVEAGPHMPNKQRYADELLRAMRPGGLLAVADWNRRDPSDGGMTRTERWVMRQLLNQWAHPEFASIKGFRQNLDNSVHHRGEIVTGDWTQATLPSWIDSIIEGIRRPWAVVSLGPKAVLQGLRETPTLLLMHWAFATGLMQFGVFRISKD

SEQ ID NO: 14800 - protein, 332 aa, Gibberella zeae PH-1
MSFGRTVTLNSGWKIPQIGYGTWQAAPGEVGNGVYEALKAGYRHLDLAKIYQNQREVGEGIKKALSEVPGLKREDIFITGKLWNNKHRPEEVAGALDDTLEELGLEYIDLWLIHWPVAFKNGNQLFPLKEGDDGKTALDQEVTLSQTWEAVTKLPKEKVRSIGVSNFNKEMLEQIIKDTGVTPAMNQIERHPRLPQPELVKYLQEKGIFLTAYSAFGNNSWGEPLLINTPEVKAIAERLSKSKGKEVTPAQVILAWSTLDNHVVIPKSVTPARIRSNFEEVELDEEAVKELSKFGEKPQRFNIPKTYKPDWDINVFDDEKEKSATHQVVLKL

SEQ ID NO: 14801 - protein, 109 aa, Glycine max
  misc_feature (38)..(38): Xaa can be any naturally occurring amino acid
  unsure (1)..(109): unsure at all Xaa locations
LATSGDGTLSVCNLLRNKVQAQSEFSEDELLSVVLMKXDRFTDLSSNSIDAMLKLDEDRIITGSENRIINLVGILPNRVIQPIAEHSEYPVECLAFSHDRKVLGSISHD

SEQ ID NO: 14802 - protein, 181 aa, Arabidopsis thaliana
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 14803 - protein, 1142 aa, Saccharomyces cerevisiae
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQVKKRQSISSVSVSPSKKVSTTPQRRRNRESLISVTSSRKKPISFNKFTASSASSSNLTTPGSSKRLSKNFSSKKKLSTIVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEEKLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTATTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVDDMEPPLNKSVQKIREKNAGSQAKDHSKDHLKEHKQDKNTAIGNGSFFRKFSKSSDKTMELYAKISAKQLFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 14804 - protein, 663 aa, Burkholderia thailandensis E264
MTLLLLLASVAGVVVFRSLNLPPMLGYLTVGIVVGPHALGFAADLERAEHLAEFGVVFLMFSIGLEFSLSKLRAMRRLVFGLGLAQVLGTIAIALVLGALFERWMHITWEGSVALGGALAMSSTAIVSKMLAERLEIETEHGRNIFGVLLFQDLAVVPLLIVIAAFGGESSRDLALSLGFAAVKIVVALALLLIVGQRFMTRWLNVVARRRSQELFVLNLLLVTLGAAFITDRFGLSLALGAFIAGMLISETPYRHQVEEDIKPFRDVLLGLFFVTTGMLLDPSVIWRHPFLVLAFFVGQVLLKSVMITGLARAFGATPGVAMRTGLGLAQAGEFGFVLLNLILDRHLVDATLLQSILASMLLSMLAAPFLIQNADRIVMRLSAAEWMQQSLQMTRIATQSIKQKGHVIVCGYGRAGQNLARMLEQEGIAYVALDLDPDRVTAAAAAGESVVFGDAARRESLLAAGIHRAAAVAVTYANTPSALRVLHNVHELEPTLPAIVRTVDDADLEKLLAAGATEVIPEIVEGSLMLASHTLVLMGVPMRRVVRRVEEMRDERYSLLRGYFRGADDADDDDHEQVRLQSVPVDARADAVGRSLAELGLFALGIEVTAIRRHGIRGVEPDPETKLRASDIVVLRGLPEALAEAEERLSRHRREGGSTAAA

SEQ ID NO: 14805 - protein, 394 aa, Synechococcus sp. WH 8102
MTQLETRTEPMVVNFGPHHPSMHGVLRLVVTLDGEDVVDCEPVIGYLHRGMEKIAENRTNVMFVPYVSRMDYAAGMFYEAVVVNAPEKMADIPVPKRASYIRVLMLELNRIANHLLWLGPFLADVGAQTPFFYIFREREMIYDLWEAATGQRLINNNYFRIGGVAADLPWGWLEKCRDFCDWFGPKIDEYEKLITNNPIFRRRIEGLGTIEKQDAINWSLSGPMLRASGVPWDLRKVDHYECYDDFDWQVASEKEGDCYARYRVRIEEMRQSLKILRQACDMIPGGPTENLEAKRLNEGKGSDAAGFDFQYVAKKVAPTFKIPNGELYTRLESGKGEIGVFIQGNNDVTPWRFKIRAADSNNLQILPHILKGHKVADIMAILGSIDVIMGSVDR

SEQ ID NO: 14806 - protein, 135 aa, Nostoc sp. PCC 7120
MTQSENNGQLEANDSSSHSGSRYWGNVEVIEEGESYRISRIEIKPRHGIKPQIHYHRNEHWVVVSGVAKVTCGDDEVLLGRNQSTYVPAATLHKVDNPGSIPLVILEIQNGEYLGEDDTERPYDLNLVKPGVENK

SEQ ID NO: 14807 - protein, 516 aa, Medicago truncatula
MIAGMSLGSTGIVGNLIVYLTREFNIKSITATQISNVVVGSTSIFPVVAAIVADSFFGSFYVAFASSCILLLGTILLFLTETINSLKPHPCSKDSSTTCKPPTGIQYTVLYISILLISIGFGGSRFTAASLGANQFDKPEHQGTFFNWYFFTFYVASGAALTGIIYIEDNLGWAIGFGICAVAAFVGVVVFVLGYRFYRAEKPQGSAILDLGRVFVASARKWRCKLSSRAEDYYGSSSGHDVLVHVLPPPIPGKGLRFFNRAALITDADLHSNGTIKKSSWRLCTIQQVEDFKKIVGILPLWTSSLFLSIPIVMQMDFIILQALVMDRSLGYHFEIPAGSISVIVLISAPIFLTFLDRVLLPSWHKVTRKSPKLLHQIGVGHVFNVLGMVVSALVESKRLKLAHEHVSMSVLWLFPQLVLVGIGEAFHFPGQVTFYYQQFPQSLKSTSTATVSMLIGVAFYMSNALIDQVRRSTDWLPDDINHGKIDNVYWMLVLLGGINFVYYLFCSSPYKYENV

SEQ ID NO: 14808 - protein, 237 aa, Brassica napus
MSSLICRSASKAARSLLSSAKNARFFSEGRAIGAAGAVTASAKIPLYASNFARSSSGSSKSWITGLLALPAAAYMVQEQEVLAAEMERTFIAIKPDGVQRGLISEIVARFERKGFKLLVGIKVVVPSKDFAQKHYHDLKERPFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 14809 - protein, 289 aa, Arabidopsis thaliana
MSTALINSITYFLSEHPYIVGFRWSNSQSWGSTWSFLFTSISLYIAVSSSLHILLSAVRRSNRSVPLGHIPEIHSLLMSILSATIFAGILLSAAAEIRDTRWLWRRSKTATPLQWLLCFPLGTRPSGRVFFWSYVFYLTRFLHMFRTIFAVLRSRRLAVSQLFCNSVMAFTSFLWLEFSQSYQILAILSTTLVYSVVYGYRFWTGFGLPGSAFPSFVVNCQLVLVGCNLVSHAGVLTMHLFKGGCNGIGAWGLNSVLNGAILLLFLNFYVRMHSPMRRHINKMNSQRNA

SEQ ID NO: 14810 - protein, 772 aa, Novosphingobium aromaticivorans DSM 12444
MADAATEARTEGRTVRLQVAGARQEESGHGIARISRHVMSQLGVTEGDVIEIVGKRATAARVIQPYPEDEGLELIRLDGLQRANADVGSGEHVEVRKIDSRPAQRVVFAPAQKDLRLQGPAVALKRNFAGRPLVTGDLVATAGQQQVNRTDMPPQLRQMLNAPAFALTQIRLTVVSTSPKGVVHIDENTEVELRPEYEEPRSSRADVNYDDVGGMGDTIRQLREMVELPLRYPELFTRLGVDPPKGVLLHGPPGTGKTRLARAVANESDASFFTINGPEIMGSAYGESEKRLREVFEEATANSPSIIFIDEIDSIAPKRSEVHGEAEKRLVAQLLTLMDGLHSRSNLVVIAATNRPDAIDEALRRPGRFDREIVVGVPDESGRREILGIHTRGMPLAEDVDLQELARTTHGFVGADLAALAREAAIEAVRRIMPRLDFEQQTIPQDVLDSLRVERDDFLEALKRVQPSAMREVMVQAPTIGWADIGGLDEAQEKLREGVELPLKNPEAFHRLGIRPAKGFLLYGPPGTGKTLLAKAVAKEAEANFIAIKSSDLLSKWYGESEQQIARLFARARQVAPCVVFIDEIDSLVPARGSGQGEPNVTARVVNTILAEMDGLEELQSVVLIGATNRPNLVDPALLRPGRFDELVYVGTPSMSGREHILGIHTRNMPLAPDVDLALVARATDRFTGADLEDVVRRAGLNAIRRGGGNVDQVKASDFDEALEDSRATVTEQMEEEYGRMKGELKKRAMNPGPLGFIVPGMVQPTRESKHG

SEQ ID NO: 14811 - protein, 923 aa, Sesbania rostrata
MMELPDIWILRLAVACALCLYIFLRSASASEEFESIACCADSNYTDPLTTLNYTTDYSWFSDKRSCRQIPEAGLNNRSNENVRLFDIDEGKRCYNLPTIKNKVYLIRGTFPFDSTNSSFYVSIGITQLGAVRSSRLQGLEVEGVFRATKDYIDFCLVKGEVNPFISQLELRPLPEEYLHDLPTSVLKLISRNNLGGSKDDIRFPADRSDRIWKATSSPSSAFPLSFNVSNVDLQANVTPPLQVLQTAITHPERLEFIHNGLETEDYGYRVFLYFLEINRTLKAGQRVFDIYVNNEIKKEKFDVLDGGSNYGYTVLNVSANGSLNVTLVKASESEFGPLLNAYEILQVRSWVEETNQTDVEVIQKMREELLLQNQENKALESWTGDPCILFPWKGIACDGSNGSTVITKLDLSLSNLKGPIPSSVTEMTNLKILNLSHNSFDGYIPSFPLSSLLISIDLSYNGLRGTLPESITSPLHLKSLYFGCNQHMSEEDPANLNSSLINTDYGRCKSKEHKFGQGIVIGAITCGSLLVTLAVGILFVCRYRQKLLPWEGFGGKNYPMATNVIFSLPSKDDFFIKSVSIQTFTLEYIEVATERYKTLIGEGGFGSVYRGTLNDGQEVAVKVRSATSTQGTREFDNELNLLSAIQHENLVPLLGYCNENDQQILVYPFMSNGSLQDRLYGEPAKRKVLDWPTRLSIALGAARGLAYLHTFPGRPVIHRDVKSSNILLDHSMCAKVADFGFSKYAPQEGDSNVSLEVRGTAGYLDPEYYKTQQLSEKSDVFSFGVVLLEIVSGREPLNIQRPRNEWSLVEWAKPYIRASKVEEIVDPGIKGGYHAEAMWRVVEVALQCLEPFSAYRPCMVDIVRELEDALIIENNASEYMKSIDSLGGSNRYSIVIEKRVLPSTTSTAESTITAQSLSHPQPR

SEQ ID NO: 14812 - protein, 323 aa, Staphylococcus aureus subsp. aureus Mu50
MSKYSQDVLQLLYKNKPNYISGQSIAESLNISRTAVKKVIDQLKLEGCKIDSVNHKGHLLQQLPDIWYQGIIDQYTKSSALFDFSEVYDSIDSTQLAAKKSLVGNQSSFFILSDEQTKGRGRFNRHWSSSKGQGLWMSVVLRPNVAFSMISKFNLFIALGIRDAIQHFSQDEVKVKWPNDIYIDNGKVCGFLTEMVANNDGIEAIICGIGINLTQQLENFDESIRHRATSIQLHDKNKLDRYQFLERLLQEIEKRYNQFLTLPFSEIREEYIAASNIWNRTLLFTENDKQFKGQAIDLDYDGYLIVRDEAGESHRLISADIDF

SEQ ID NO: 14813 - protein, 270 aa, Burkholderia thailandensis E264
MKIAFIGGGNMAAALIGGLVRRGVAASELLAVDINEDARQRAQAQFGVRTAAAIDATLAGYDAIVLAVKPQVLKEIATALAPHLSTQLVVSIAAGIRGADLSRWLGDYARVVRTMPNTPALVGLGVTGLSALPGVDAAGRDLASKVLGAVGETVWFDDESQLDAVTAISGSGPAYVFYFIEALQEAARQLGMNDEQGRALAVATFAGAAQLAVQSGEPASVLRERVTSKGGTTAAALASFDAQHVKDSIVRGVLAAQARAKEMGDELGAA

SEQ ID NO: 14814 - protein, 400 aa, Triticum aestivum
MEALHEETPFDLSFHPSAPLVATSLITGELHMFRYADGLPLERLFVAKPHKDSCRAVRFVDSGTAILTGSADMSIVASDVETGKVIARLDNAHDDAINRLVCLTETTVASGDDDGYIKVWDTRQRSCCNTFHRHEDYISDMTYVAGSNQILATSGDGTLSVNNLRANRVKSQSEFSEDELLSVVVMKNGQKVVCGTPSGALLLYSWGHFKDCSDRFLGHAQSVDNLLKLDEETLISAAADGVIRLVGILPNQIIQPLAEHSEFPIEALGFSHDRKYLGSISHDKMIKLWDMEELLGGPQLNHQNDMPEANAAVHDDELPEANAAIHHDELPEANAAAGQHDELPAANAAAVNHNQPTEADSDDDGMDVDMEPSSSNVSRSKKKGKGKRLDGFAPDFFADL

SEQ ID NO: 14815 - protein, 308 aa, Triticum aestivum
  misc_feature (204)..(204): Xaa can be any naturally occurring amino acid
  misc_feature (222)..(222): Xaa can be any naturally occurring amino acid
  unsure (1)..(308): unsure at all Xaa locations
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAXASFNIIPSSTGAAKAVEXEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 14816 - protein, 338 aa, Gibberella zeae PH-1
MSAQLKHKAVWEASPLAFLSRQFIEGVPNIPKNVNLSGQTALITGSNVGLGFESARQLLALDLSHLIIAVRNQARGDAAAKKLRNEFPNAKIQVSLVDMASYKSIQSLVEWCETLSRLDIAILNAGLSRPQFERSEASKHEMTHQINYLSTALLTILLIPVLKTKRGTSGPAHLSIVGSDMSYWAQWTGTNDSIWDVIDDPAHFSSNGAYQISKLLLIMFVDKISQHVSPQEVIVNYPNPGACRGTEFGNDGNSGLVEKIWMAFAKPIIGRTVATGARSYVDAVAVKGIESHGSFIGEGKIKPFPVMMYEPAGKMLQETAWKDLMEELSFAKPMEILK

SEQ ID NO: 14817 - protein, 408 aa, Bradyrhizobium japonicum USDA 110
MPGLNRTRDTTLRARAEKVVPGGMWGHLHAAKLPDGYPQFFRRGEGGVLWDVDGNRYVDFMCSWGPNLLGHHHPEVEEAAERQRREGDCLNGPAEVMVELAELVVDMVGHADWTQFQKNGTDATTTCVTIARAATGRRKILVAKGAYHGAVPWCSPSLLGVTAEDRAHLAYFTFNDVESLEVAAKAAGDDLAGILVSAYRHDLGLDQELPTVEFAHAARRICDDRGAALIIDEVRAGLRLNAAGSWEGLGVRPDLSAWSKAIANGYALAAVTGANWLRGAASQVFVTGSFWAGAVAMAAAVATLKIVRRDNVPSRLAQLGQMLREGLETRSRQFGVSIRQSGPAQMPTLLFDQDPAYRKGSAFCSAMLARGVYFHPKHNMFLCAAHTEADIAEALQAAEHGFAVVAGL

SEQ ID NO: 14818 - protein, 221 aa, Zea mays
PRVRPRVRPRVRPRVRPRVRQTKVFYFDIGENKRGRFLKVSEASVNRNRSTIIVPAGSSGEEGWEAFRSVLLEINNEATRLYVLPNHPNQQHMEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVEPSQR

SEQ ID NO: 14819 - protein, 421 aa, Prosthecochloris aestuarii DSM 271
MSEKKIDSIESAIEDLKNGKLIIVIDDEDREDEGDFIAAADKVTPEMVNFITKEARGLLCVAVTMDRAKELQLDPMVQRNTSQHETNFTVSVDALAEGVTTGISAFDRYMTIKMLADPVSHADNFSRPGHIFPLRAMDGGVLRRVGHTEAAVDLAELAGSTPVGLLCEILHDDGSMARLPELLKIKEKFDLKLITIKDLVAYQMKRKKLVARAVETSLPTRHGDFRLIAYEACCDSQQQNHLAFVKGDFSTDEPVLVRVHSQCATGDIFASLRCDCGNQLASAMQQIEKAGKGVLIYLMQEGRGIGLINKLKAYNLQDQGFDTVEANEQLGFKADLRDYGIGAQILQDLGVKKMRLLTNNPKKIVGLEGYGLEIVERVPIEIAPNSVNLSYLETKRDKMGHMINCSCNCSGVSQQDNHTQQ

SEQ ID NO: 14820 - protein, 199 aa, Brassica napus
MEKSTRTLMIITIVITSMLVGFGSSDLDQDREECTDQLIALSPCLPYVGGNAKAPTKDCCGGFDQVITKSEKCVCILVKDKDDPNLGLKFNATLAAHIPTLCHITAPNITKCISLLHLSPNSTLAKEFESLGRIEYEGKTNSTSPLQNVTDGAGGGKAESVKSDGGKKKKSWLAVELLIFALFSHLLLVISSFTSSSFI

SEQ ID NO: 14821 - protein, 282 aa, Lactobacillus sakei subsp. sakei 23K
MTIQWYPGHMAKAQKQIKERLKAVDLILEIVDARVPESSINPMIQELGQNKPILLIMNKADMADPRRTQQWIETFKKRGITAIALDAQHKAKLPMIEKVAQEILAEKLAKKRAKGIRNPVIRAMCVGVPNVGKSTILNRLVQKNIAVTGNRPGVTKNQQWLKAGQTLELLDTPGVLWPKFEDPTIGSKLALTGAISDAIYHPDDVVIFALEHFKEYYSSQLQKVYKVTDAELEEPAAELIMILTKRLGFKEDYDRFCVKFINDARQGKLGRFTLDVVPVEAS

SEQ ID NO: 14822 - protein, 508 aa, Halobacterium sp. NRC-1
MQAALVILDGWGLGDHDRRDAVRAADTPTFDEYAERGAFGTLTTSGRDVGLPDGQMGNSEVGHLTIGAGRVVKQAYTRIEDAIAAGDLCGNDAISGALDHVADTGGTLHVMGLVSDGGVHADQQHIHALVECAAGRGVEAAVHAFTDGRDTSPTGGEDYLADLEAVADEHGTGDVASVSGRYYAMDRDQNWARTKRAYDAITRSDGVAHHAAAAVDAVTDSYERGDTDEFVEPTTIEGGAALSDGDAVVFANFRADRARQLTRLLADIHPADWDADGIETNPPAVPVVTMTEYDETFDCPVAFPAAEPTDTLGAVLAAHDHTQLRVAESEKYAHVTYFLNGGREVAFDGETRTIVDSPDVPTYDEQPAMSAPAVTDTVLDALAGDDPDVLVLNYANPDMVGHTGDFDAAIEAVEAVDRELGRLVPALNDAGAHAFLTADHGNADDLGTPADPHTAHTFNPVPFVSLPPASGDTAAVRDGGALRDIAPTLLDVLGIDRPTVMTGASLLE

SEQ ID NO: 14823 - protein, 297 aa, Lactobacillus sakei subsp. sakei 23K
MEDIANPERTKKILKRYGFKFKKSLGQNFLTNITILKQIVEAGEITKDDDVIEIGPGIGSLTEQIARKAHQVLSFEIDDRLIPVLKDTLNHYHNVTVLNQDILEADLPTLIAKHFDGQHNLKIVANLPYYITTPIMLHLLEAGLPIDRMVLMMQKEVAERIDAAPGSKAYGSLSIAVQLHSEVKLAFIVPKTAFVPQPNVDSAIVEFVGRQEPLVTVQNQQLFDQLVRGAFAQRRKTLWNNLQNQFGKQEEVKAGLVAALDQADIAPSTRAEQLSIQQFAQLSDCLNEQPVFAKKRG

SEQ ID NO: 14824 - protein, 336 aa, Legionella pneumophila str. Lens
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVTPFSDPEEVADYTISVFRNNVPASVPTINFLSGGQTPQQATANLNAINQIGHQPWLLSFSFGRALQEDCLKEWCGNKANIAKAQEALIKRARLNSMACLGEYQNDME

SEQ ID NO: 14825 - protein, 190 aa, Zea mays
HEPKLTSLVKCNDPTRDKIRELLAEAFAKVPRETSNDDRDEVRNILDEVDACDPFRVAVTVESALFERFGRSTGAHKAKYRSIMFNLRAENNTDFRRRVLIGQVTPERLPDISPDEMASDARKQENLQIKEKALFDCERGAAPKATTDQFKCGRCGQRKTTYYQLQTRSADEPMTTFVTCVNCNNHWKFC

SEQ ID NO: 14826 - protein, 488 aa, Xylella fastidiosa Ann-1
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDATQVGVSYLGLPQDVAAGDVLLLDDGLMQLQVVQVQGARIVTTVLNDGVLSDRKGLNKQGGGLSLGALTDRDRELIRIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 14827 - protein, 227 aa, Methanocaldococcus jannaschii DSM 2661 [sequence omitted]

SEQ ID NO: 14828 - protein, 194 aa, Lycopersicon esculentum
MVDLARVQKELHECNRDVQVSGINVTLKGDSLTHLIGTIPGPVGTPYEGGTFKIDITLTDGYPFEPPKMKFATKVWHPNISSQSGAICLDILKDQWSPALTLKTALLSIQALLSAPEPDDPQDAVVAQQYLREHQTFVGTARYWTETFAKTSTLAADDKIQKLVEMGFPEAQVRSTLEANGWDENMALEKLLSS

SEQ ID NO: 14829 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 14830 - protein, 123 aa, Oryza sativa
RIGRYLKQGRYSQRIGTGAPVYLAAVLEYLAAKVLELAGNAARDNKKNRIIPRHVLLAIRNDEELGKLLAGVTIAHGGVLPNINPVLLPKKTGSAAAKEAKEGKTPKSPKKATTKSPKKAAAA

SEQ ID NO: 14831 - protein, 228 aa, Parvularcula bermudensis HTCC2503
MSDDKKQRAAAAALAHVRPGMTLGLGTGSTAAHFVKLLGDQGFEGQAIPTSEETARLAEAVGISLITPDETTRIDLAVDGADEADPSGALIKGGGGALLREKIIAQQAQTFIVIADDGKDVVQLGQFPLPVEVTGFAVGLTIQAIRSTLAALGYEDPSLTLRRGEGGFFQTDGGHLIVDIALGRIDEAEPLDAALTMIPGVVTTGLFVGLTDLMIFGTESGVREAVPT

SEQ ID NO: 14832 - protein, 426 aa, Triticum aestivum
MSSAMESSYLPATTESIEKAQEAKDASESISILYRVIQDPSSSADALRIKELAITNLTNYLTKENRAEDLRNLLTQLRPFFSLIPKAKTAKIVRGIIDAVAKIPGTSDLQISLCKEMVEWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEKDYKTAYSYFFEAFEAFNALDDPRAIFSLKYMLLCKIMVNHADDVAGIISSKASLKYVGPDVDAMKAVADAYSKRSLKYFETALRDYKAQLEEDPIVHRHLSSLYDTLLEQNLCRLIEPYSRVEIEHVAQMIELPVDHVEKKLSQMILDKKFAGTLDQGAGCLIIFEEMKTEAIFPATLETISNVGKVVDSLYMRSAKIMA

SEQ ID NO: 14833 - protein, 330 aa, Anabaena variabilis ATCC 29413
MNWLFSTLVFFLTLLAAGIALYLITARRYQSSNSVANSYDQWTEDGILEFYWGEHIHLGHYGSPPQRKDFLAAKSDFVHEMVRWGGLDKLPPGTTLLDVGCGIGGSSRILARDYGFAVTGITISPQQVQRAQELTPQELNAQFLVDDAMALSSPDGSFDVVWSIEAGPHMPDKAIFAKELMRVLKPGGIMVLADWNQRDDRQKPLNIWEKPVMQQLLDQWSHPAFSSIEGFSELLAATGLVEGEVITADWTKQTLPSWLDSIWQGIVRPEGLVRFGLSGFIKSLREVPTLLLMRLAFGMGLCRFGMFRALRANTVTPPAEQTTGIKVAQR

SEQ ID NO: 14834 - protein, 369 aa, Pseudomonas syringae pv. syringae B728a
MAFDRIEDIIEDYRQGKMVLLVDDEDRENEGDLLLAADCCSPQAISFMAREARGLICLTLTDEHCQRLGLEQMVPSNGSVFATAFTVSIEATTGVTTGISAADRARTVQAAVNPHAVPEDLVQPGHIFPLRARDGGVLTRVGHTEAGCDLARLAGFTPASVIVEVMNDDGSMARRPDLEVFAKKHGIRIGTIADLIHYRLSTEHTIVRIGERELPTVHGTFRLFSYEDRIEGGVHMAMVMGDIRRDAATLVRVHVVDPLRDLVGAEYNGPANWTLWAALQRVAQEGHGVVVVLANHESSQALLERIPQLTQPPRQYTRSQSRIYSEVGTGAQILQDLGVGKLRHLGPPLKYAGLTGYDLEVIESIPFPG

SEQ ID NO: 14835 - protein, 468 aa, Oceanobacter sp. RED65
MSENTLKLIKDNDVKWVDLRFTDTKGKEQHVTIPAKDVDEEFFEVGQMFDGSSISGWKGINESDMILLPDDTTPFLDPFTEDATLCLRCDIIEPSTMQGYERDPRSVAKRAEEYLQSTGLGDTAFFGPEPEFFIFDDVRWGADMSGTFYKINSEEAAWNTEAVMEGGNMGHRPSVKGGYFPVPPVDSSHDMRAAMCNTMMAIGLDVEVHHHEVATANQNEIGVKFNTLVKKADEVQMLKYVVHNVAHAYGKTATFMPKPVVGDNGSGMHVHQSFWKDGENQFAGDSYSGLSETALYYIGGIIKHAKALNAFTNPSTNSYKRLIPGFEAPVMLAYSARNRSASIRIPYVASPKGKRVEARFPDPTANPYLAFAAMLMAGIDGVKNKIHPGDAADKDLYDLPAEEAAQIPQVAGSLREALGALEADMDFLVEGGVFTKDMIEAYIELKMEDVYRVEHTTHPAEFDMYYSL

SEQ ID NO: 14836 - protein, 323 aa, Trichodesmium erythraeum IMS101
MKENHKSTVVITGASSGVGLHAAKALAKTGEWYVVMACRDISKAEKVAQEVGMTQDSYTVMHLDLASLEVVKRFVKTFRESGRSLEALVCNAAVYLPLLKEPMRSIDGYEISVATNHLGHFLLCNLMLEDLKKSPAKDKRLVILGTVTANPKELGGKIPIPAPPDLGNLQGFEQGFKTPISMINAKKFKSGKAYKDSKLCNVLTMRELHRRYYKSTGIVFSSLYPGCVADTPLFRNHYPLFQKLFPLFQKNITGGYVSQDLAGERVAAVVKDPEYKESGIYWSWGNRQKKDRKSFVQEVSDEASDDDKAIKLWELSSKLVGLS

SEQ ID NO: 14837 - protein, 389 aa, Arabidopsis thaliana
MSCFLGPSTNNKSRENEGSSMAAPYEQQNLPRNDRRQITTWEAVGTNKESPKNIKAKSFKFRELATATNSFRQEFLIGEGGFGRVYKGKMEKTGQVVAVKQLDRNGLQGNREFLVEIFRLSLLHHPNLANLIGYCLDGDQRLLVHEFMPLGSLEDHLLDVVVGQQPLDWNSRIRIALGAAKGLEYLHEKANPPVIYRDFKSSNILLNVDFDAKLSDFGLAKLGSVGDTQNVSSRVVGTYGYCAPEYHKTGQLTVKSDVYSFGVVLLELITGKRVIDTTRPCHEQNLVTWAQPIFREPNRFPELADPLLQGEFPEKSLNQAVAIAAMCLQEEPIVRPLISDVVTALSFMSTETGSPSGLTGTALNPLSPKTVEDQGWLQCESPRDVYSLL

SEQ ID NO: 14838 - protein, 309 aa, Saccharomyces cerevisiae
MDSKEVLVHVKNLEKNKSNDAAVLEILHVLDKEFVPTEKLLRETKVGVEVNKFKKSTNVEISKLVKKMISSWKDAINKNKRSRQAQQHHQDHAPGNAEDKTTVGESVNGVQQPASSQSDAMKQDKYVSTKPRNSKNDGVDTAIYHHKLRDQVLKALYDVLAKESEHPPQSILHTAKAIESEMNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 14839 - protein, 632 aa, Oryza sativa
MASRAPCLLAARGIASSPHLARRLKQTENEIVQMFRTPSPRNEDAVAALSPRYTNSVRVLDERFIRILKIFKWGPDAERALEVLMLRVDHWLVREVMKTDVGVNVKMQFFRWAAKKRNYQHDTSTYMALIHCLELVEQYGEMWKMIQEMVRSPICVVTPMELSQVIRMLGNAKMIGKAITIFYQIKARKCQPTAQAYNSMIIMLIHEGQYEKVHELYNEMSNEGHCHPDTVTYSALISAFCKLGRQDSAIRLLNEMKENGMQPTAKIYTMIISLFFKLDNVHGALSLFEEMRYMYCRPDVFTYTELIRGLGKAGRIDEAYHFYHEMQREDCKPDTVVMNNMINFLGKAGRLDDGLKLFEEMGVSHCIPNVVTYNTIIKALFESKSRVSEVFSWFERMKGSGISPSPFTYSILIDGFCKTNRIEKAMMLLEEMDEKGFPPCPAAYCSLIDALGKAKRYDLACELFQELKENCGSSSARVYAVMIKHLGKAGRLDDAINLFDEMSKLGCTPNVYAYNALMSGLARACMLDEALTTMRKMQEHGCLPDINSYNIILNGLAKTGGPHRAMEMLTNMKNSTIKPDAVSYNTVLSALSHAGMFEEAAELMKEMNALGFEYDLITYSSILEAIGKVDQE

SEQ ID NO: 14840 - protein, 336 aa, Legionella pneumophila subsp. pneumophila str. Philadelphia 1
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVAPFSDPEEVADYTISVFRNNVPASVPTINFLSGGQTPQQATANLNAINQIGHQPWLLSFSFGRALQEDCLKEWCGNKANIAKAQEALIKRARLNSMACLGEYQNDME

SEQ ID NO: 14841 - protein, 796 aa, Escherichia coli
SQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGAVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLRILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAAR

SEQ ID NO: 14842 - protein, 366 aa, Pyrenomonas helgolandii
DNGSGMVKAGFAGDDAPRPVFPSIVGRPRHQGVMVGMGQKDSYIGDEAQSKRGILALKYPIEHGIVTNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDIKEKLCYVALDFEQEMQTAAQSSSIEKSYELPDGQVITIGNERFRCPEVLFQPSFIGLESAGIHETTYNSIMKCDVDIRKDLYGNIVLSGGTTMFSGIADRMQKEITALAPSTMKIKIIAPPERKYSVWIGGSILASLSTFQQMWISKQEYDESGPSIVHSKCFS

SEQ ID NO: 14843 - protein, 366 aa, Guillardia theta
  misc_feature (324)..(324): Xaa can be any naturally occurring amino acid
  unsure (1)..(366): unsure at all Xaa locations
DNGSGMVKAGFAGDDAPRAVFPSIVGRPRHQGVMVGVGQKDSYIGDEAQSKRGILTLKYPIEHGIVTNWDDMEKIWHHTFYSELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDIKEKLCYVALDFEQEMQTAAQSSSIEKSYELPDGQVITIGNERFRCPEVLFQPSFIGLESAGIHETTYNSIMKCDVDIRKDLYGNIVLSGGTTMFSGIADRMQKEITALAPSTMKIKIIAPPXRKYSVWIGGSILASLSTFQQMWISKQEYDESGPSIVHSKCFS

SEQ ID NO: 14844 - protein, 93 aa, Zea mays
MAAAAATKASSWMVAMSVGAVEALKDQGGLCRWNYALRSVHRTAKANVRSSRSFAAQRDKELTPAAQKGRQEDKAAAEEGLRTVMYLSCWGPN

SEQ ID NO: 14845 - protein, 192 aa, Glycine max
SPLHTSHQNGSSLHQSPATPSPAKSRPIQVRSASPRCVRDDRSYHTSQTPSLRSNYHYTGNLYQNGRIVSTGTSSGGATATLPNYMAATENSARGIRSQSAPRQRPSTPERDRVGSAKKRLSFPAPDPYGVGVSYGNYGHSLRSPSFKSVSGSHFGGLEQQSNYSSCYTESIGGGGGEVSPSSTGDLRRWLR

SEQ ID NO: 14846 - protein, 338 aa, Paracoccidioides brasiliensis
MVVKVGINGFGRIGRIVFRNAVEHDDVEIVAVNDPFIETKYAAYMLKYDSTHGQFKGDIQHSSSNNLTVNNKTIHFYQERDPANIPWGKHGVDYVVESTGVFTTTEKAKAHLSGGAKKVIISAPSADAPMFVMGVNEKSYRPDISVLSNASCTTNCLAPLAKVIHDNFGIAEGLMTTIHSYTATQKTVDGPSHKDWRGGRTAAQNIIPSSTGAAKAVGKVIPALNGKLTGMAMRVPTANVSVVDLTCRTEKPVTYDQIKAAVKAASEGELKGILGYSEDALVSTDLNGDPRSSIFDASAGIALNDRFVKLISWYDNEWGYSRRVLDLIAYIAKVDAGK

SEQ ID NO: 14847 - protein, 379 aa, Pseudomonas syringae pv. syringae B728a
MKAIVYSGPRDVSVKNVPDAKIQKPTDALVRVTSTNICGSDLHMYEGRTSFETGRIFGHENLGQVIEVGAGVDRIKVGDWVCLPFNIGCGFCENCEKGLTGYCLTANPGSAGAAYGFADMGDHEGGQAELLRVPYADFNCLLLPEDAAEREEDYVMLSDIFPTGWHATELAGLLPGESVAIYGAGPVGLMAAHSAMIKGASQVFVVDNHPDRLALAAKMGATPINSLEQGAVDQILNLTDGKGTDRGCECVGYQCCDRHGHEANHVTMNNLVASTKATGGIGVVGVFVPQDPGAKSDLAKEGKMAFDFGSFWFKGQQIRTGQANVKAYNRRLAELIHHGRAKPSQIISHRLKLEEGPDAYKHFDARDEGWTKVVLKPGA

SEQ ID NO: 14848 - protein, 475 aa, Bordetella bronchiseptica RB50
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLARFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 14849 - protein, 476 aa, Pseudomonas syringae pv. syringae B728a
MYPDVQLYIDGQWRASRDNRTLSVINPATGEALGAVAHAGIADLDEALAAAERGFATWRATSAYDRYKLMQKAANLVRERADSIARIMTQEQGKPLAEARMETLSAADIIDWLAEEGRRSYGRLVPSRNVSIEQKVIKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTEKFVGLTREIKVGNGLEAGTTMGPVANDRRIPALVDLIDDAVRGGATLSAGGKAGEGPGYFFEPTVLSGLKPHMRIMNEEPFGPVALLVPFDTLEEAIAESNRVPFGLASYAFTTSMKTAQALSTYIEAGMLSINHQGIGLPEVPFGGIKDSGYGSEGGTEAIEAYLNTKLVTQYN

SEQ ID NO: 14850 - protein, 288 aa, Synechococcus sp. WH 8102
MSTPAIQWYPGHIAKAEQQLSRHLDKVDLVIEVRDARIPLATGHPHLDRWLKGKQHLLVINRRDMVTPAAREAWEAWFKGRGQRTVWCDAKAGTGVKQVQQAAIRAGDQLNERRRNRGMRPRPVRALTLGFPNVGKSALINRLVKQKVVASARRAGVTRTLRWVRLGQDLDLLDAPGVLPPRLDDQQAALHLALCDDIGQAAYDGELVAQAFLQLLIDLQQQQASGVAIPVLESRYGIPVQGETADPPYWLEAAAQRHTSGDTARMAQRLLDDFRKSALGSIALELPE

SEQ ID NO: 14851 - protein, 337 aa, Oryza sativa
MVPKVGINGFGRIGRIVFRNAINHGGVDVVAVNDPFIEVHYAAYMLKYDSTHGQFKGTIEIDGTSGLIVNGKKIRFYAERDPASIPWSETGAAYVVESTGVFTTTEKASAHLKGGAKKVIISAPSADAPMFVMGVNNDSYKSDVNVLSNASCTTNCLAPLAKVINDKYGLVEGLMTTIHSYTATQKTVDGPSAKDWRGGRTAAQNIIPSSTGAAKAVGKVIPSLNGKLTGMAMRVPTANVSVVDLTCRIEKAATYEDIKATIKAASEGELKGILGYTEDDIVSSDLNGDDNSSIFDAKAGIALNPNFIKLVSWYDNEWGYSHRVVDLIAYIAKVDGQ

SEQ ID NO: 14852 - protein, 94 aa, Aspergillus nidulans FGSC A4
MSSKYVFTKGLKELRFLLCQTSEQSAATRLFINRAYPTMKKHNPHTPILIREAAGTLPRVYARYALGKEKVESLNGLSDQQIEEKVKQLVKESS

SEQ ID NO: 14853 - protein, 107 aa, Burkholderia sp. 383
MQILTAAMLAEWLGDKARPAPVVLDVREPWEIATAHIAGSVSIPMQQIPARSEELDDEAEIVCVCHHGMRSAQVAMFLESRGFTKLYNLQGGIDAWSRDVDPSVPRY

SEQ ID NO: 14854 - protein, 436 aa, Saccharopolyspora spinosa
MASPNPLRALDEVWRDTYYRRTARSRKANEAAEKFVAKGQRARFNSGMPYPVYIERGAGSHFTDLDGNDFLDCNAGWNAAFLGRGNPTVSATVQEAMAKLGAPGGAMHPSLIRDEFAELLCERVPGAERVIFAPSGSEANTYALRLARSFTGKQKVIRMAGGFHGQHDALLGAQSSKAGTASTAQDNVITVPFNDLDAARSALAEHAGSVAALITEPMMTIPGAVHQRDQFLAGLRAATRQHHVVFVLDEVITGCRFAVGGASEFYDFAAPDLTVMGKMLGGGLPTAAVVGRADIIEQPISASNTHAQNPVTLAAAVAAMRVTEADGYARVAKMGDRLRRELRAVTDELTTPVQVTGDGPCVGIHFVDEEVVDFATAERADHSLWQLLCLGIASHGLGLSSRTFGPTLAWTESDLDVAVKGFSSTLEAISTACASN

SEQ ID NO: 14855 - protein, 295 aa, uncultured archaeon GZfos13E1
MNGKKATGKEKGKTKRKREKIGIIGVGNIGASILRGLLTAEPTSKIFITDAENEKRRFFEADLGTDSGVVVCKTNEEVAENAEVTILAVKPNDMLVVVKEIAPFMNEDKILISVAAGVPTAAIDGYLGEAKARGRKVIRVMPNIGACVREAVCAICKGKYADEADEEIAKEILSAIGTVHSVNEGDMDVITGLSGSGIAFVATVIDAMADGAVYEGLPRELSLTIAAQTAIGAAKMILEGKQPSEIVTMTASPGGTTIRGIYTMESRNVKAAMMEAVIEATRRATEISKQGSMKN

SEQ ID NO: 14856 - protein, 403 aa, Saccharopolyspora spinosa
MITKVSNHSEDAASLTERARNVLPGGITRSTVYVPPHPPYAATGSGALVQDVSGHVLVDCNNNYTSLIHGHSSRQEIVEAAVSATRSGTAFGLPTRHEVDFAEYLAARTGVEKWRFCNSGTEAVLMMLRAARAFTQRDTIIRFAGSYHGTGDEVVDPKAAGVPKWVEESVLVVPQGDLDALKDALREHGNRVAAVLIDLMPNRAGLNPATREFVQELRALTRRYGVLLAIDEVISFRLSWGGFHQHYGVEPDLISTGKIIGGGFPVGAVGGKAGFLREFDPARAGAVMWGGTFSANPVTMVAGLTALRLFDQDAISALNAKGESMRGDLEAAGVRVNGFGSLLRIMTSDTKALWWSLYERGVLAGSNGLLALSTAMNDKHLSHVIEAVAEGARNVGDTGTPEQ

SEQ ID NO: 14857 - protein, 263 aa, Glycine max
LTSIPDELIKNAKYIATPGKGILAADESTGTIGKRLSSINVENIEANRQALRELLFTAPDALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAAVYKALNEQHVLLEGTLLKPNMVTPGSDSPKVTLNIFKIIHPYVWIHSIVEYLLVFEIKLE

SEQ ID NO: 14858 - protein, 316 aa, Rubrivivax gelatinosus PM1
MSHSVVFLDRESLKAKVRKPAQAESYVEHAKTSVDEVVAKLQGATVAITNKVPLRAETLKQLPQLKMIAVAATGYDVIDVPYCKEHGIAVANIRNYAVHTVPEHAFALILALRRNILAYRQDVEAGVWQKSDQFCFFTHDIGDLHGATLGIIGEGAIGQGTAAIARGFGMKVLFADHEPPKMPGVEFTPFEQVLAESDVISMHCPLTPSTRNLIGLEQMRRMKRNALLINTSRGGLVDEAALIQALDEGLIAGAGFDVLTTEPPKNGHPLLDVRRPNFILTPHVAWASDGAMQFLADQLIDNIDRWAEGRPQHLVT

SEQ ID NO: 14859 - protein, 619 aa, Chlorobium tepidum TLS
MILLCFPGSEQGIGMHQFEFLGQLVLIGALAIVNILVFQKIRIPPVIGLIFTGIMLGPTGFHVIRNSGLISTLAEMGVVLLLFTIGLEFSADDLKKLRKIVLFGGTAQILLTGLVIAMFSYWLMDAIGKSVGSKEALVLGFSFSVSSTALCLKILSDRGELGFDHGKIALGILIFQDMAIVPLMFGFSFLTRGSSMPLESSFEEIALLLLFAIGMFGGFRLLMPKIVRIITELHAGEVLVLGALVLCFGAAWLASLIGLSLALGAFMAGMVIASTDGSHRISRTIDPFREAMTSIFFVSVGLLLDVNMIELPWLIAIALVVLVVKGLIMTGILMALGFSLRVSLMSGMVLAQIGEFSFVLAGTAKDAGLLDQHMFQSMLAVIVVTMIVTPALISAAPKFAAQVAPALGFMPLASKPEPKQPARAAAGPIVCRGEIHAAIIGFGLIGRNIAAVMNATNLNYTVLDTDRKTVKTMRRQGEPLFYGDCTERKSLLRIGVDHSRAVVICIPEIDAAIQCIRLVREINPGAFIIVRSRSLESTNRFYRAGADAAVTELFETSIQMFSELLKHFRVEPETILAQQEIIRREGGNIFRELVTETDGSGDDPAKKSQNGAGFVTSET

SEQ ID NO: 14860 - protein, 428 aa, Silene latifolia
  misc_feature (276)..(276): Xaa can be any naturally occurring amino acid
  misc_feature (417)..(417): Xaa can be any naturally occurring amino acid
  unsure (1)..(428): unsure at all Xaa locations
RWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDXRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACXPTPTKDVNHSA

SEQ ID NO: 14861 - protein, 317 aa, Pichia guilliermondii
MSIKLNSGYDMPSVGFGCWKVDNATCADTIYNAIKVGYRLFDGAEDYGNEKEVGDGINRALDEGLVARDELFVVSKLWNSFHDPKNVEKALDKTLSDLKVDYLDLFLIHFPIAFKFVPFEEKYPPGFYCGDGDKFHYEDVPLIDTWRALEKLVEKGKIRSIGISNFSGALIQDLLRSAKIKPAVLQIEHHPYLQQPRLVEYVQSQGIAITAYSSFGPQSFVELDHPRVKDVKPLFEHDVIKSVAGKVKKTPAQVLLRWATQRGLAVIPKSNNPDRLLSNLKVNDFDLSQEDFQEISKLDIELRFNNPWDWDKIPTFI

SEQ ID NO: 14862 - protein, 159 aa, Oryza sativa
MDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAAAAGKEAKSPKKAAGKSPKKA

SEQ ID NO: 14863 - protein, 508 aa, Arabidopsis thaliana
MLNAIILILFPIIGFVLIFSFPTKTLKAKTASPSNPISYPLIGSILSFNKNRHRLLQWYTDLLRLSPSQTITVDLLFGRRTIITANPENVEHILKTNFYNFPKGKPFTDLLGDLLGGGIFNSDGELWSSQRKLASHEFTMRSLREFTFEILREEVQNRLIPVLSSAVDCGETVDFQEVLKRFAFDVVCKVSLGWDPDCLDLTRPVPELVKAFDVAAEISARRATEPVYAVWKVKRFLNVGSEKRLREAIKTVHLSVSEIIRAKKKSLDIGGDVSDKQDLLSRFLAAGHGEEAVRDSVISFIMAGRDTTSAAMTWLFWLLSQNDDVETKILDELRNKGSLGLGFEDLREMSYTKACLCEAMRLYPPVAWDSKHAANDDILPDGTPLKKGDKVTYFPYGMGRMEKVWGKDWDEFKPNRWFEEEPSYGTKPVLKSVSSFKFPVFQAGPRVCIGKEMAFTQMKYVVGSVLSRFKIIPVCNNRPVFVPLLTAHMAGGLKVKIKRREQCDSMYI

SEQ ID NO: 14864 - protein, 171 aa, Sporobolus stapfianus
MASASKEEVIGKLNVRVVRGSNLAICDPLTHTSDPYVVLHYGAQKVKTSVQKKNPNPVWNEVLQLSVTNPTKPVHLEVFDEDKFTADDSMGVAEINLTDIYDAAKLDLKHAADGTRIKTIYPVGVNYLGGESHVMWKDGKVVQDLILKLTKTDSGLITLQLEWVHVPGVKL

SEQ ID NO: 14865 - protein, 118 aa, Arabidopsis thaliana
MIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHRFDLLPNTILDFANSNHQSIMW

SEQ ID NO: 14866 - protein, 481 aa, Glycine max
MGIVRGVILDESVLLAESGDDKTVSLLRPGAESLIRTLFLSRTHSGISYGVGLPDDKASVLQKIASLYSLDCFILNDSVSEVMPGWSNTDDGSIIIYLISDKKEFLPKLSSYNWLVVVLNVGGESLCHNPNILQIENLEEFPLTICHLNKRSIGTNAVTVSYTMKPSRVEDFAKRGAFPLCPTQNGLMFVPLASKLPLSSQLKGVDIVLHKATDEILSIEDNNITFTQNIQALQRYLDQHQDFCVIDPLSNVYPLLDRLEIQQVLLGLVELNTEGKYLIRGAHFLKADNFDEFDFATGLAEARLSLPCIVKPKVACGVSDAHKMAIVFKVDDFKNLSVPLPAVIQEYVDHSSTLYKFYVLGEKIFYAVKKSIPNADILRKSSNGDELKPLLFDSLKSMPTADSITSNEPIDLKLVTDAANWLRRRLQLTIFGFDVVIQEGTHDHVIVDVNYLPSFKEVPDDISIPAFWDAIRNKFDSRVSK

SEQ ID NO: 14867 - protein, 262 aa, Propionibacterium freudenreichii subsp. shermanii
MARKPIMAGNWKMNLNHIDAVGLVQKLAFTLADKGYDPEQSECVVIPPFTALRTVQTLVEGDKLPIVYGAQDLSPHDDGAYTGDISSSMLTKLGCSYVVVGHSERREYHAETDEVVNAKARKALDAGLTPIICVGESLEVRKAGKHVEHVLAQVTGALAGITAEQAASLVIAYEPIWAIGTGEVATPEDAQEVCGAIRAAVADLYDAPTGDAVRIQYGGSVKPGTVAAIMAKPDIDGALVGRASLKADDFAAIVRFYAMAQA

SEQ ID NO: 14868 - protein, 250 aa, Propionibacterium freudenreichii subsp. shermanii
MLWVGTSWKMNGTRASSRTYVEALKQADHSAWDGVQAFIIPPATVLAEVSELLGPDSDVLLGAQNAHWADAGAWTGEVSVPQVADAGAQLVEVGHSERRANFGDTDEVVNKKVRAIIGHGLRPVLCVGESQEVFDAGDSVKFITDQADSALQGVDPSSVVLAYEPIWAIGEHGREPQRDDLLRAFDALQSRYGDAVTAVIYGGSANPGNARELLGIPGVEGLFIGRAAWTGPGYVQMLGIAGEVARAHQG

SEQ ID NO: 14869 - protein, 389 aa, Campylobacter jejuni subsp. jejuni NCTC 11168
MLTKRSQVLEESITLAITALANELKAKGEDIISFSAGEPDFDTPQTIKNAAISAIEKGCGKYTAVAGIPEVLKAIQTKFKKDNNLDYETNEIITNVGAKHSLFECIECLVEKDDEVIIPSPYWVSYPEMVKFAGGKPVFIEGLEENGFKITAEQLKKAITAKTKVLMLNSPSNPVGSIYSKEELTQIAKVLEGTQITVLSDEMYEKLRYDGFDFVAFASVSKDALKRTVTINGLSKCGAMPGWRFGYMASKNKALISAVKRLQGQSTSNICSITQHAAIPALNGECDKDIEKMRQAFEKRRNLALDILKQIPNISVYKPEGAFYLFVNIQKIEKDSMKFCQKLLEQEKVAVVPGVGFGMDGYFRLSYATSDELIKKGLERIANFIKNYK

SEQ ID NO: 14870 - protein, 147 aa, Bacillus clausii KSM-K16
MERTYVMVKPDGVQRNLIGNIVSRFEQKGYTLAAAKLVTLSKETAETHYSEHRERPFFGELVSFITSGPVFAMVWEGEGVIKAARQLIGATNPSEAAPGTIRGDLAVNVGMNVVHGSDSPESAEREIAIFFKEEELNDYQKDSNKWV

SEQ ID NO: 14871 - protein, 491 aa, Aspergillus oryzae
MATEYKLPFELNDPSLLHFDSFVGNSWVQAKNPGTDIPWASCPTNSAEDVPSAVETAHAAFEQYKKSNPRQRAQWLLKWDTLIREAKPDLAKILTHETGKPLAESYGEIDYATGFTWWFAGEAERIHGSISVPSAPNRRVFTVKQPIGVAAALVPWNFPIAMVLRKAGAAFAAGCTMIVKPSPETPLTALVLAHLAQKAGFPAGVFNVLTTDLENTPSLSEALCKHPLVKKVTFTGSTRVGKLIASHCAHGLKKLTLELGGNCPFLVFDDANLDQALDQLMALKWRHAGQACITANRVYVQAGIYDRFAQLLKERTQKLVVGHGAKEGTTMGPVTTPRSIDKALSQVEDARRLGADVILGGNKVTDTKGYFFEPTILTGMTKDMLVSREETFAPIAALYKFETEEEAVQLANDTSMGLASYAFTKNIDRMWRLLENLDAGMIGMNTGNSSAAESPFGGIKESGYGKESGKEVAVNEYLVTKTGTLTIEGQY

SEQ ID NO: 14872 - protein, 499 aa, Propionibacterium freudenreichii subsp. shermanii
MRRAKIVCTLGPATSTQERMEEMIHAGLDVARFNMSHGDHSEHLRRLEETRAAAEAVGKTVGLLADLQGPKIRLGVFADGKAELALGQEFIITTDDVPGDAHRASTTYKGLPADVKAGDRILIDDGNIQLEATGVTDTDVITKVTVAGPVSNHKGINLPGVAVNVPALSEKDENDLRWALRNDFDMIALSFVRHAADIDRVHEIMDEEDMHLPVIAKLEKPQAIENLDEIIDAFDGFMVARGDLGVEMPLEQVPLVQKTIIRKARKWAKPVIVATQMLDSMISNPRPTRAEASDVANAVLDGADAVMLSGETSVGAFPVTTVETMANIVSTTEGEGLTDISKIKWDPHTTGGVIAMAAATSGVQLGAKFLVAFTQSGDTARRMSRLRNDIPLLVFTPEAKTAQWLTLCWGAQVFHTPSYSSNEEMVTAVNRTLQDLGLAAPDDVVVIIFGSPIGMVGKTNTMRIHRLKPIDWVEKVKLPSYMRGEDGPVDGTVVANDRR

SEQ ID NO: 14873 - protein, 796 aa, Medicago truncatula
MLESLLASSQTIKGYDLTKQKSPGYSRAVSRIRTSSMFTHYSVDKQVPFQCQSTAASEKFTRRRPLDAPSFSGRNLSYFSKHRQLRWDRLQTNVTYDVASAVEVINDLGLDTLTFLAVTVFIVPSFKLIKASPILGFFCAGVVLNQFGLIRTLEDVKVLSEWGILFLLFEMGLELSLARLKALAKYAFGMGLTQVLLSTLAFTAFELPPNGAVGTKILQFLFHSRSDLVNIRSIDEAVVIGAALSLSSSAFVLQLLAEKGELPTRLGSATLGILLLQDIAVVPLLVILPVLESQNMTEGSIWPMLAQESLKALGGLGLLSFGAKFFLRRIFEVVADTRSSEAFVALCLLTIAGTSLLTQKLGFSDTLGAFLAGAILAETNFRTQIEADIRPFRGLLLGLFFLTTGTSIDMQVLLREWPNVLALLGGLITIKTLIITAIGPRVGLTLQESVRIGLLLSQGGEFGFVVFSLANSLGVLPLELNKLLIIVVVLSMALTPFLNEAGRRAASFIEDKYDVDNKQKDPEMVNFEVNEPVVILGFGQMGQVLANLLSNPMASGGDGDAIGSTYVAFDIDPRVVKTARKLGFPILYGDGSRPAVLQSAGISSPKAIMIMLTEKEKSIEAVQRLRLAFPAVPIYARARDLKHLLDLKKAGATDATLEKAETSLQLGSKMLKGLGMMSDDVSFLSQLVRDSMELQAEEAISQSEYQESNIMEPLQVRVADVMDSRVPVTTNTPKYEVSVPNQEDQASLGRIQKEADLEEQDYELNQAVKLEGNGAPCSKQDIGESSVVGSEDDLGH

SEQ ID NO: 14874 - protein, 219 aa, Nitrosomonas europaea ATCC 19718
MTQDEQKRAVAQAALQYVPTGEIIGIGTGSTANLFIDELAKIKHRIEGAVASSEVTANRLKQHGIEVLDLNSVGELPVYIDGADEITRNMHMIKGGGGALTREKIVAAVARKFICIADQSKLVKVLGKFPLPVEVIPMARSYVAREITLLGGQPAWRQGFTTDNGNIILDVHNLNIMNPVELETALNQIAGVVTNGLFARRAANVLLMGTDQGVETITV

SEQ ID NO: 14875 - protein, 180 aa, Zea mays
  misc_feature (35)..(35): Xaa can be any naturally occurring amino acid
  misc_feature (49)..(49): Xaa can be any naturally occurring amino acid
  misc_feature (59)..(59): Xaa can be any naturally occurring amino acid
  misc_feature (69)..(69): Xaa can be any naturally occurring amino acid
  misc_feature (78)..(78): Xaa can be any naturally occurring amino acid
  misc_feature (131)..(131): Xaa can be any naturally occurring amino acid
  misc_feature (136)..(136): Xaa can be any naturally occurring amino acid
  misc_feature (145)..(145): Xaa can be any naturally occurring amino acid
  misc_feature (160)..(160): Xaa can be any naturally occurring amino acid
  unsure (1)..(180): unsure at all Xaa locations
RGYSRGTSPGVILFEEHVYHKTKNGEPFVDVLKQXGVLPGIKVAKGHIXLAGSDKSARXKGHDGLDERXSQVLRVRCXYAKWRAVLKIGCNEPSQLAIDLSAQGLARYAIICQQNGLVPIVQPQILADGPXHDIDXCACVIEAVXLRCFKALIKAPCPLXGTLLKSNMVTSGSECNKVTP

SEQ ID NO: 14876 - protein, 183 aa, Zea mays
  misc_feature (38)..(38): Xaa can be any naturally occurring amino acid
  misc_feature (62)..(62): Xaa can be any naturally occurring amino acid
  misc_feature (66)..(66): Xaa can be any naturally occurring amino acid
  misc_feature (94)..(94): Xaa can be any naturally occurring amino acid
  misc_feature (104)..(104): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(114): Xaa can be any naturally occurring amino acid
  misc_feature (122)..(122): Xaa can be any naturally occurring amino acid
  misc_feature (124)..(124): Xaa can be any naturally occurring amino acid
  misc_feature (130)..(130): Xaa can be any naturally occurring amino acid
  misc_feature (134)..(135): Xaa can be any naturally occurring amino acid
  misc_feature (138)..(138): Xaa can be any naturally occurring amino acid
  misc_feature (140)..(141): Xaa can be any naturally occurring amino acid
  misc_feature (144)..(144): Xaa can be any naturally occurring amino acid
  unsure (1)..(183): unsure at all Xaa locations
MIALSFVRKGSYLVTVRQVLGHHANRIKLMSKVENQEXVVNFDEILRETDAFMVARGDLGMXIPVXKIFLAHNMMIYMCNIAGKPVVTATHMLXSIIISPMPTXAEALDXAXAXSDGTDCVXLXGESAAXAYPXXAVXIXXRFXIDGVCTMHDPPALIICLRLVSLFPLVPTRGLIIRRCFRV

SEQ ID NO: 14877 - protein, 136 aa, Glycine max
MVTSNTNNTILKISKLAILLVLFASVCNVAMSDSTAKPLDQHATTGSDPTAPAVHIVYTERPQNEEPEAYHIRTLTSVLGSEEAAKEALLYSYKSAASGFSAKLTPEQVEQISKLPGVLQVVPSRTYQLHGPNNLQ

SEQ ID NO: 14878 - protein, 296 aa, Arabidopsis thaliana
MEANSGGGGGAEGGRAVTGGGGGGGGSDVELVSKTLQVEHKLFYFDLKENPRGRYLKISEKTSATRSTIIVPSSGISWFLDLFNYYVNSEEHELFSKELQLDSKVFYFDIGENRRGRFLKVSEASVSRNRSTIIVPAGSSPDEGWAAFRNILAEIHEASGLFVMPNQVKPSDGQEHLVDDVGAGFIPGHGSQQPSSSEHNVDRTIDSPGQEETGMTGVSKVIRADQKRFFFDLGNNNRGHFLRISEVAGSDRSSIILPLSGLKQFHEVIGHFVEITKDKIEGMTGANVRTVDPPQR

SEQ ID NO: 14879 - protein, 122 aa, Arabidopsis thaliana
  misc_feature (55)..(55): Xaa can be any naturally occurring amino acid
  misc_feature (106)..(106): Xaa can be any naturally occurring amino acid
  misc_feature (108)..(108): Xaa can be any naturally occurring amino acid
  unsure (1)..(122): unsure at all Xaa locations
RTHIISSSFLSSATILPSPRHSTMGAPFNKLNSSPAFPTTHKANNDITSITSNYXRVNCMHVWPPILKKKSETLSYLPDLTDSELANEVDYLILNKWIPCVEFYLXTXFVYREHCNSPLFYY

SEQ ID NO: 14880 - protein, 251 aa, Bradyrhizobium sp. BTAi1
MTDHIRPLIAGNWKMNGLKASTAEFEAMLAGAAEVTGKADLLVCPPATLLAGFADKARGTRAVAVGAQDCHAKASGAHTGDLSAEMLADAGASAIIVGHSERRADHGESDVVVHQKTEAVWRAGLVAIVCVGETQQQRDAGQTLDILRGQLNLSLPQGSTAANLTVAYEPVWAIGTGLTPTAKDVEQIHAFIRTLLIERFNGEGARMRILYGGSVKPSNAAELMAVANVNGALVGGASLKAADFLAIAKGC

SEQ ID NO: 14881 - protein, 478 aa, Legionella pneumophila str. Paris
MTTPLYPIILAGGSGTRLWPLSRQNFPKQFLKLNGELSLIQQTMKRAMGLPGNQTIIVSNDAHYFICQDQLKDFNAQTTYLLEPCARNTAPAIACAAHYLANTVGKDAVMLVLPSDHWIADDEIWLAAMLEGGQFASENNAIVTFGIKPDSPKTGYGYIEAGTTLFSNIKQVLSFREKPDAHSAAQFVSKGNYFWNSGMFICRAGVYLEELEQFEANIYQFSQQALTLAQHHHDFLRLDLDCFSQCKEESIDYAIMEKTDKAVVIPISIQWSDLGCWTAVADANKQDEQGNTLIGNVIAQDSHNCLINSEELLVTTVGIQDQIIVATSDAVLVADKRYSQQVKDLVHSLRKDHPHLTQDHQRVPRPWGYYEVLAEGTSFKVKRLMVKPGAKLSLQTHQHRAEHWVIVGGEAEVVNGNNTFRLSKNQSTYIPKNALHRLSNPHNEPLYVIEVQSGSYLGEDDIKRFDDIYLRKEVELAE

SEQ ID NO: 14882 - protein, 227 aa, Lactobacillus sakei subsp. sakei 23K
MDKNAMKKMAAERSVDYVEDNMILGLGTGSTVVYMVEALAKRVKAENLHLTCVCTSIRTAEQATSLGIPVKALNEVDHIDLTIDGADEVDDNFQGIKGGGAAHLFEKLVATTSTRNIWIVDEEKVVDTIGRFPLPVEVIPFGSQQVFNKFVKEGLNPEFRTTEDGQRVLTDSKNEVIDLHLEKITHPHLLATWLSEQVGVVEHGLFLDLVNEVVVGSPEGVKILKAR

SEQ ID NO: 14883 - protein, 574 aa, Moorella thermoacetica ATCC 39073
MGQGSESKRAQKYIKDLRSKFPGAILEESSQAPDQITVTVKLNDLPGIVEELYYRHNGWLSTMLGNDERELNGCFALYYVLSMEGNSNKRENTWITVKALVPEKEPQFPSVTPRVPAAVWYEREVRDMFGLEPVGIPDARRLVLPDDWPDNLHPLRKDAMDYRYRPEPVEENYNFIEVEGEGIVEVPLGPLHITSDEPGHFRLFVDGEYIVDADYRLFYVHRGMEKLAENRMDYDQITFLAERICGICGYAHSVAYAAAVETANGIEVPPRAQYIRTILLEVERLHSHLLNLGLAAHLVGFDSGFMHFFRVREKAMQMAEILTGGRKTYGINLIGGVRRDIFKEERDQVLRLIAEIRTELDELLDILINTPNFISRTQGVGRLERQVARDFSPVGPNMRGSGYARDTRADHPYGAYDRVSWEVISKDGCDVLSRELVRAAELYESFNIIERCLTEMPPGPVLTEGFAYKPHTFALGYTEAPRGENVHWLMTGNNQKLYRWRVRAATYNNWPALRYMFRGNTVSDAPLIVASIDPCYSCTERVTMVDVRKKKARTIEYKELERYCRERKYSPLKF

SEQ ID NO: 14884 - protein, 225 aa, Zea mays
MEAVCGSVWVTSSLPRSPKSTLSLFRSTHQHLTAFPSQSHLFLYHPPPYANAKTLRARTSSKPAIFLPHLIASLEQVDQTYIMVKPDGVQRGLVGEIISRFEKKGFKLTGLKLFQCSKELAEEHYKDLKQKSFFPKLIDYITSGPVVCMAWEGVGVVASARKLIGATDPLQAEPGTIRGDLAVQTGRNVVHGSDSPENGKREIALWFKEGEVCEWTPVQAPWLRE

SEQ ID NO: 14885 - protein, 299 aa, Nannochloris bacillaris
MTTAISAAASRVLRRVLAIKISNHNRHPSPVRTFRTCIANQTFRTAIPTILKQHLPMKRSFTSTISASSSSSPSPTSGISSDDPNRQVRVSHILLPPGSESTIEDFKSQILNGTATLETLAKEHSTCPSASRGGDIGWIQKGRTVREFEIAAYSTPKDSFSTCTTKFGVHLIQVKEERIAIDVGHCTVQELSEILSSVNVDQDLLEEEYQFVDVREPHEVDVVSLPYFKVLPLGSFQEWAPKLSSLLDPSKKTYVLCHHGMRSMQASQFFVENGFRQVYNISGGIDAYSRGVDNNLPRY

SEQ ID NO: 14886 - protein, 618 aa, Oryza sativa
  misc_feature (153)..(153): Xaa can be any naturally occurring amino acid
  unsure (1)..(618): unsure at all Xaa locations
MAAPSQTTATTTHHRVLLPSHHHHRAVPPSLLRLPLRAARRGRLSAAAAAAAPAASTAAPSEPAAGAVPGKPTVLVAEKLGAAGLELLRGFANVDCSYGLSPEELRAKIPLCDALIVRSGTKVGRDVFEASGGRLRVVGRAGVGIDNVDLAAXTEHGCLVVNAPTANTVAAAEHGIALLTAMSRNIAQADASLKAVDRARTKWQRNKYVGVSLVGKTLAILGFGKVGSEVARRAKGLGMHVIAHDPYASADRAHAIGVELVSMEDALTTADFISLHMPLTPATNKMLNDETFAKMKKGVRIINVARGGVIDEDALVRALDSGIVAQAALDVFTKEPPAPDSKLVLHENVTVTPHLGASTVEAQEGVAIEIAEAVIGALKGELAASAVNAPMVPAEVLSELAPYVVLAEKLGRLAVQLVAGGGGIKSVKVTYASARAPDDLDTRLLRAMITKGLIEPISSVFVNLVNADFTAKQRGVRITEERILLDGSPETPIDYIQVHIAHVESKFPSAISESGEITVEGKVKDGIPHLTKVGSFQVDVSLEGSLILCRQVDQPGMIGAVGSVLGEENVNVSFMSVGRIAPRKHAVMAIGVDEEPKKSTLTKIGEIPAIEEFVFLKL

SEQ ID NO: 14887 - protein, 460 aa, Vitis vinifera
MAVFGVVLIGLCICTALLRWNEVRYRKKGLPPGTMGWPVFGETTEFLKQGPSFMKNQRARYGKFFKSHLLGCPTTVSMDPELNRYILMNEAKGLVPGYPQSMLDILGKCNIAAVHGSTHKYMRGALLALISPTMIRGQLLPKIDEFMRSHLNKWDTKIINIQEKTKEMALLSSLKQIAGIESGTISKEFMPEFFKLVLGTISLPIDLPGTNYRRGFQARKNIVGMLRQLIEERKASQETHNDMLGCLMRTNENRYKLSDEEIIDLIITILYSGYETVSTTSMMAVKYLHDHPRVLDELRKEHLAIRERKRPEDPIDWNDYKLMRFTRAVIFETSRLATIVNGVLRKTTKDMELNGFVIPKGWRIYVYTREINYDPLLYPDPLAFNPWRWLDKSLESQNYFLLFGGGTRQCPGKELGIAEISTFLHYFVTRYRWEEVGGDKLMKFPRVEAPNGLHIRVSAY

SEQ ID NO: 14888 - protein, 357 aa, Triticum aestivum
  misc_feature (115)..(115): Xaa can be any naturally occurring amino acid
  unsure (1)..(357): unsure at all Xaa locations
YCWLIYLADELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNXRTTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 14889 - protein, 425 aa, Glycine max
QPRHTLLPPQYLGSLPLRISKVSHEPHIPGQCTFGQAVLNGINALCGIGILSTPYAAKEGGWIGLSILLLYAVFSFYTGLLLRYCLDSAPGLETYPDIGQAAFGTTGRVIISIILYMELYACCIEYIIVESDNLSTLFPNAHISLGGVELNAHILFAILTAVALLPTVWLRDLRILSYISACGVIATILVVLCLFWVGLLDNADIHTQGTTKTFNLATFPVAIGLYGYCYAGHAVFPNIYTAMANRNQFPGVLLVCFAICTSMYCAVAIMGYTAFGKATLSQYTLNMPQHLVATKIAVWTTVVNPFTKYALSLSPVAMCLEELIPANSPNFFIYSKLIRTALVVSTLLVGLSVPFFGLVMSLTGSLLTMFVSLILPAACFLSIRGGRITRFQVSICVTIIVVGIVSSCLGSYSALSEIIQELFKS

SEQ ID NO: 14890 - protein, 352 aa, Bacillus cereus ATCC 10987
  misc_feature (224)..(224): Xaa can be any naturally occurring amino acid
  unsure (1)..(352): unsure at all Xaa locations
MTIDRICTIGPASNNKETLAQLISNGMKIVRLNLSHGTHESHKDIIRLVKSLDDSIKILGDVQGPKIRLGEVKGEQITLQAGDSFILHTQPVTGSSTEASVDYEGIANDVKVGSRILMNDGEVELIVGKVGKDKIETKVKAGGNISSHKGVNLPGAIVRLPAITEKDKQDIQFLLEEGVDFIACSFVRKPSHIKEIRDFIQQYKETSPNLIAKIETMEAIKNFXDICKEADGIMIARGDLGVELPFQFVPLLQKMMIQECNRTNTYVITATQMLQSMVEHSIPTRAEVTDVFQAVLDGTNAVMLSAESASGEHPIESVKTLRLVSEFAEHVKKDGPFVMKDVLELLHKSLNA

SEQ ID NO: 14891 - protein, 251 aa, Propionibacterium freudenreichii subsp. shermanii
MHMTSKLILLRHGESEWNAKNLFTGWVDVDLNEKGVREASHGGELLAQEGLLPDIVHTSLLRRAIHTSYLALDKADRLWIPVKRSWRLNERHYGALQGLNKSEIRDQYGEEQFMAWRRSYDVPPPAIEPDSKFSQFNDPRYADIPADERPLHECLKDVVERMLPYWESSIVPDLKAGKTVLVAAHGNSLRALVKHLDNIDDQTISGLNIPTGIPLFYELDDDMKPLVPGGRYLDPEAAAAGQKAVASQGKK

SEQ ID NO: 14892 - protein, 754 aa, Streptococcus agalactiae A909
MTRNFTTYVGQQGKVLSELTNEEIYVELLNFVKEEAAAKSKNSSQRKVYYISAEFLIGKLLSNNLINLGIYKDVKKELELVGKSIAEIEDVEPEPSLGNGGLGRLASCFIDSISSLGINGEGVGLNYHCGLFKQVFRNNQQEAEANYWIENNSWLVPTDISYDVPFRDFTLKSRLDRIDVLGYKKDTKNYLNLFDIDGLDYNLIEKGITFDKTEIKKNLTLFLYPDDSDKNGELLRIYQQYFMVSNAAQLLIDEAIERGSNLHDLAEYAYVQINDTHPSMVIPELIRLLTEKHGFEFDEAVSVVRNMVGYTNHTILAEALEKWPLEYLNEVVPHLVTIIKKLDQMIREEQTNPEVQIIDEAGRVHMAHMDIHFSTSVNGVAALHTEILKNSELKVFYDIYPDKFNNKTNGITFRRWLEFANQDLADYLKELIGDSYLTDATQLEKLLTYADSNEVHDKLAAIKFKNKLALKRYLKENKGIELDEYSIIDTQIKRFHEYKRQQMNALYVIHKYLEIKRGHFPSRKLTVIFGGKAAPAYTIAQDIIHLILCLSELINNDPEVNKYLNVHLVENYNVTVAEKLIPATDISEQISLASKEASGTGNMKFMLNGALTLGTMDGANVEIAELAGKENIYTFGKDSDTIINLYETSGYRSKDYYDKDKVIREAVDFIISDDIVSLGNAERLKRLHDELVGKDWFMTLIDLKEYIAVKEQVLADYEDYESWNKKVIHNIAKAGFFSSDRTIEQYNQDIWHSN

SEQ ID NO: 14893 - protein, 845 aa, Arabidopsis thaliana
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYFYGSESTEPPYWLTLTTSVTLVPEIVALKTIAAYRSGLDIDTYVSKEVAENGLVEVLRAGKPVRIGNKGLIDYILTISLEVAVRRDLPLQIHTGFGDKDLDLRLSNPLHLRTLLEDKRFGKCRIVLLHAAYPFSKEASFLSSVYPQVYLDFGLAVPKLSVHGMVSSVKELLDLASIKKVMFSTDGYASPETYYLGAKKAREVIFLVLSDACASGDLSLMEAIDAAKDIFSRNSIGFYKLNIDTDSSSPQNIISPKLKIKEPDVQEDSSSFVRIIWVDTSGQQRCRAVQAQRFNRSVKKNGVGLTFASMGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 14894 - protein, 141 aa, Arabidopsis thaliana
  misc_feature (126)..(126): Xaa can be any naturally occurring amino acid
  unsure (1)..(141): unsure at all Xaa locations
GAHARERRRETQEGAGLPLFLSSAAAVTSPAQATMGAPFTGLKASAALPVTRKTNKDITSIERNGGRVSCMKVWPPIGKKKGETLCYLPDLNDVQLAKEADYLVRNKWSACVECELKHRVVYRERXYTPRYYDGRDWTMWK

SEQ ID NO: 14895 - protein, 502 aa, Mycoplasma penetrans
MKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 14896 - protein, 514 aa, Legionella pneumophila subsp. pneumophila str. Philadelphia 1
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWERVEPVYNLLTQGKSERQFPDAETAIHFYYKNKISDEFVPPTLIGKEHSIQDGDAVLFFNFRADRARQLTSTFLDPSFKGFERKTLPKLSYFVSMTQYDKNLLTTTAFPPVPLNNTLGEVLSSHGLSQLRIAETEKYAHVTFFFNGGCESVFTNEERIMVPSPQVATYDLQPEMSAHELTKTLIAAINSQDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHP

SEQ ID NO: 14897 - protein, 510 aa, Zea mays
MAKKKEKAVNVSGKPRHSNDVNRPNDKKGAGGGAGGGSRSAATVRRLKMYKTRPKRDRAGKVLRNDFQSKELPNTRIEPDRRWFGNTRVVGQPQLEMFREELQSRLSDNFSVILKERKLPLSLLQDHQKQAKAHLLEVEPFEHAFGPKGKRKRPKLTALDYESLLKRADDSQDVFEQKYASSKLPREEEEDGLRDLVRHTMFEKGQSKRIWGELYKVIDSSDVVVQVLDARDPMGTRCYHLERHLKENCKHKHLVFLLNKCDLIPAWATKGWLRTLSKDYPTLAFHASINKSFGKVCKVAPIPGETKVWQYITLTKKIFLIDCPGVVYQNNDSETDIVLKGVVRVTNLADAAEHIGEVLRRVKKEHLQRAYKIQDWSDDNDFLVQLCRTTGKLLKGGEPDLTTAAKMILHDWQRGKIPFFVPPPQQSDGGASESAEPIGITKEDGVSSDRTAAAMKAIAGIISSQQNMNVPCHKENNADNEDTTENADNEDIESSDNEDNDDIEPAERSE

SEQ ID NO: 14898 - protein, 275 aa, Oryza sativa (japonica cultivar-group)
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVAKKDGTVALLHKKK

SEQ ID NO: 14899 - protein, 642 aa, Rhodobacter sphaeroides 2.4.1
MDRSRSASDSLTLGQHGQRGMESLLLQASIYLGAALLIVPLAVRAGLGSVLGYLAAGIVMGPVLGLAGAETEDLRHYAEFGVVLMLFLVGLELEPAALWAMRRSLVGLGGLQIVLTSLAAALGLFWLGFPWPEAAVLGMVAALSSTAIVLQTMTERRMLRTTGGRSAFAVLLAQDIAVVPMLALVPLIALRPGAGAHSAHDATEGPAMPIIGLLQSLPGWADTLVMLGVVGFIVLGGHFLTRPVFRYVHASRLPEMGSFIALFTVMGTAFLTMVVGLSPALGAFLAGVVLANSEFRHQLEADIRPYKGILLGLFFMAVGMGIDFRLLAADPWTLAGFTLALVGLKVLVLAALAQTFGLTGRDRWLLTLGLAQAGEFGFVLVAFAAQETILPALLAQKALIVISLSMLVTPVLFLVASWLTRLGEEAPALGADAIDEKGRVIIAGIGRFGQVVNRLVRMSGIETVVLDHDMAAVQIMRRFGVKGFFGDPTRPELLQAAGLAEATVLVVAVDDRENAIKIVRYARQVRPDLHIVSRARDRVHVYELYQAGADDIVRETFDSSIRAGRYVLENMGFSEYEAAQRSRTYYRVDRAAMRDLAELWVPGQPAHLNEAYVARARQLDDDLETAMLEEAGQIPLDPEAAE

SEQ ID NO: 14900 - protein, 278 aa, Zymomonas mobilis
MLDQTLEPLRAVIARHGLSADKRLGQNFLLDSQLLDRIARVPGDLTQKTVYEVGPGPGGLTRALLKAGAKVTAVERDRRCLPALAELSAHFPDQLQVISGDAMEIDEAAVLGEHVHIVANLPYNVGTALLIRWLTAKTWQPWWSSLTLMFQKEVAERITAKVGTPHYGRLSVLAQWRSEAKLSFPVHRSAFVPPPKVMSAVVHLTPKDQPEGLSLGTLEKITAAAFNQRRKMLRQSLKNIEHMMEALELAGIDATRRPETVSVAEFIAIGRHWEKLSA

SEQ ID NO: 14901 - protein, 535 aa, Malus x domestica
MADRTTDDNTVSSQPQKTIADFDPPQKPKRNKYAFACAILASMTSILLGYDIGVMSGAAIYIKDDLKISDVEVEVLLGILNLYSLIGSAAAGRTSDWVGRRYTIVLAGAIFFVGALLMGFATNYSFLMFGRFVAGIGVGYALMIAPVYTAEVSPASSRGFLTSFPEVFINSGILLGYVSNYAFSKLPTHLGWRLMLGVGAIPSIFLAVGVLAMPESPRWLVMQGRLGDATRVLDKTSDSKEESMLRLADIKEAAGIPEHCTDDVVQVPKRSQGQDVWKELLLHPTPAVRHILICAIGIHFFQQASGIDAVVLYSPRIFEKAGITNSDKKLLCTVAVGFVKTVFILVATFFVDKVGRRPLLLASVAGMILSLTGLGLGLTIIDQNHERILWAAVLCLTMVLLYVAFFSIGMGPITWVYSSEIFPLKLRAQGCSLGVAMNRVVSGVLSMTFISLYEAITIGGAFFLYAAIASVAWVFFFTMLPETHGRTLEDMEVLFGKFHKWRKANALLKQKKNASHGDGITNNGQVQLGTRGQVN

SEQ ID NO: 14902 - protein, 312 aa, Medicago sativa
MGSVEIPTKVLTNTSSQLKMPVVGMGSAPDFTCKKDTKDAIIEAIKQGYRHFDTAAAYGSEQALGEALKEAIELGLVTRDELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNAHGIVLTAFSPLRKGASRGPNEVMENDMLKEIADAHGKSVAQISLRWLYEQGVTFVPKSYDKERMNQNLRIFDWSLTKEDHEKIAQIKQNRLIPGPTKPGLNDLYDD

SEQ ID NO: 14903 - protein, 312 aa, Medicago sativa
MDSVEIPTKVLTNTSSQLKMPVVGMGSAPDFTCKKDTKDAIIEAIKQGYRHFDTAAAYGSEQALGEALKEAIELGLVTREELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNANGIVLTAFSPLRKGASRGPNEVMENDMLKEIADAHGKSVAQISLRWLYEQGVTFVPKSYDKERMNQNLCIFDWSLTKEDHEKIDQIKQNRLIPGPTKPGLNDLYDD

SEQ ID NO: 14904 - protein, 273 aa, Parvularcula bermudensis HTCC2503
MTNKLSLLLVGAGNMGGALFTSWVEKGVLDPARSAISDPNPSDAVIALAEKAGIAINPEDDQPYEVCVLGIKPQLFGAVLPDLQFGGMNDALFISMAAGTSLGEIGKLLKGQAPNARLVRTMPNLPAAIGEGMSLLCAGEGVTDKDKAAATALMEAAGQVVWTKTEDDVDRLTGVSGSGPGFVLYVVEAFEAAAKAQGASDSDARLLAEQTIIGTALHLSRDGRTAAELRKAVTSPGGTTEAGLNVLMADERLHRLIAEAVEAAYDRAQELSS

SEQ ID NO: 14905 - protein, 251 aa, Carboxydothermus hydrogenoformans Z-2901
MRKPFIAGNWKMYKTPVEAAGFVRELIDSLKDVSGVDVAVCPPFPALWPVKEALEGSNIALGAQNMHFEKEGAFTGEVSPAMLQDIGVKYVILGHSERRAYFGETDELINQKIKAAFTWGLNPIFCVGETLEERERGITKAVVEIQVLKGLAGVTAEQAENLTIAYEPVWAIGTGKTATPDDAQEVCQFIRELLVKLFGREIADKVRIQYGGSVKPENIKELIAKPDIDGALVGGASLKVESFTAIVKGSI

SEQ ID NO: 14906 - protein, 549 aa, Staphylococcus aureus subsp. aureus Mu50
MNKQWWKEAVAYQVYPRSFNDSNHDGIGDLPGMIDKLDYLKDLGIDVIWLSPMFKSPNDDNGYDISDYQEIMDEFGTMEDFDCLLKGIHDRGMKLILDLVVNHTSDEHPWFIESKSSKDNPKRDWYIWQDPKQDGSEPNNWESIFNGSTWEYDANTEQYYFHLFSKKQPDLNWGNPEVRDAVFEMMNWWFDKGIDGFRVDAITHIKKTFEAGDLPVPEGKTYAPAFDVDMNQPGIQTWLQEMKDRSLSKYDIMTVGEANGVSPDDADDWVGEENGKFNMIFQFEHLGLWNSGDSHFDVNSYKSVLNRWQKQLENKGWNALFIENHDQPRRVSTWGDDDKYWYESATSHAAVYFLQQGTPFIYQGQEIGMTNYPFESIETFNDVAVKNDYQIVKAQGGDVDALLAKYKDENRDNSRTPMQWDDTLNGGFTNGEPWFPVNLNYKTINVAQQLEDEHSVLQFYKDLIQLRKSNDVYVYGQFDLVDAENSQVFAYTRTLNEKQVLIVGNLTNHEAELTVPFDLSHGEVKLFNYDAKVNLKQLRPYEACVIELN

SEQ ID NO: 14907 - protein, 270 aa, Moorella thermoacetica ATCC 39073
MPAPLQSLRQYLKVVDAVLEVADARLPVSSRYPDLEKLIGFRARVVVLTRADLADPAATACWLEKLRAGGTRAVAMNARTGSGDRLLYQYLKAIAKAKREARARRGLGEAPLRVMALGIPNVGKSSVLNRLAGRGAARTGNRPGITRGPQWIRIKDNLELLDTPGVLWPRWREPRTALWLGALGCAPEESVPVVGIACLVGEFLLREAPGTLAARYGIQEQGDATDILAAIGRARGFLLPGGVVDQEKTARALVNDFREGRLGRFTLERP

SEQ ID NO: 14908 - protein, 278 aa, Triticum aestivum
SSTQGVEELKNELALVAKLKHKNLVRLVGVCLEQQERLLIYEFVPNRSLDLILFDEANRQKLDWETRFKIINGVARGLQYLHEDSQLKVIHRDLKASNVLLDMNMNPKISDFGLAKIFGRDQTQGVTNRVIGTYGYMAPEYVMRGNYSVKSDAFSFGVLVLEIMTGKKNSDCYNSQQSQDLLTTVWEHWVAETVLEVVDPCMNKSFSESDALRCIHVGLLCIQGNPADRPMMSTVAMMLGSNTFSLPTPSKPAFYTTNDGANSSTGSSVSIPSVQARS

SEQ ID NO: 14909 - protein, 151 aa, Synechococcus sp. WH 8102
MAERTFIAIKPDGVQRGLVGEILGRFERKGFKLVGLKQITPSRALAEQHYGVHKERPFFAGLVDFITSGPVVAMVWEGDGVIASARKLIGATKPLEAEPGTIRGDLAVNIGRNVIHGSDAPETAEFEIGLWFDAAELNDWTPSDQTWRVEA

SEQ ID NO: 14910 - protein, 272 aa, Erwinia carotovora subsp. atroseptica SCRI1043
MNNRVHQGHFARKRFGQNFLNDHFVIDSIVSAIHPQPGQAVVEIGPGLGALTAPIGERMDRFTVIELDRDLAARLEKHPTLKDKLTIIQQDAMTIDFAALAEQAGQPLRVFGNLPYNISTPLMFHLFTYTQSIRDMHFMLQKEVVNRLVAGPNSKTFGRLSVMAQYYCQIIPVLEVPPEAFKPAPKVDSAVVRLVPHAELPYPVSDIRMLSRITTEAFNQRRKTLRNSLGNLFTPETLTELGINITSRAENVTVEQYCRLANWLSEHPAKQE

SEQ ID NO: 14911 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGQSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 14912 - protein, 438 aa, Thermoproteus tenax
MPSLTAPSSSSLYLSRIFSTKNLFMRPSSFTDTLGFRTSSSSYISAIPSSSPSFDFNTWTSNGFLATSLFSFSCAAVVKDLCPIASSIKESNRLYRRTSFSNCAIFSSRIFLSSSNSSTTIVILTSIKSIVALVASIGNLNYDIYIKTHELPGLDQSVDALDLYTGGGGSAANFSVAIARLGHRARFIGAVGDDVIGEIILKELESEGVEVRYVKKIGGLRSGVVVVIVQPDGGKRMIAYRGANMGLSPDDINEASLGGVDHVHVASGRVELILKAKEVAKRDGKSISVDGGTSLARKGLEVAAKALSGVDVVFMNQAEAKLLSSSSDHRAALDVIARNIDAREIVVTLGDRGAMALSGGEFLYVDAFRLQALDTTGAGDTFAAAYIAARLMGLSLYERLLFANAAASIKVTRPGARSSPRLSEVLEFLRSLGYRLAE

SEQ ID NO: 14913 - protein, 216 aa, Oryza sativa
  misc_feature (198)..(198): Xaa can be any naturally occurring amino acid
  unsure (1)..(216): unsure at all Xaa locations
MDNMLLPLPKSSLHLMCNDFKNIMQIIEEDITKFNVRSHFLPFLEEKSHHTRKYAKVVSNLPFNVSTEVVKLLLPMGDVFSVMVLLLQDETALRFADASIQTPEYRPINVFVNFYSEPEYKFKVERTNFFPQPKVDGAVISFKLKNSGDYPPVGSHKGFFSMVNSAFNGKRKMLRKSLQHLCSSSEIEAALANIGLPXSDLLLDDFVRLHNHLTKA

SEQ ID NO: 14914 - protein, 509 aa, Oryza sativa
LGFKSLIKMSGATADWAWWLGLVAGAVPLLALAVWHCTDAFHSAAFAFRRRGTRARLPPGHMGLPFVGETLALIWYFNLARRPDAFIEAKRRRYCYGDGDDDGGIYRTHLFGSPAVLVCSPASNGFVFRSAPPGSFGVGWPVPELVGASSLVNVHGGRHARLRRFVLGAINRPGSLRTIARVAQPRVAAALRSWAAKGTITAATEMKNVTFENICKIFVSMEPSPLTEKIHGWFTGLVAGFRSLPLDMPGTALHHARKCRRKLNSVFREELERRKVKMVTGEGGDDDDDGDLMSGLMHVEDEQGRRLDDDEVVDNIVSLVIAGYESTASAIMWATYHLAKSPSALAKLREENLAIAKEKNGDGFITLEDVSKMKYTAKVVEETIRLANIAPMAHRVALRDVEYRGYTIPKGWKVIVWIRSLHVDPAHYDNPLSFNPDRWDKSAELGTYQVFGGGERICAGNMLARLQLTIMLHHLSCGYKWELLNPDAGIVYLPHPRPTDGAVMSFSEL

SEQ ID NO: 14915 - protein, 775 aa, Arabidopsis thaliana
MEERRDDESSPTHQGSELAERVKLLSFESQGEALSKDSPRSVEQDCSPGQRASQHLWDTGILSEPIPNGFYSVVPDKRVKELYNRLPTPSELHALGEEGVRIEVILVDFQKDKKLAMLKQLITTLVSGSGTNPALVIKKIAGTVSDFYKRPTLESPSKLALEENAFLFENHGAQLLGQIKRGCCRARAILFKVLADTVGLESRLVVGLPSDGTVNCMDSNKHMSVIVVLNSVELLVDLIRFPGQLVPRSAKAIFMSHISPAGESDSAENDSCDSPLEPNSPLYERRDPESTEKDENLQFYRKLEGYPNASGSSLRSLMLRPSTAIERKLSNTSHSEPNVATVFWRRSRRKVIAEQRTASSSPEHPSMRRGRSMLSTGRNSFRDYTGEASSPSSSSTSEIRKTRRRSFRITPEIGDDIASAVREMYEKSKQNRLLQGREDENSSVIDNNVSGLHLDDELNSKKTMSLPSSPHAYRCQTFGRRGPSEFAVKDTWNKVVESSTLQNQPLLPYQEWDIDFSELTVGTRVGIGFFGEVFRGVWNGTDVAIKLFLEQDLTAENMEDFCNEISILSRVRHPNVVLFLGACTKPPRLSMITEYMELGSLYYLIHMSGQKKKLSWHRRLRMLRDICRGLMCIHRMKIVHRDLKSANCLVDKHWTVKICDFGLSRIMTDENMKDTSSAGTPEWMAPELIRNRPFTEKCDIFSLGVIMWELSTLRKPWEGVPPEKVVFAVAHEGSRLEIPDGPLSKLIADCWAEPEERPNCEEILRGLLDCEYTLC

SEQ ID NO: 14916 - protein, 312 aa, Medicago sativa
MGSVEIPTKVLTNTSSQLKMPVVGMGSAPDFTCKKDTKDAIIEAIKQGYRHFDTAAAYGSEQALGEALKEAIELGLVTRDELFVTSKLWVTENHPHLVIPALQKSLKTLQLDYLDLYLIHWPLSSQPGKFTFPIDVADLLPFDVKGVWESMEESLKLGLTKAIGVSNFSVKKLENLLSVATVLPAVNQVEMNLAWQQKKLREFCNAHGIVLTAFSPLRKGASRGPNEVMENDMLKEIADAHGKSVAQISLRWLYEQGVTFVPKSYDKERMNQNLRIFDWSLTKEDHEKIDQIKQNRLIPGPTKPGLNDLYDD

SEQ ID NO: 14917 - protein, 183 aa, Arabidopsis thaliana
  misc_feature (105)..(105): Xaa can be any naturally occurring amino acid
  misc_feature (127)..(128): Xaa can be any naturally occurring amino acid
  misc_feature (130)..(130): Xaa can be any naturally occurring amino acid
  misc_feature (135)..(135): Xaa can be any naturally occurring amino acid
  misc_feature (137)..(137): Xaa can be any naturally occurring amino acid
  misc_feature (143)..(143): Xaa can be any naturally occurring amino acid
  misc_feature (147)..(147): Xaa can be any naturally occurring amino acid
  misc_feature (150)..(150): Xaa can be any naturally occurring amino acid
  misc_feature (153)..(153): Xaa can be any naturally occurring amino acid
  misc_feature (159)..(161): Xaa can be any naturally occurring amino acid
  misc_feature (164)..(164): Xaa can be any naturally occurring amino acid
  misc_feature (167)..(167): Xaa can be any naturally occurring amino acid
  misc_feature (170)..(170): Xaa can be any naturally occurring amino acid
  misc_feature (176)..(176): Xaa can be any naturally occurring amino acid
  misc_feature (178)..(178): Xaa can be any naturally occurring amino acid
  unsure (1)..(183): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGXFVYREHGKQFPGTTDGRYLGKXXKXSIFRXTXFCLRIXREFXDSXRGXPGGLFXXXGFXKTXKAXEKFFFXKXPSFGN

SEQ ID NO: 14918 - protein, 269 aa, Mesorhizobium sp. BNC1
MGKRVVLVGCGNMGYAMMKGWLAAGKLSAADISVVEPNDELRARAADCGVSVAAQPDALPWREADLVIFAVKPQMVHQVVPDYRFFAPGATFLSVAAGAGISLFEELLGHNAAVVRCMPNTPAAIGKGMLVIVSNGNVRPQTKEFVNELLATNGAVATIEDESLMDTVTAVSGSGPAYVFHFIECLTAAGEQAGLPSQTAKQLAMQTVYGAAVLAKESGEEPGMLREQVTSPNGTTAAALKVLMGEERLQRLLGEAVEAARQRSIELGK

SEQ ID NO: 14919 - protein, 175 aa, Oryza sativa
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 14920 - protein, 290 aa, Yarrowia lipolytica CLIB122
MKFSSVLVAFLASFVVAEEQPACGVPIVYRLFTQPELSAPLHKDCPANADLPLSCSKEITDKDSLCCVQQPGGLVLLAQFWDYDPGFGPEDAFTLHGLWPDNCDGTYQQYCDKEQEVSNVTDIIKKLEPSLLDYMNEHWVSDDGDNESFWEHEWNKHGTCMSTLNPSCYKEGTDKHQNVADYARTAIALQKELNTFGFLGSKGIWPSDDKTYPKQDIEAALKYHHSNSKVHIACDKSGALNEVWYYFHIQGAIPSAEYTPVDDTIPKNNCPDQVKYLPKKFNSTKPATGY

SEQ ID NO: 14921 - protein, 487 aa, Prosthecochloris aestuarii DSM 271
MKETLIFDLSRKGRQGHRIASLDIEPQPAINLIPEKFLRTEPADLPEVPESEVVRHFIRLSNLNHHVDKDMYPLGSCTMKYNPKINDQTADIAGFTSIHPLQPAETAQGTLQLMYELGEMLREIAGMAAITLQPAAGAHGELTGILMIRKYHDSRASKRTKLLVVDSAHGTNPASAALVGYDILSVKSNAEGRTDIEDLKAKLDENVAALMLTNPNTIGLFEKDIKEIEQLVHDNGSLLYMDGANMNALMGITRPGDMGFDIVHYNLHKTFSAPHGGGGPGSGPVGVCDKLKPYLPVPVIEKHDDGNTSRYTLTTDRPLSIGRMMNFYGNFSVMVRAYTYIRMLGAEGIRRVSENAIINANYLLSKLIDRYDLPYPKPVMHEFCLSGDRQKKQHNVRTLDIAKRLLDLGFHAPTIYFPLIVSEALMIEPTETETRETLDRFAEAMLQIADETENSPETVQNAPQFTPVKRLDEAQASRKLNICCPGC

SEQ ID NO: 14922 - protein, 360 aa, Glycine max
LAVGLEALLEGITDTLGTELLESLLKMAPSKEEERKLKEHKDDSPTKLGPAEKFLKAVLDVPFAFKRVEAMLYIANFESEVEYLRKSFQTLEAACEELRNSRMFLKLLEAVLKTGNRMNVGTNRGDAHAFKLDTLLKLVDVKGADGKTTLLHFVVQEIIRTEGARPSSTNQTPSANLNDDAKCRRLGLQVVSSLSSDLASVKKAAAMDSEVLSSEVSKLSKGIAHIAEVVQLDEAGGSDESSQKFRESMNKFMRMAEEEILKVQAQESVALSLVKEITEYFHGNLSKEEAHPFRIFMVVRDFLTVLDRVCKEVGMINERTMVSSAHRFPVPVNPMLPQPLPGLVGKRQYNSSDDDDSSSP

SEQ ID NO: 14923 - protein, 417 aa, Nitrosomonas europaea ATCC 19718
MAEIRNYTMNFGPQHPAAHGVLRLVMELDGEVIRRADPHIGLLHRATEKLAENKTYVQSVPYMDRLDYVSMMVNEHAYVMAIEKLLQIEVPIRAQYIRVMFDEITRILNHLLWLGAHALDVGAMTVFLYAFREREDLMDCYEAVSGARLHAAYYRPGGVYRDLPDNMPQYQPSAIHDEKATRARNENRQGSLLDFIEDFTRRFPGYIDDYEALLTDNRIWKQRLVDIGVVSPDRAKALGFTGPMLRGSGVEWDLRKKQPYEVYDQVDFDIPVGANGDCYDRYLVRIEEMRQSNHIIKQCVEWLRKNPGPVITDNHKVAPPSRLAMKQNMEEMIHHFKLFTEGMHVPRGEAYAAVEHPKGEFGIYIVSDGANKPYRLKIRAPGFAHLAALDEMTKGHMIADLVAIIGTQDIVFGEIDR

SEQ ID NO: 14924 - protein, 484 aa, Prosthecochloris aestuarii DSM 271
MNSKRANATVLIADDSAVMRTLISHVIKRLGYKHITADDGNACIRLLQDNKVDLLLLDINMPGKNGIDVLAYMKENGLEIPVIMITASDDISQAVQCIKMGAYEYLTKPVDNDRLEITAKNALSEQSLKKKVELLEKELLQKDIFKRIYGESQAIKECIGQATQVMETDVNVLINGESGTGKELFAQAIHNGSKRKNGPFVTINCAAITNELADSLLFGHVKGSFTGANSDHTGFFEQADGGTIFLDEIGDLNIEIQAKVLRVLQEHIVRRVGEKKERPVDFRLISATHKDFSNAIETGSFRADLYYRLEEYPLYIPPLRERGDDISLLAKHFLESFCIANNIEPLTFKPLVLDQLSRYDWPGNIRELQNIVRRSAINRTGNEINALPGFLSADHKRPKDALPEPEASHPEPVTDTEINHPISAPVETSLKDAEQQAIARAYEACRGNQTKTARILGISRSSLYRKLKKYGMEKSITLSLNKTP

SEQ ID NO: 14925 - protein, 414 aa, Burkholderia sp. 383
MRPFFLLPRLPRPARPMNTATDSLVRLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRAVLVPSGPDARFQLTEDDVRTRWGDRTRGVLLASPSNPTGTSLEPDELKRIVEAVRARGGFTIVDEIYQGLSYDAAPVSALSFGDDVVTVNSFSKYFSMTGWRLGWLVVPPALVGTFEKLAQNLFICPSALAQHAALACFEPAALDIYEARRLEFKRRRDFIAPALERLGFTVPVMPDGAFYVYAHCGGVAHPAAGDSAALTTAMLHDAGVVLVPGMDFGVHAPRDYIRLSYATAYSRLEEAVDRLATLFGQH

SEQ ID NO: 14926 - protein, 139 aa, Wolbachia endosymbiont of Drosophila ananassae
MAIEKTLSILKPDAVKNNITGKINSYIESSGLKIIAQKMMLLTKKQAELFYEIHKDRPFFGELVEFMTSGSVIVQVLVGENAVSKYRQIMGATNPKQADKGTIRGDFADDISENRVHGSDSLENARKEIAFFFAECELV

SEQ ID NO: 14927 - protein, 480 aa, Pseudomonas putida KT2440
MELIPVILSGGVGSRLWPVSREAHPKPFMTLPDGQNLIQKTFLRAADLNGVVEILTVTNRELLFKTEDEYRTINKQNLSQGYILEPFGRNTAAAVAAAALQLLESHGPQVHMLVLAADHLIQNEAAFSEAVSKAVQLAGEGWLVTFGIKPQYPETGFGYIEAAAGGVLEGGLRVERFVEKPDAKTAEAYVAAGNYFWNAGMFCFQVGTVIEQFRAYAPDVLEAVERTLEASRRSTSKGYSCLALDAECFASVPDISIDYALMERSSKVATIPCDIGWSDIGSWNAVSELTLPDEHGNRFDGEVMAYGASNNYVSTEDRLAALVGVQDLLVVDTPDALLIAHKDHAQDVKHIVKRLKNDGHTAHLLHQTVHRPWGTYTTLEDGERFKIKRIVVKPKASLSLQMHHHRSEHWIVVSGMAVVVNDDQELMLNTNESTFIRAGHKHRLQNPGVIDLVLIEVQSGDYLGEDDIVRFEDNYGRCDA

SEQ ID NO: 14928 - protein, 380 aa, Burkholderia sp. 383
MTLASTLDIIAELKAGRMVILVDEEDRENEGDLVIAAEFVTPEAINFMAKYGRGLVCLTLTQERCKQLHLPLMTYRNGTQYGTAFTVSIEAAEGVTTGISAADRARTIATAVAHDVRPEHIVQPGHVFPIMAQPGGVLVRAGHTEAGCDFTALAGLTPAAVICEIIKDDGTMARLPDLIEFAQEHNLKIGTIADLIQYRSRTESIIERIAERTMQTAHGTFRAVLYRDQPSGSPHIALVRGAPSPDVDTPVRVHEPLSVLDLLETGVSTHSWTLDAAMREIAERDLGVIVLLNCGDTKEHLIDVFKAFDEEEKAAALKRRPVDFKTFGIGAQILRDVGVSKMQVLSNPRKLGSMSGYGLEVTGFIPMPGGEAKSCPASNA

SEQ ID NO: 14929 - protein, 338 aa, Bradyrhizobium sp. BTAi1
MTAPEGTLESFLEGDCSVSEPLAITVTALAFVAETLAGVISSGPLNGRLGEEVGANSDGDRQKKLDVVADELFAGALAPTPVRWYASEERPTAEMLNPEGTLALAIDPLDGSSNIDVNISIGTIFSVFEAKESGVESFLRPGREQIAAGYVVYGPQTVFILATRTTLAQFVLHRGHFFLVSDSLRIPDRTTEFAINASNYRHWSRPIRAFVDDCIAGDEGPWGENFNMRWVASLVAETHRILTRGGIFLYPADARRGYGQGRLRLVYECAPIAFIVERAGGKATDGIDRILDLTPSELHQRTPLVFGTAEKVSQVCAYHDLPESEVSPLFGTRGLFRA

SEQ ID NO: 14930 - protein, 140 aa, Medicago truncatula
MPADLERLASRIPQLDGPIPYEDDVLSTPNIYNYGGVFNEDYNIANTPAPPEVPASTPALVAQNEAVNEDEDDEPLNEDDDDDLDDLDQEDDQDTNHLVLAQFDKVTRTKSRWKCTLKDGIMHINKKDILFNKATGEFDF

SEQ ID NO: 14931 - protein, 252 aa, Nitrosomonas europaea ATCC 19718
MGRAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQN

SEQ ID NO: 14932 - protein, 346 aa, Medicago truncatula
MAASTTSQVYIDVIEDVMVKVRDEFVNTGASPGDEVLRELQAIWESKCIQAGAVLGPIERNTGVNRPMPGGPITPVHDLNVPYEGTEEYETPTAEILFPPTPLQTPIQTPLPGPGETPNYNIPTGPSDYSSGNDAGGNADVKGGRQAFMPPPSPWMNMNQRPPLDVNVAYVEGRDEADRGASNQPMTQDFFTMTGGKRKRNDLPPPYDAGGYIPQQDGAGDAVSGDFEIEYMHGPGFKPRPSLAPRCMLFADDVVLLGESREELNGRLETWRQALVAYGFRLSRSKTEYMECNFSKRRSGSTLEVKVGDYIIPQVARFKYLGSIVQNVGEIEADVNHRIQAGWLKT

SEQ ID NO: 14933 - protein, 249 aa, Nitrosomonas europaea ATCC 19718
MKKLVLLRHGESIWNQENRFTGWTDVDLTPKGLKEAEEAGRLLRENGFSFDIAYTSLLKRAIRTLWIALDEMDQMWTPIELNWRLNERHYGALQGLNKAETAKQYGDEQVLVWRRSYDIRPPSITINDERYPGFDLRYRNMSSGDIPLAESLKDTVARFLPYWNQSIAPQIKAEKKVIIAAHGNSLRALIKHLDNISDQDILNCNIPTGIPLVYELDDDLKPLNSYYLGDAGQIGEAISAVANQGKSGA

SEQ ID NO: 14934 - protein, 1102 aa, Rhodobacter sphaeroides 2.4.1
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLGRFRGAVPVELTGRSEFPPVGDLPYMLTLPPYGFYWFILSDQQALPSWHQPMPETLPDFITLTTRDGRAETALTGRETRQLEADVLPNWLPLQRWFGAKEEKISAVKLAVLGSLSADHALVRLEADVGGEVQQYFLPASALWGEEQLRAGAPKLSFTLAKVRRGPQVGALIDGAYDEQMAQAMLEALRDGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAAFAFVANMGDAWRGLFDALVRDLGEFGGWSTAEAPEVEKDGFSFPLTIPGLLGQRTAELHQAFATETDEAAFRMEPLTAQHLTGWAEGARREAEAMLSVLERQRTHLPDEVLPLAEALLARREDLLARLDRVTGFEPSGALTRIHGDYHLGQVLLAQDDVAIIDFEGEPRRTLAERREKSSPLRDVAGMLRSFDYAAAAALARHEESFGPASERAVERAEAWRQQAVADFLAAYEGASAGTASLPSDPALKEALLDLFLVQKAVYETSYELGSRPAWVGIPLRGLLELLDRKPA

SEQ ID NO: 14935 - protein, 290 aa, Streptococcus pyogenes serotype M6
MRIADYSVTKAVLDRHGFTFKKSFGQNFLTDTNILQKIVDTAEIDQNVNVIEIGPGIGALTEFLAENAAEVMAFEIDDRLVPILADTLRDFDNVQVVNQDILKADLQTQIKQFKNPDLPIKVVANLPYYITTPILMHLIESKIPFQEFVVMMQREVADRISAEPNTKAYGSLSIAVQYYMTAKVAFIVPRTVFVPAPNVDSAILKMVRRDQPLIEIKDEDFFFRVSRLSFVHRRKTLWNNLTSHFGKSEDIKTKLEKGLALADIKPSIRGEALSIQDFGKLADALKEVGL

SEQ ID NO: 14936 - protein, 469 aa, Xylella fastidiosa Ann-1
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFSNDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLAPEEEKLIPQVCSSLDQALEALDKDRDFLKAGGVMSDDFINGYIALKMQEVTQFRAATHPLEYQMYYAN

SEQ ID NO: 14937 - protein, 285 aa, Zea mays
MGFKCPRASKKPVGILLVKVVRAQNLRKKDLLGKSDPYVKLKMSDDKLPSKKTTVKRSNLNPEWGEDFKFVVTDPENQALEVGKHEKMGMNMIPLRELLPEGTKVTTLNLLKTMDPNDVQNEKSRGELTLELTYKPFKEEDIEKEDTQGADVIEKAPDGTPAGGGLLYVIVHEAQDLEGKHHTNPYAKIIFKGEEKKTKVIKKNRDPRWEDEFEFVCEEPPVNDKLHVDVLSKASKKGLIHGKETLGYIDISLADVISNKRINEKYHLIDSKNGQIQIELQWRTS

SEQ ID NO: 14938 - protein, 278 aa, Chlamydophila caviae
MSRSSPDQLTRFLAQVQGRPKKGLSQNFLIDGNILRKILAVSCVEAGDWVLEIGPGFGALTEVLVNQGAHVVALEKDPMFEETLKQLPIDLEITDACKYPLSQLEEKGWQGKGRVVANLPYHITTPLLTKLFLEVPNQWKTVTVMMQDEVARRITAQPGGKEYGSLTIFLQFFADVRYAFKVSPGCFFPKPQVSSAVVHMTVKETFPLETSLHQKFFSLTRAAFGQRRKLLANALKDLYPKELVFSALNQLNFSEKTRPETLSLNEYLQLFHLLSSNA

SEQ ID NO: 14939 - protein, 329 aa, Kluyveromyces lactis NRRL Y-1140
MTYLAETVTLNNGEKMPLVGLGCWKMPNDVCADQIYEAIKIGYRLFDGAQDYANEKEVGQGVNRAIKEGLVKREDLVVVSKLWNSFHHPDNVPRALERTLSDLQLDYVDIFYIHFPLAFKPVPFDEKYPPGFYTGKEDEAKGHIEEEQVPLLDTWRALEKLVDQGKIKSLGISNFSGALIQDLLRGARIKPVALQIEHHPYLTQERLIKYVKNAGIQVVAYSSFGPVSFLELENKKALNTPTLFEHDTIKSIASKHKVTPQQVLLRWATQNGIAIIPKSSKKERLLDNLRINDALTLTDDELKQISGLNQNIRFNDPWEWLDNEFPTFI

SEQ ID NO: 14940 - protein, 387 aa, Desulfitobacterium hafniense Y51
MNQYLSPIAANLPPSGIRKFFDLVSTMKNVISLGVGEPDFVTPWTVRESGIFSLEQGQTMYTSNSGLLELRQALSWNMEKKLGLEYNPNDEILITVGASEAVDLAMRALLGPGDALLLTDPAYVSYGPCATLAGAEVHYVPTREEEDFRVRVEDLERVYTPNAKVLVLSYPNNPTGAIMTWEDYQPIAKFVQDHDLIVVADEIYSDLSYGGSHTAFASLPNMRNRTLHISGFSKSYAMTGWRIGYVAGHHDFIQAMTRIHQYTMLCAPITAQLAALEAVRSAEQAMQDMVATYDRRRRLMVHGFRKMGLSCFEPLGAFYTFPSIKATGLTSEEFANELLQEEKVAVVPGTAFGPSGEGHIRCSYAYSTEQIQEALTRMERFVSKRIK

SEQ ID NO: 14941 - protein, 126 aa, Vibrio vulnificus YJ016
MCVRNFTLVRLILFKSVSREGLNMIQEIIETKLHNTFEPSHLSVVNESYMHNVPPGSESHFKVIVVSDLFEGKRLIARHRLVNQALANELENNIHALAIHTYTDQEWKLQRDGAPDSPMCMGGTSH

SEQ ID NO: 14942 - protein, 290 aa, Candidatus Kuenenia stuttgartiensis
MTYSRPETTTRDYYNDQSADRFYYSVWGGEDIHIGIYRYPSESIFAASRRTVETMCAFLPRLNASTRVLDIGAGYGGSARYLAMQFQCEVTCLNLSDVQNQKNRQQTEEAGLDSLIEVVDGSFENIPFSPNSFEVVWSQDAILHSDDRKKVLEEVHRVLKPGGVFIFTDPMQSDECPKEALAPVLARIHLESLGSPGVYRQIAAQLGWIELKFEDLSSQLPIHYRRVLEEITGRETEIVRQCTPEYIERMKTGLGHWIKNGEKGYLKWGIFLFQKPDVFQDSFVGSRPVQ

SEQ ID NO: 14943 - protein, 475 aa, Mesorhizobium sp. BNC1
MLDDSKAGRTNRGGRRTPAFLKNLRGVKGWKEARAWLEWRGIEDIECIAPDQAGVARGKMMPSKKFISNTSLALPSAVFMATISGEYPEDGNGFTYPEDDGDLKLVPDLSTLSVVPWETDPTAQVICDLAHQDGRAVEFSPRNVLRRVVAKYAEHGLKPIVAPEIEFYLVHKNPDPDYPLTPPVGRSGRPIGGGQGYSIAGVNEFDELIDDIYHFSEGQGLEIDTLIHEEGAGQLEINLRHGDPVELADQVFLFKRTIREAALKHEMYATFMAKPIQDQPGSAMHIHQSVVTLKGGRNVFSDENGEETDVFRHFIGGLQQHIPNALIMLAPYVNSYRRLTQAGSAPVNTRWGYDNRTTAFRVPRSDPNSRRVENRIPSSDANPYLALAASLACGLIGILQKIEPDAPAGTAVNTDVINLPRGLLEAVALFEADESLRNIVGDLFASTYAAIKRAEFETFMKVISPWEREYLLLNV

SEQ ID NO: 14944 - protein, 192 aa, Arabidopsis thaliana
  misc_feature (86)..(86): Xaa can be any naturally occurring amino acid
  misc_feature (106)..(106): Xaa can be any naturally occurring amino acid
  misc_feature (148)..(148): Xaa can be any naturally occurring amino acid
  misc_feature (154)..(154): Xaa can be any naturally occurring amino acid
  misc_feature (182)..(182): Xaa can be any naturally occurring amino acid
  unsure (1)..(192): unsure at all Xaa locations
MASSMLSSAAVVTSPAQATMVAPFTGLKSSAAFPVTRKTNKDITSIASNGGRVSCMKVWPPIGKKKFLDFILPSLTFSDGRIWLKXKLTYLLPQQSGIPLFLNFEXLEHGIFCTREQRENTSRVTYGWTGTWANVGGFPLFGCTDFDXVLKEVXECQKEYPGAFIRILGFHHTRPGPWTGFXAYKPPRFPEA

SEQ ID NO: 14945 - protein, 492 aa, Arabidopsis thaliana
MARRGSCSTICLNEKLQRFRIVRISDKADNFNSRSGSFFERSISLVLLLWCFLFLVYSKLGQSHDDYGNADRIGNYTDGSVSKTLNSTSSVFPQATEKENNFCLLRKGQLQDVYEHVLVNNALLICKVVLPERRISKKTLEARDPRYVNLEDKSLKVNGSSQLVNNGTRYRLEPDGNGYNYASAMKGAKVVDHNKEAKGASNVLGKDHDKYLRNPCSVSDKYVVIELAEETLVDTVRIANFEHYSSNPKEFSLSGSLSFPSDMWTPAGSFAAANVKQIQSFRLPEPKWTDQIGKETEAQKKKDDVVKTINIIGDKKYEVKEKHNVLKVMMQKVKLIEMNLSLLEDSVKKMNDKQPEVSLEMKKTLVLVEKSKADIREITEWKGKMEKELRDLELWKTLVASRVESLARGNSALRLDVEKIVKEQANLESKELGVLLISLFFVVLATIRLVSTRLWAFLGMSITDKARSLWPDSGWVMILLSSSIMIFIHLLS

SEQ ID NO: 14946 - protein, 432 aa, Carboxydothermus hydrogenoformans Z-2901
MPLKIDRSIEAFSEAKKVIPGGVNSPVRAFKSVGLNPVFIERGEGSKIYDIDGNCYIDYVGSWGPLILGHRHPKVEEALANCLKKGTSFGAPTLLETEMAEIIVNAFPAMDMVRMVNSGTEATMSAIRLARGFTGRNKIVKFEGCYHGHADSLLIKAGSGALTLGVPTSPGVPANIANNTITAQFNDLALLEEIFAQEGNDIAAVILEPVAGNMGVVPPKPGFLEGVRELTRKYGALLIMDEVMTGFRVHWGGAQVLYNVEPDITTLGKIIGGGLPVGAYGGRREIMEMVAPAGPVYQAGTLSGNPLAMTAGIATLTVLKEEGVYEQLEEKSSYLESGLKEAARAAGLKLWFNRVGSMLCTFFTSEEVVDYKTACTSDTQKFAVFFKTLLENGIYIAPSQFEAMFVSLAHSKDDLDKTIEASYKAFKAAAEN

SEQ ID NO: 14947 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 14948 - protein, 621 aa, Oryza sativa (japonica cultivar-group)
MATAAAASRAALSRPHAAAAAARASPAAGARVTLPRRRSVRSAVISSSASAAAVAASEPAAGRVTLGAGTDGALWPKPAVLVAEKLSEAGLAVLRGFADVECAYGMSPAELLAKVAQFDALIVRSGTKVTREVLEAGRGRLRVVGRAGVGIDNVDLQAATEAGCLVVNAPTANTVAAAEHGIALLASMARNVSQADAALKAGKWQRTKYVGVSLVGKTLAVMGFGKVGSEVARRAKGLGMHVIAHDPYAPADRARAIGAELVSFDEAIGRADFISLHMPLTPATSKVFNDESFSRMKNGVRIINVARGGVIDEDALVRALDSGKVAQAALDVFTEEPPAKDSKLVLHENVTVTPHLGASTVEAQEGVAIEIAEAVVGALRGELAATAVNAPMVPAEVMSELAPYVSLAEKLGKLAVQLVAGESGGIKGVKVVYTTARGPDDLDTRLLRAMVTKGIVEPVSSTFVNLVNADYTAKQRGLRITEERVSHESPAAEAPLESIQVRLSHVQSKFAGAISDGGDIVLEGRVKYGVPHLTVVGPYEVDVSLEGNLILCRQIDQPGMIGKVGNILGQTNVNISFMSVGRTFRGKQAIMAIGVDEEPDKETLEHIGHIPAIEEFVFLEL

SEQ ID NO: 14949 - protein, 226 aa, Thermoproteus tenax
MKHLLARKAAEYIREGSIVGLGSGSTAKAFIEELAKRVREDGLTVTLVSTSVDSELKAAEVGLDKYLAPLWAVDRIDIAVDGADELTRDRLFLKGGGGAMFREKVVDYRASTLIIIAESHKLVDRIPARHPIPIEVLPAAWRLVADDIVKRWGGKAVLRVCQCGGKLGPLVTDNGNYILDWAPPGPIDPALEDELRGIPGVIESGIFSKRRDAVVLLADERGVFEL

SEQ ID NO: 14950 - protein, 548 aa, Oryza sativa
MSVLIVTSVGDIEVDLHTDMCPLTTKNFLKLCKGNEGLVAGGLAFRKQLSGQFWRCRAGATGSGFDVKGMSFPGYSFFLVFLSLHYFVHIQNYLFSRFLSGAMATRFFDDEIHPELRHSKMGTIAMASAGENCNASQFYITLRDGVDYLDDKHTVFGMVAEGFDTITKINETYVDDKGRPFKDIRIRHTYVLDDPFDDPPQLSKLIPENSPVGKPQDEIAEERLEDNWVPPDETVAPEELEDTIRSKEAHTNAVILQSLGDIPDAEIKPQDNVLFVRELNKDEDLYTIFSHFGSVTSAEIIRDYKTGDSLCFAFIEFEKKEACERAFFMMDNCLIDDRRIRVDFSQSVSKQWRQFRQSKSNANKDGCFKCGALDLIARDCDQRAEQKNKGPNYILKDENTQRSGNKRRSYDLVFEDGENYNGQQDLRSADRRKIHKIDDRRSGLPPRGDRDRISRERTHIDENDKEGNRDRGNQKHEDYNRYCKPGERSSSRHDDRGYSKHESRSKYRDGDDDYRRQSGGSRYGRDKCDGERRYRGDDDHGRSNRHTR

SEQ ID NO: 14951 - protein, 500 aa, Cryptococcus neoformans var. neoformans JEC21
MPSLTQTKDLASLLSDASHFKQKGYINGEWVSASDGATFPLYNPATGAKLADMPHMPRSQVAEAINAAKAAFPAWAALTAYQRQNYLLKLFKEMEEHSEDLAIILCTENGKPLAESRVEISYGASFLTWNAAEALRTYGQTIPSPFPGTRNTVIKQPIGVCGLITPWNFPNAMITRKMAPALAAGCTVVIKAPAETPLSALAMCVLCERVGIPPGVVNVVTMDKGQREMAAGLELCENVKVSKISFTGSTPVGRLLMKQSSGTLKKLSFELGGNAAFIIFDDADLDLAVNGVILSKFRAAGQTCICANRIFVHSKIYDDFARRLVERVKAFKVGNGIEEGVTIGPLVSQRGVEKVERHVQDAVGLGAKVLVGGKRIDKGEGSCFYEPTVLVDVPRQCAVSNEETFGPLAPLFKFDDEDDVVERANSSEVGLAAYFFTKDLARTHRVAEKLEVGMVAVNTGAIAQSCVPFGGVKQSGFGREGGPSGIDEFMVEKLITIGGL

SEQ ID NO: 14952 - protein, 802 aa, Bacillus cereus ATCC 14579
MFTHVESFKSTFLEKLETMYGKSFKDSTTRDQYNTLGHMVREYMNSQWIATNESYRSGEQKQMYYLSIEFLLGRLLGSNILNLGIRDVCEQGLSELGISLQELEEVEADAGLGNGGLGRLAACFLDSLASLNLPGHGCGIRYKHGLFDQKIVDGYQVEFPEQWLLHENVWEVRRYDQAVEVSYFGSVEPLEIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWEQYPYEWDRIEAMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANVEIKDRVGEDNCFIFGLTAEEVLHYYQNGGYRASDYYHHNRHIKKVVDQLTNGFFAQSGAEFEAIYDSLVIQNDEYFVLRDFGPYAERQEAVGRAYENRTKWLEMSILNIAQSGHFASDRTILQYSNEIWGIGNAVKQF

SEQ ID NO: 14953 - protein, 427 aa, Burkholderia sp. 383
MSNNQILFERAQKTIPGGVNSPVRAFRSVGGTPRFVARAQGPYFWDADGKQYIDYIGSWGPMIVGHVHPEVLSAVQNVLADGFSFGAPTEAEIEIAEEICKLVPSIEQVRMVSSGTEATMSALRLARGFTGRSRIVKFEGCYHGHADSLLVKAGSGLLTFGNPTSAGVPADIAKHTTVLEYNNVAALEEAFGAFGDEIAAVIVEPVAGNMNLVRGTPEFLNALRALCTKHGAVLIFDEVMCGFRVALGGAQQHYGITADLTCLGKVIGGGMPAAAFGGRRDIMAHLAPLGGVYQAGTLSGNPIAVAAGLKTLQLIQAPGFYDALTAQTKRLADGLAAEARAAGVPFVADSIGAMFGLYFTERVPTSFAEVTKSDTERFNRFFHLMLDEGVYFAPSAYEAGFVSSTHDDAVIDATLAAARRAFAALAA

SEQ ID NO: 14954 - protein, 234 aa, Exiguobacterium sibiricum 255-15
MSTQYALVTGANKGIGLEIVRQLAEQDYHVFLAARDEANGQSAVASLASDKVTFVQLDVTDPASIEHAKQQILAVTDRLNLLINNAGIALDFGQTPITVDVDVLRQIFDVNYFGTFQVTQTFYPLLSNGKIINVTTDMSSQTSFAEGRIHPLNVLGYNSSKTALNAITLSLGTQFQENGPEIFGVTPGFTSTDLNGNAPGGKTTAEGAAVIVRYALDETNYNGKILNDQGIMPW

SEQ ID NO: 14955 - protein, 245 aa, Nicotiana tabacum
MATASSASAALRTISSSAKLTSSFPTTSASQKIRSFKLPNPLISQSLKLGTSTNSKSFYCKSQSGSTDSSTTKVQELSVYELNERDRGSPAYLRLSQKNVNSLGDLVPFSNKLYTGDLKKRIGITAGLCILIKHEEEKKGDRYEAIYSFYFGDYGHIAVQGSYLTYEDTYLAVTGGSGIFAGVSGQVKLQQIIFPFKLFYTFYLKGIPDLPSELLVTAVPPSPTVEPAPEAKACEAGATLKNFTN

SEQ ID NO: 14956 - protein, 227 aa, Zea mays
  misc_feature (191)..(191): Xaa can be any naturally occurring amino acid
  misc_feature (219)..(219): Xaa can be any naturally occurring amino acid
  unsure (1)..(227): unsure at all Xaa locations
MPPKKAAASKADVAKKQKVVEDKTFGLKNKNKSKNVQKYVQSLHQSVQPKPDPTKTAAKKKKEEEKAREKELNDLFKVAVSQPKVPVGVDPKSILCEFFKVGQCQKGFKCKFSHDLNVQRKGEKIDIYSDKRDGEEEDTMDDWDQETLEKVIASKNAEYQQNKPTDIVCKHFLDAVEKKQYGWFWVCPMAXQECRYRHALPPGYVLKSQMKALLEEESXKVAIEDEI

SEQ ID NO: 14957 - protein, 252 aa, Medicago truncatula
MASMSSLKMISSLNLSTSPLQTQNQIVSSGLSLSFPSRRNFNTSTTKQVSTTKRSSQNTRTNALFFNNQKQHQESSKPAKVQELFVYEINERDRGSPAYLRLSQKSVNSLGDLVPFSNKLYSGNLEKRLGITSGLCILIQNEPEKKGDRYEAIYSFYFGDYGHISVQGPYLTYQDTYLAITGGSGIFEGVYGQVKLQQLVFPFKLFYTFYLKGVADLPADLLGKPVDPSPHVEPSTAAKATEPHASLPNFTN

SEQ ID NO: 14958 - protein, 275 aa, Corynebacterium efficiens YS-314
MTPMTSSTGDFPPSRQPLDITRLRAALVDHGPYTRVDYTPTTGSTNGDLLDADREGAPDWTVATTDYQDRGRGRLGRPWTAPEGSQAIFSVLFRPRPSLLEHLGTVPLACGLALIDTLRSFGVDGVGLKWPNDVLINGRKLCGILVEATSLDTTPAVVIGIGINLNLTTGELPVPHATSLALEGYDIDRTDLLIRVLGHIHARISDWERGETVWLDDYRAVCSSLGQDVRVILPGDRELLGVAVGIAEGGQLMVRDEEGTIHTLSAGEVTHLRLQ

SEQ ID NO: 14959 - protein, 580 aa, Rhodobacter sphaeroides 2.4.1
MSLDQAIPEALQALRTRFGAAVRAEQATGEAFPVLWLDASVWEAAHRFLREEIAAPFPLLADLWAIDESLRQHRTGQPASRITLCSHLVSLVRNADLRLKLATDGRAPSIAGVYANADWYEREAHDMFGLDFGRETRRILMPPTWEGHPLLKTHYARATEKPPFVLTDRLFEAEERATITDPDLLGLPKLRDGEELMVLNFGPHHPSTHGVLRILLGLDGEEVVWAWPDIGYHHRGAEKMAERQTWHGFIPYCDRIDYLGGVISELPYLLAVERLCGIAVPPRAQMIRVMLCEFYRIMNHLLFYGTMAQDVGAMSPVFYMFTDREKGHEILNAITGARMHPAFFRIGGVAMDLPDGWDAMVRGFLDWMPARLDEYERMVLRSELFRARTVGVGAYDTDTALTWGTTGPGLRATGCDWDLRKLRPYSGYEQFDFEVPLGQRGDIFDRTRVRADEMRESLKIIRQCLENMPEGPVKADHPLTTPPPRGAMQKDIETLIAHFLQSSWGTVVPAGEATGQIEGHRGLTQYAIVSDGGTQSYRTRIRTPSFAHLQMIPKIVPGMTVADLVAHIASIDFVMSDVDR

SEQ ID NO: 14960 - protein, 166 aa, Brassica napus
MKLLQTQSSALFNLLPSPNFTKPIDKRGFVTPKRYPSPPISLRCSVSTASDTPSTATNHHLSASSHKPFPAEVSRSIMELSSVGTLSTLTHDGWPLGVGVRFAVEQDGTPVLCLNRTFSPDKRSSLHVQLEQCGLRTPQCTIQGSIARPGDDNALKRVSATWRKKF

SEQ ID NO: 14961 - protein, 290 aa, Helicobacter pylori J99
MDYKRFKGKHANIVIEIISLLEKGVKKAQEILEKPDAGSYTQLENSSGDTPIKADLALDKFLEETFLSLENVKSVFSEEKETPVTKENGSYLIAYDPLDGSSVMEANFLVGTIIGVYEKDYKAQNLVASLYVVFGHKIELVVALEEVYRYAFYQNKFHFIETIVLENKGKIIASGGNQKDFSLGLKKALEGFFAENYRLRYSGSMVADVHHVLVKKGGMFSYPQKKLRKLFEVFPLALMVEKAKGEAFYFDKGVKKRLLDQSVESYHEKSECYLASPHEAQILEKHLKGE

SEQ ID NO: 14962 - protein, 430 aa, Flavobacteria bacterium BBFL7
MSFSYQRSSALFKEAQKVIPGGVNSPVRAFNAVGGSPVFVDHAKGAYLYDVDGNKIIDYIASWGPMILGHAFDPVVDAVKAAADKGTSYGMPTELETQIAELAISMAPNVDQIRMVNSGTEACMSAVRLARGFTGRDKIIKFAGCYHGHSDSFLIQAGSGAVTFGSPNSPGVTQGTAKDTLLAQYNNLEQVADIFKQNEGEIACVIIEPIAGNMGCIVPQEGFLEGIRSLCDENGALFIFDEVMTGFRLAAGGAQETTGVKADIVTYGKVIGGGLPVGAFAARQEIMNHLAPLGPVYQAGTLSGNPLAMSAGIAMLSHLNSNPNIFTSLAQKTERLHKGIEAVLTEKGMPYQINRYGSMMSVHFTDQPVVDFASAATGNNDWFKKFFHGLLNRGIYLPPSAFESYFLNNALSTEDIDKTIDASREVVAEW

SEQ ID NO: 14963 - protein, 309 aa, Brassica napus
SIPTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKYFTDLFDYLPLTALVESEIFCLHGGLSPSIETLDNIRNFDRVQEVPHGGPMCDLLWSDPDDRCGWGISPRGAGYTFGQDISNQFNHSNSLKLISRAHQLVMDGYNWAHEAKGGTIFSAPNYCYRCGNMASILEVDDCRNHTFIQFEPAPRRGEPDVTRRTPDYFL

SEQ ID NO: 14964 - protein, 254 aa, Arabidopsis thaliana
  misc_feature (39)..(39): Xaa can be any naturally occurring amino acid
  misc_feature (232)..(232): Xaa can be any naturally occurring amino acid
  unsure (1)..(254): unsure at all Xaa locations
MKKVTSSKIPAKDDWVAVAITDDDLVVELLLRLKHAGTXVSDNPAVILPPLRWGIRQRRSRSSRFGGGGGVLVSLKKDVDSVRASPKTPLSWSGGSGSGGGSASPSADGFEDNSRQASCSTSTGSGSKVFPTNEITSCFSKRLKKRKSSFELKNEENLKLKERLDLEKEIASLRATFDEQNLRNQKLKRIKLDLNSGRVTNKKPVDLIRKSQLERLQGSKSCKTSYSQNQGXSFFVLPDLNMAPSEEEILYGTS

SEQ ID NO: 14965 - protein, 237 aa, Triticum aestivum
MVVKEFTVDLNQPLVFQVGHLEEHYQEWVHQPIVSKEGPRFFANDTMEFLTRTKWWAVPVIWLPVVCWLFAKSIRMGHTIQEVILMALFGVFVWTFIEYALHRFLFHIETKSYWSNTAHYLIHGCHHKHPMDSLRLVFPPAGAAIICVPFWNVVAFFASPSTTPALFAGGLLGYVMYDCTHYYLHHGQPSKDPAKHLKRYHLSHHFRIQDKGFGITSSLWDAVFGTLPSSNIVAKLS

SEQ ID NO: 14966 - protein, 229 aa, Zinnia elegans
MKMQSNYPFMLIKLLTLHSLLALSAAQDFDFFYLVQQWPGSYCDTKQGCCYPSTGKPASDFGIHGLWPNRNDGSYPSNCDSSNPFDASKISDLTSHMQSEWPTLLCPSNNGLAFWGHEWDKHGTCSESVLNQHDYFATTLSLKNEINLLQALRSAGIQPNGQKYSLSSIKTAIKQASGYTPWVECNNDSSGNSQLYQIYLCVDSSASGFIECPVFPKGSCGSSIEFPSF

SEQ ID NO: 14967 - protein, 240 aa, Yarrowia lipolytica CLIB122
MVRSDWRAQEIRRVMTFTGSKEKTARDALEKFDWNVEVAIDHILNTPQVDLSGASKVFDKYRNADSDEIDLDGTIQYITDLGLSLEEPTVLAVAMTAGSPSVGTFTRKPFVEGWAAIGGDTLPAQQKLCRSFAESMTSLNADFQKIYKFTYGFLLQEGQRVLPQETAVDYWRLLLTGKYEHLDKWLSFVTEKYKRNISRDAWNMLYEFMLFQAKDPSLESYDEDGAWPSVIDEYVEFLKE

SEQ ID NO: 14968 - protein, 343 aa, Burkholderia xenovorans LB400
MKALAKLERAPGLTLTDVKKPEVGHNDVMIRITRTAICGTDIHIWKWDDWAQKTIPVPMHVGHEYVGEIVEMGQEVRGFAIGDRVSGEGHITCGFCRNCRAGRRHLCRNTVGVGVNREGAFAEYLVIPAFNAFKIPPEISDDLAAIFDPFGNATHTALSFNLVGEDVLITGAGPIGIMAVAIAKHVGARNVVITDVNDYRLELARKMGATRAVNVSRESLRDVMADLHMAEGFDVGLEMSGVPSAFTGMLEAMNHGGKIALLGIPPAQTAIDWTQVIFKGLEIKGIYGREMFETWYKMVAMLQSGLDLSPILTHHFKVDDYREAFATMLSGESGKVILDWTAA

SEQ ID NO: 14969 - protein, 229 aa, Cicer arietinum
MEFQGSILIKAILVLQCFSILCASQSQDFDFFYFVQQWPGSYCDSKKACCYPTTGKPDADFGIHGLWPNYKDGTYPSNCDPSKPFDESQISGLTSSLQKNWPTLACPSGDGITFWTHEWEKHGTCSESVLNQHDYFETTLNLKQKANLLKALTSAGINADGGSYSLSNIKTAIQDGVGFAPFIECNRDSSGNSQLYQVYLCVDNSGSDFIDCPVFPHGKCGPEIEFPTF

SEQ ID NO: 14970 - protein, 476 aa, Anabaena variabilis ATCC 29413
MRRTKIICTVGPATSAPERLEALVEAGMNVARLNFSHGAYDFHAQTAQYLRQISADRQKPVAIMQDLCGPKIRLGTLPPEGLTVEAGQEVTFVLQEKGNSLDELPLPLPTLFAMVRPGEPILINDGRVKLIVTDRDADRIRAIAKIGGLLSTRKGVNLPATRLPVSSITEKDLQDLRFGIELGVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQTMHDIATTTEKSLQEGSKNCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 14971 - protein, 343 aa, Anabaena variabilis ATCC 29413
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 14972 - protein, 620 aa, Escherichia coli K12
MDSHTLIQALIYLGSAALIVPIAVRLGLGSVLGYLIAGCIIGPWGLRLVTDAESILHFAEIGVVLMLFIIGLELDPQRLWKLRAAVFGCGALQMVICGGLLGLFCMLLGLRWQVAELIGMTLALSSTAIAMQAMNERNLMVTQMGRSAFAVLLFQDIAAIPLVAMIPLLATSSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLLENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 14973 - protein, 531 aa, Neurospora crassa
MGNSSSKDAGASSKNRGDDDLKSYPSFSKSDTKDSSRSFRGLRSKIPGGSKTDSPRNSTILSSEEVAEKMNALSGKNGRPSVHTRPSRRDMSPSPASPSTSSPSSPSLDTATLASPTGEPLPPPSPVHNATGGHHDVRAAQESGEVDHISDQPPSGGGGANSNQQPGQSILVKRENTINPVYDTPNQDPQNEQAVSGVAMSDIKDIDLDDFIKRLLDAAYAGKVTKSVCLKNAEIVAICHRARELFLSQPALLELDAPVKIVGDVHGQYTDLIRMFEMCPFPPNSNYLFLGDYVDRGKQSLETILLLMCYKLKYPENFFLLRGNHECANVTRVYGFYDECKRRCNVKIWKTFVDTFNCLPIAAIVAGKIFCVHGGLSPALGHMDDIRNIARPTDVPDYGLLNDLLWSDPADMDQDWEANERGVSYCFGKKVISDFLATHDFDVVCRAHMVVEDGYEFYTDRILVTIFSAPNYCGEFDNWGAVMAVSTELLCSFELLKPLDSAALKTHIKKGRHRRNNMLNSPPAHFNPQSV

SEQ ID NO: 14974 - protein, 513 aa, Triticum aestivum
MVSNGELSQPQAGEYGLAVMRRRPKTKIVCTLGPASRSVDMIEKLLRAGMCVARFNFSHGSHDYHQETLDNLHAAMDRTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAFDSEATEEALRFAMKNAKEMGLCNAGDSIVALHRIGNASVIKLLTV

SEQ ID NO: 14975 - protein, 336 aa, Xanthomonas oryzae pv. oryzae KACC10331
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPEQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPDETAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAAATRYHLDADKA

SEQ ID NO: 14976 - protein, 738 aa, Gibberella zeae PH-1
MAGIVAVTWKFSSEREQWAHRPEPGQWYASRHWSKQLKQWDAEDHEDNLELKTIIWGSLMFCGETETLIPFLNPRASDKCWKRILEMNRSIRQSSESFESCLPSQSIHGLTSDLVPPASIKFQEPKPQLLASRAFRLAGLAVGLGLSALTAYQRNQAQQMSSHAERHGHLDATAGREVVYCHACANEWYRDEDGLTCPECRGEITEIIDPENDPRDLDHHSSASTSPELHPYDSDPDEADIDEHTNQGFVFRRNIREGSGHHHHHDPAYAPTIESFVNMLNQFGARTPDGRSFSHGPGEHGEHQGHGEHERQGHEGQAGEGEHAHPNFARVQRATFTGPFGSGRTTITMISTPMHTTHTVPPGAPGLQTFQEYAQSLSRRPDGPRGLRVTAISLTMGANQPSSIFSDLLRDTGPPPGHEHVGEDGMGGGPPPGFGRGLQDLLNLLTPGNAVHGDAVYSQEALDRIITRLMEANPQSNAAPPATDEALRNLERKPVNKQMLGSEGKAECTICIDEMKEGDMATFLPCSHWFHEECVTLWLKEHNTCPICRTPIEKNDRGASNNSGNNNSSGSNQSQGPASGPSSDRSNPFAAHMPNAYNTDWEPFDWTSQPHSHSRPAQYSRPPSQSQSRLNEVLRNISTQREERDREHGRDRATTSGYSYDTSRLQRRSSHSPTSPRARAPSEHGARMRQRSPSQSSRRSTADSDQQSRTSGHGPISWLRGQFSRGPGTGSPRDGSRQ

SEQ ID NO: 14977 - protein, 178 aa, Triticum aestivum
  misc_feature (141)..(141): Xaa can be any naturally occurring amino acid
  misc_feature (145)..(145): Xaa can be any naturally occurring amino acid
  unsure (1)..(178): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYXDAYXRIIGFTTSQVQCVSHRKQRAARSGRLNSHHTAH

SEQ ID NO: 14978 - protein, 133 aa, Triticum aestivum
  misc_feature (95)..(95): Xaa can be any naturally occurring amino acid
  unsure (1)..(133): unsure at all Xaa locations
DTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERXPIFLGSSDDVEEIKALYAEEAKKARICMMIGGHRPQGV

SEQ ID NO: 14979 - protein, 469 aa, Xanthomonas campestris pv. campestris str. ATCC 33913
MSVENVEKLIKDNKVEFVDLRFVDMRGVQQHITFPASIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGAKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLTKGGVNLFSGDGYGGLSQMALWYIGGIFKHARAINAFANSGTNSYKRLVPGYEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 14980 - protein, 309 aa, Triticum aestivum
  misc_feature (111)..(112): Xaa can be any naturally occurring amino acid
  unsure (1)..(309): unsure at all Xaa locations
NSARGAAVEDAVARVSQLWDALTAEQKEHWVGLFFYTELLQTFYLLRVCDYKAASKHVERLDTAVKNEMERGHRIKELGTELSAVEGTLAQTMLKERERVALAHKQGQLRXXLQALCGYDTLKDVLDYGDKLLLAPPPMHGEWLPRTAVFVLVDLMVVMVSRPKGIFKECGKRIHSGLQLIHEELSKLGIVDGVTEGDLEHSTIWTAGLYLMLLLQFLENNVAVELTRSEFVEAQEALAQMKNWFTRFPTILQGCESTIEMLRGQYAHSVGCFDEAAFHFLEALKLTENKSMQSMCQVYAAVSYICKGD

SEQ ID NO: 14981 - protein, 291 aa, Zea mays
MAAAPSSLVSSHLSRLADLRRAAAPATPTVPQQLRVGFSRRRAQRVVAMAGSGKFFVGGNWKCFLYPLIQNGTKDSVSKLVSELNAATLETDVDVVVAPPFIYIDQVKNSLTGRIEVSAQNVWIGKGGAYTGEISAEQLVDIGCQWVILGHSERRHIIGENDEEKLLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 14982 - protein, 143 aa, Kineococcus radiotolerans SRS30216
MTDTTAQRTLVLVKPDGVRRNLSGEVLRRIEAKGYTLVALELRTADRELLAGHYAEHEGKPFYEPLVEFMLSGPVLAAVVEGHRVIEGFRSLAGTTDPTTAAPGTIRGDLGRDWGLKVQQNLVHGSDSPESAAREIGLWFPNL

SEQ ID NO: 14983 - protein, 269 aa, Shigella flexneri 2a str. 301
MEKKIGFIGCGNMGKAILGGLIASGQVLPGQIWVYTPSPDKVAALHDQFGINAAESAQEVAQIADIIFAAVKPGIMIKVLSEITSSLNKDSLVVSIAAGVTLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 14984 - protein, 515 aa, Yarrowia lipolytica CLIB122
MLRALNTVQRLSSTRAMSTSSISSLLKNPNLLRNQGYVNGQWVSSKTGDTFSVENPATGETLGQVPEFSVAEADEAVQHAQTAFKTFKHTTGRERSKMLRKWYDLMQENAGDLATLVTLENGKSLADAKGEIGYGASFFEWFSEEAPRIYGDIIPSANPANRIYTIKQPIGVCGIITPWNFPSAMITRKAAAAVAAGCTMVIKPGSETPYSALALAYLAEQAGIPKGVVNVVTTKKNTRAFGNALCENPTVKKVSFTGSTGVGKTLMGASASTLKKLSFELGGNAPFIVFEDADIDRAVDGAIASKFRGTGQTCVCANRIYVHESIAEKFAERMAAVVKDFKVGNGLDPNTTHGPLIHEGAKGKIQEQVDDAVKKGGKVLIGGSDAPEIGKAFFQPTVISGAKSDMLIASEETFGPIAAIFPFKTDAEVIELANKAEVGLAGYFYSKDVYRIQQVAEALEVGMVGVNTGLMTECALPFGGIKESGFGREGSKYGLDDYMVLKTIVVSGVEPHIQP

SEQ ID NO: 14985 - protein, 315 aa, Ustilago maydis 521
MSSKDMSLDELKDLQKQLSKLATSSDSEAILSIFSKLKSGLSAPTEDVIRQSKIGVAVGKMRSHSDKKVADQAKSLVKDWKAIVDKQRAQSSANSSKAPSSTASPAPTTSKPDGTINGNGTASASPASTPSAAAKSTSSTKIDFEILNDKVRNACLKLLYQSLEIGKESHVWNDSQIFDAAVAVEAAILSNQGKGSVTADYRNKVRSLSLNIKDKNNPDLRVRVVEGDIAADKLVTMTNEELASDKRKREIEELQMQNLFKAKGAAAQEAETDAFQCGRCKQRKTRYYQMQTRSADEPMTTFVTCTNCNHKWKFC

SEQ ID NO: 14986 - protein, 116 aa, Arabidopsis thaliana
  misc_feature (90)..(90): Xaa can be any naturally occurring amino acid
  misc_feature (99)..(99): Xaa can be any naturally occurring amino acid
  unsure (1)..(116): unsure at all Xaa locations
MASSMLSSATMVASPAQATMVAPFNGLKSSAAFPATRKANNDITSITSNGGRVNCMQVWPPIGKKKFETLSYLPDLTDSELAKEVDYLYXANKWVPCVXNFEFEHGFCVTREQRVT

SEQ ID NO: 14987 - protein, 532 aa, Synechococcus elongatus PCC 6301
MLDASISPVVLVILDGWGYRNATEGNAIRTAETPIMDALWEAYPSTLIHTSGKDVGLPDGQMGNSEVGHLNLGAGRIVPQELVRITDAVEDGSILENPALLQACSAVRQHGSKLHLIGLCSDGGVHAHLDHLGGLLKLAAAQGIQDVYIHAITDGRDTNPTEGVNCITKIERLIATAGVGQIVTICGRYFAMDRDRRWDRVRKAYELLTIDGEGCGQTATEVLQETYAKGVSDEFVEPTRLAPGAIAPGDGVIFFNFRPDRARQLTYAFVEAEFEGFERDLIQPLTFVTFTQYDANLNVPVAFEPQNLTNILGEVVANHGLRQFRTAETEKYPHVTYFFNGGIEEPFPGEDRELIPSPMVATYDRAPKMSAQAVTDAAIAAIDKGIYSLVVINYANPDMVGHTGKMGATVEAIETVDRCLGRLVSAINRAGGTALITADHGNAEYMWDENGEPWTAHTTNLVPFIVVEGERRKLPGFGTEIPLREDGRLSDIAPTILQLLGLPQPVEMTGRSMIEPAAYEVKQGRTPVKVGV

SEQ ID NO: 14988 - protein, 467 aa, Xanthomonas axonopodis pv. citri str. 306
MSDVLPIILSGGSGTRLWPLSRESYPKQFLPLVGDKSMLQSTWLRAAPVAGHAPIVVANEEHRFMAAEQLQQLGVKPSAILLEPKGRNTAPAIAVAALEATRDGADPLLLVLPSDHVIQNEAAFQAAVTLAATAAEQGKLVTFGIKPTAPETGYGYIKASAGAGASAVERFVEKPDLATAQSYLASGEYYWNSGMFLFRASRYLEELRKFHPAIADACQKAWENGKRDADFTRLDKDAFAASPSDSIDYAVMEKTADAVVVPLDAGWNDVGSWSSLLDVSNQDAQGNAHHGDVIQLDCQNTYAYGSRLIAMVGLEDVVVVETPDAVLVGHRDRIQEVKDVVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 14989 - protein, 333 aa, Aspergillus oryzae
MQSVLKPIIGPKKEIHDLSGRVALITGGALGIGYEVARAFVLNGARVIMVNRKEEQGQAAIDKIKEEAGADAKIEWVPCDMGNLAQIKEVFTGIREREERLDLLILSAGINANQYGETHDKIDRHFQVNWLGQFYVCNLLFPLIRKTSKLPDTPAPRIVWETSEQHRAAPKVVHFGSLDEINNPAIDNTELYGRSKLAIILGVKYGFLDRVIKPNEDNIYVLSVHPGAVNTTMQQQWKDAYPGLLGKVLTTAMLAIGRDVEQGAFSALWAATSPEIEEKSWNGYYFSDSAQPGKETSQASDPTLGASLWDLSHRIIQDKVGKDAIVDWNSSKS

SEQ ID NO: 14990 - protein, 256 aa, Streptococcus agalactiae A909
MKIGIIGVGKMASAIIQGLKQTQHDIIISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLAKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 14991 - protein, 279 aa, Rubrivivax gelatinosus PM1
MSSHSSPADTPSARKPVTLHTLREMHARGEKIAMITAYDASFAALVDTAGVDCILVGDSLGMVLKGQSSTLSVTMEQIGYHTRSTSRGTKAAFLIADMPFGSYQENPVQALRNAGTLMAAGAQMVKLEGGGWTPETVNFLVERGVPVCAHLGLTPQSVHALGGYRIQGKDEAGAATLRRHAKALADAGAAMMVLELMPSRVAREVQADNPGLMTIGIGAGAGTAGQVLVLHDMLGVTRGRLPRFVRNFMDSATSIEDAVRRYVAAVKDGSFPDETLHAY

SEQ ID NO: 14992 - protein, 358 aa, Bradyrhizobium sp. BTAi1
MADSIQEVLYAFAKGEMVVVTDDDDREGEGDLIVAASLCTPDKMAFIIRHTSGIVCAPITADDARRLRLDPMVAHNDSNHTTAFTVSIDYKPDGGTGISAEERASCCRALANPNAGANDFARPGHIFPLIARDGGVLLRSGHTEAAVDLCKLSGLPPVGVISELMNDDGTVMKGEQVVRFAAAHNLKHVTIADLISYRQAREKLIERVSTFTTESPIGPLQGFAYRSPFDPITHAAFVYNGIGDGKNVLTRLHKPNIVKDLIAGPQRIQAVLQHFKKAGRGILIYLRDGAAGVPVEPVTEPHTAEADRHRQWREVGVGAQILRDLGVTSIRNLTSSAHDYKGLSGFGIEIVANERLEG

SEQ ID NO: 14993 - protein, 344 aa, Streptomyces coelicolor A3(2)
MIRLMTAMRTAGGGPLVAITECDHDSFDIERDVVTSAGGQLLVTQSRDADTMVVNCAGADAIVVQYAAITEQVMDRLPRLKVIGRYGVGVDSVDVEAATRRGILVCNVPDYGTEAVSDHAIGLALSVARGIPRLDRGVRAGSFDLPAVRPLYQVGQRVFGVVGMGLIGAATARKAAGLGYDVIAYDSAADPDAQTFRGFRSVGLHELLERAQVVSVHTPLTEQTRGLLGADAFARMRPDAIVVNTSRGGVIDTGALVDALKRGAVAGAGIDVHEIEPLPRDHPLTSFDNVVLTPHLAWYSEESYAELKRRTVENVVDACAGRTPRNVVNPEALPAAAQRSEGRR

SEQ ID NO: 14994 - protein, 274 aa, Idiomarina loihiensis L2TR
MNDIRNIAFIGAGNMTQSIVGGMCKSGYPADKVWVSNPSDAKLEKMKSELGVNTSNDNLEVVNNADAIVLSVKPQLMAEVCAHLRENVHNLTDKLIITIAAGIRIPKYREYLGENIRIIRVMPNTPSLVGQGMSGLVTDDSVDEADKNFVTEAFNGVGETLWVSDEDQLDILGAVAGSGPAYFFEFMDSLAKAATELGFDAEKARAMVQQTCLGAAQMAKESELSLEDLRKQVTSKGGSTAKGVEAYQDSDLHGISEKAVKAAVNRNQEMAKLF

SEQ ID NO: 14995 - protein, 486 aa, Kineococcus radiotolerans SRS30216
MSQENGRGPDRADAEERQRTTTKVVLISVVAAIGGFLFGFDTAVVNGAVDAVAEEFRLAAGLKGFAVSCALLGAAVGAWFAGRLADRFGRKAVMVIAGALFAVSAVGSAFAFGVWDLILWRVVGGVGVGIASVIAPTYIAEVAPAHIRGRLASLQQLAITVGIFAALLSDAFIANTAGGASETTWFGWDAWRWMFVVGVIPSLVWALLALQIPESPRYLIAQGKTQRAGEVLREVLGTRSLEAVQRKVADIKNSMRREDEPSLRDLRGPRFGLLPIVWVGILLSVLQQGIGINVIFYYSTTLWKAVGFDESDAFTTSVITSVTNVVVTFIAIATVDRIGRKPLLTVGSAGMFLSLTVMAIAFSQASGSGQDVSLPQPWGTIGVIAANVYVISFGATWGPVVWVLLGEMFPNRIRAAGLAVAAAAQWLANFAISTSFPSLAKLGLQYAYGLYAVIALLSFVFVRRAVQETKGRELEEIGAETTSTAP

SEQ ID NO: 14996 - protein, 341 aa, Oryza sativa
MDHAAEAQRTDLMTITRHVLNEQGRHPESRGDFTILLSHIVLGCKFVASAVNKAGLAKLIGLAGDTNVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 14997 - protein, 425 aa, Cryptococcus neoformans var. neoformans B-3501A
MTSLPQALKRAQQTYANRNRKSYEAHQAASRHLPGGSTRSSIFIHPFPLCIQKGQGVKITDLDGHEYVDFVSDFTSGIYGKSHPVLIDAIKEALDNGLQLGAHTLAETTLASHFTSRFPSIELVRFANSGTEANILAISTAVKHTGRKKVLVFEGGYHGSVMSHFHMKGGDGDDLKVPFDFVVCSYNDPKGADALISQHPSEIGAILVEPMLGAGGCIPGDPAFLQFLREKASSIGAVLIFDEVQTARLSTGGRQKILGITPDLTTVGKFFGGGFAFGAFGGKKEIMEKFDARKGGAISHGGTFNNSPLTMVAGATAMEKILTEDALKNLNKLGDWMREEINRMFTSDGSPFLMTGLGSINQFHCTLSSNQNQVLDLLFFYLLERGFWIAQRGLVSLSFAMTKEDVQRFIEAAVEATQKVKATLK

SEQ ID NO: 14998 - protein, 523 aa, Salinibacter ruber DSM 13855
MDSSKRHLLLILDGWGLADDPSVSAVEQADTPFVDHLYDEYPHGVLKASGLEVGLPDGQMGNSEVGHTNLGAGRVVYQEILRISKAIEDGSFFENDALVRAARHAKASDQKLHLMGCFSDGGVHSHLEHLYGLLELARREGLAPAQVNVHAFTDGRDTDPHGGVDYVEQFQKKADEIGVGRLASIVGRYYAMDRDERWARTERAYRLLTDGTGAAFDDPVTALKASYDDGVTDEFVEPRRIRADDADAFGDHGTRIEDGDAVVYYNFRSDRARQLTRAFTEADFDGFERERPDDLLFVTMSPYDDEFDLPVAFEKLNLEGTLGEVLSARGGRQLRAAETEKYAHVTYFFSGGREAPFDGEDRVLVPSPKVDTYDQQPEMSAPELADRVSRSLREADYTLAVLNFANPDMVGHTGDFEAAVAACEAVDRGARQVVEAARDQGYSVSIIADHGNADRLQNPDGSPHTAHTTALVPHIILKDGFEGPVRDGKLGDVAPTILTLLGEDVPDAMDGEVLVPAERAAAS

SEQ ID NO: 14999 - protein, 193 aa, Triticum aestivum
  misc_feature (133)..(133): Xaa can be any naturally occurring amino acid
  unsure (1)..(193): unsure at all Xaa locations
ALAGGPLVQARNFAVMTGANAGISCVMRRVRGVEDVQGSMAAAFGSGALFSIVSGMGTPNPVVNAITTGMAFAVFQGGFFIVGQKFSKTKTHNEDMNYSRARNMLSQLGLQNYEKNFKKGLLTDETLPLLNEXAPRDVIIPPGSKICLYLRPIKNKTLGSPEITLELIGIAKHSFCPGWGKLYGRAKFPPVPT

SEQ ID NO: 15000 - protein, 411 aa, Bordetella bronchiseptica RB50
MNTIYDSAAVAAGRRVAARMARVTTSKIYLAIAKVADMQAQGMQVASLTAGEPDFDTPAHVIEAAVQAMRGGDTHYTPVRGSLAMREAVRQKFQRENGLAFRDEEVMVGTGSKQVIANALAVTLETGDEVLLPVPYWAAYTGMVYAAGGVPTFVGTRAEDGYKLTPQALRAALGPRTRWVILNTPSNPSGLVYGSDELRALGEVLRERPDVLILTDEIYEHLNYTAEPPASLRKLCPDLAERIVVVNGVSKAYAMTGWRLGFAGGPADIIEAMANLQAQTTLAPCSISQAAAVAALNGPRESIDAMAAAYRRRRDLVMQIAGGQPGVRLQRPDGAFYAMLDLSEALAGGERFRGDPEPDQAFCEWLLETRHVAAVPGSVFGAPGSVRISFATDEQTIERGLTGLLDAAAHC

SEQ ID NO: 15001 - protein, 488 aa, Ruegeria sp. PR1b
MTRTGETPKTVQMITPVLLCGGSGTRLWPLSRKSYPKQFVPLMGEETLFQASAKRLAGVAEGLSFGAPLVLTNSDFRFIVTEQLQAVGIDPGAILIEPEGRNTAPAVLAAALRAQAEDPEAVLLVAPSDHVVPDVAAFHAAISQGLAAVAEGQMVTFGITPTHAETAYGYLELAAAPDADGAPLALKQFVEKPDAARAAEMLAAGNFKWNAGIFLFAARDIIAAFTAHAPALVAPVQAALDQAQVDLGFLRLAPEPWAQAEDISIDYAVMEKARNLSVVPFDAAWSDLGGWDAVWRELGPDDNGVVTSAGATAIDCHDTLLRSDSEGLEVVGIGLEGIMAVAMNDAVLVADKSRAQDVKLAVSALKAKGAAQATAFPKDHRPWGWFESLVVGERFQVKRILVHPGASLSLQSHFHRSEHWIVVEGTAKVTVDDEVRLVTENQSVYIPLGAVHRMENPGKLPMVLIEVQTGAYVGEDDIVRYEDIYARS

SEQ ID NO: 15002 - protein, 76 aa, Triticum aestivum
  misc_feature (67)..(67): Xaa can be any naturally occurring amino acid
  misc_feature (72)..(72): Xaa can be any naturally occurring amino acid
  misc_feature (75)..(75): Xaa can be any naturally occurring amino acid
  unsure (1)..(76): unsure at all Xaa locations
MAEQTFIMIKPDGVQRGLIGEVISRFEKKGFYLKGLKLQNVEKSFAEQHYADLSSKPFFAGLVEHIXSGPVXSMXW

SEQ ID NO: 15003 - protein, 462 aa, Desulfitobacterium hafniense Y51
MSSEKDHHVELHRGLKNRHIQMIALGGAIGTGLFYGSATTIQLVGPAIIVSYLLGGTAIFFIVRALGEMCVDQPVAGAFSYFAYKYLGDFPGFFSGWNYWFNYIAVSMAELTVVGVYINFWYPNVPQWVTALAFLVIITLINLINVEAFGEFEFWFALIKVVAILAMIAFGLVMIFFGLGEQGAVGFSNLWTHGGFLPNGVWGLLLSLVIVMFSFGGVELIGITAAEADDPKRSIPKAINQVVWRILIFYIGALTILMILYPWDQIGTSGSPFVEIFSAIGIPAAAHILNFVVLTAALSVYNSGIYSNGRMLHGLALQGNAPKFLTKVSRNGIPINGVFASSAVTLIAVILNFLVPGKVFLYLISIATIAGIFNWAMILVTQLRFRKVEAEKGREDQLQFKMPLYPISNYIALAFLAMVVVLMAYIPDMVYSLYIGPIWIIILYIGYKFLRRNPETKPPHRE

SEQ ID NO: 15004 - protein, 410 aa, Erwinia carotovora subsp. atroseptica SCRI1043
MAKVSLEKDKIKFLLVEGVHQSALDNLRAAGYTNIEFHKGALDPEALKASIRDAHFVGIRSRTHLTEEIFAAAEKLIAVGCFCIGTNQVELSAATKRGIPVFNAPFSNTRSVAEMVIGEMLLMLRGIPAANAKAHRGIWHKLAVGSFEARGKKLGIIGYGHIGMQLGILAESLGMHVYFYDIESKLPLGNAQQVRHLSDLLNMSDVVSLHVPENESTHNMMGAEELALMKPGAILINAARGTVVDIPALCEVLSSKHLSGAAIDVFPQEPATNSEPFLSPLCEFDNVLLTPHIGGSTQEAQENIGDEVAGKLAKYSDNGSTLSAVNFPEVSLPVHGARASRLLHIHENRPGMITKINQIFAEQGINIAAQYLQTTPEIGYVVIDVETDGAQTALQLMKAIPGTIRARLLF

SEQ ID NO: 15005 - protein, 219 aa, Erwinia carotovora subsp. atroseptica SCRI1043
MTQDELKKAVGWAALDYVRPDTIVGVGTGSTAAHFIDALGSIKHQIKGAVSSSDASTEKLKSLGIPVFDANDVDSLDVYVDGADEINGHMQMIKGGGAALTREKIISALSRQFICIVDASKQVDVLGKFPLPVEVIPMARSYVARELVKLGGQPEYRQGVVTDNGNVILDVHNLNIMDAVAVENHINGIAGVVTVGLFANRGADVALVGTADGVKTVTK

SEQ ID NO: 15006 - protein, 236 aa, Triticum aestivum
  misc_feature (82)..(82): Xaa can be any naturally occurring amino acid
  misc_feature (90)..(90): Xaa can be any naturally occurring amino acid
  misc_feature (122)..(122): Xaa can be any naturally occurring amino acid
  unsure (1)..(236): unsure at all Xaa locations
MIEQVCTKKQAGTGPEFPGYRRPTRPVTNSRHLEDLYSRYKERDADMIMVEGTSQLCNDLLVDPQDVVMLVISWHMKAAMIXTSMTRESXTMCEFTRQEFIDGLQSIGVDSIEKLREKLPFXRAEIKDDNKFREIYNFAFAWAREKGQKSLPLETAIGMWRLLFAERHWPLIDHWCQFLQVRHNKAISRDTWSQLLEFVKTIDPQLSNYDEEGAWPYLIDEFVEYLTENGCVQRNK

SEQ ID NO: 15007 - protein, 267 aa, Desulfitobacterium hafniense DCB-2
MKKISFIGAGNMAEAIIKGLMVTGSYEIRVTNRSNQAKLAQMKEDYGVIPVSFREAVKDSEIILLAVKPKDVGEALAQIREGISSNQLLISVAAGIPLALLEKHLPHCPIIRAMPNTSSAVLHSMTGLVKGQGVNEAKQRDVEDIFGAVGKYIWITEEQINPLIAMSGSGPAYFYLFTEALVKAGVDMGFSQEVAENLAKETLMGAAKMLAQSGKSPGELRVAVTSPKGTTQEALEVFREQGLEELVAQAAKACKHRAQAMEREYLG

SEQ ID NO: 15008 - protein, 441 aa, Yarrowia lipolytica CLIB122
MGEKPNRIGRANISYINHDHIFLPSFQPSYPSRQLHPLISSQNKVHSSIVHLPKVASPSSPETQQHSQAPLFITHIMSGLPQALASGFAARVREGGTTLYINTTPMLRSARHNTAVNYAEFEEDFDANDFEDDDDDDQSQRESRDGSEEAEGDEDGTKKEEQDKFAGLKAPLVSNEPKRAAPPVRPVMYPQEVLEELSQVKEPTLIPIRVAVENIDVFRVQDFFLWDADEKILTPEQFATLTCADLDVPIGYSAQMSAQIKKQLAEYTAAPALPKDVEVHVIVELAVTVDKIVYEDKFEWDLSGEYATPQEFARTVVQDLGLGQEFYPAITYQLYETLGKLQKAWLERSIPLDVDNRAAFGLEAGLRVDQDNLGESWVPRVEEMTPEEMQKREMERDRSSRRLKRESARMAEVPYVDLDSLYSRKRRRRFDEDSRSGSPMW

SEQ ID NO: 15009 - protein, 857 aa, Xanthomonas oryzae pv. oryzae KACC10331
MNAVASLQADAEPSAVVADQRWYKDAIIYQVHVKSFFDSNDDGIGDFPGLISKLDYIAELGVDTIWLLPFYPSPRRDDGYDIAEYMAVHPDYGSIEDFEQLVAQAHARGIRIVTELVINHTSDQHPWFQRARTAPAGSPGRDFYVWSDTDQEYEGTRIIFCDTEKSNWTWDPVAGQYFWHRFYSHQPDLNFDNPAVLEAVLEVMRFWLDRGVDGLRLDAVPYLIERAGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFELVSEGTLPDWHVPSPVPLPDYRTLVLRSDADGSAALLPHLPTLEGEILPAWLSARRWFSAKDQALRSVRIARRTPLPGDQPMTLLELEVELEDGRRERYMLPVGIVWEREQPSTLAEQLALARVRQGREVGYLTDAFALKPMVRGVIDALCSNAALKFCDGEEASQQGQVRFEATPALAMLDIPHDPEIRWLSAEQSNSSLVIADKAVFKLLRHVAVGANPEIEIGRRLTEMGYANAAPLLGSISRVDGQGTVTTIALLQGFIRNQGDAWRWTLDHLARSFDEYVDRADRRSARRSRRWL

SEQ ID NO: 15010 - protein, 534 aa, Bacillus cereus ATCC 14579
MKNQDQALIFEVSKEGRIGYSLPKLDVEEVKLEDVFESDYIRVEDAELPEVSELDIMRHYTALSNRNHGVDSGFYPLGSCTMKYNPKINESVARFAGFANIHPLQDEKTVQGAMELMYDLQEHLIEITGMDTVTLQPAAGAHGEWTGLMLIRAYHEANGDFNRTKVIVPDSAHGTNPASATVAGFETITVKSNENGLVDLEDLKRVVNEETAALMLTNPNTLGLFEENILEMAEIVHNAGGKLYYDGANLNAVLSQARPGDMGFDVVHLNLHKTFTGPHGGGGPGSGPVGVKADLIPYLPKPILEKTESGYHFNYDRPEAIGRVKPFYGNFGINVRAYTYIRSMGPDGLRAVTEYAVLNANYMMRRLAPFYDLPFDRHCKHEFVLSGRRQKKLGVRTLDIAKRLLDFGYHPPTIYFPLNVEECIMIEPTETESKETLDGFIDKMIQIAKEVEENPEVVQEAPHTTVIKRLDETMAARKTSFTLCKASSCTSLIRITKEELAEVGSFFVWRICPALTDSKLPTQNLAGAKKPGGR

SEQ ID NO: 15011 - protein, 447 aa, Bacillus cereus ATCC 14579
MLHRYLPMTEEDKKEMLQTIGVQTIDELFSDIPESVRFKGDLKIKEAKSEPELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQNLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 15012 - protein, 483 aa, Pseudomonas aeruginosa PAO1
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVKAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 15013 - protein, 178 aa, Triticum aestivum
  misc_feature (109)..(109): Xaa can be any naturally occurring amino acid
  misc_feature (143)..(143): Xaa can be any naturally occurring amino acid
  unsure (1)..(178): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGVLXDARYWDNVGKLPMFRDCTRRHTVINEVEESRRSXPDAYVRIIGHNIASCSSSCLSTGCKIRKAKVSHGN

SEQ ID NO: 15014 - protein, 492 aa, Streptomyces coelicolor A3(2)
MTHELFDSKGLLGSAPAAFVAGEYELDSSHGTLPVINPANGQLVAEVPSSSSSTVDRAVTAAVAAQREWGRRSHVARAAVLEAVRDAIAVHADELARIVSVEQGKPLSDARGETEGACAFFDFAISQKYRAVGSMMASEPGRSLGVREEPIGVVAAILPWNFPVAIFARKVAPALMAGNAVVLKPSELTPLSALALARLCRLAGVPDGLLSVVCGEGKDTGRALVTHPGVGMVTMTGSTRGGREILAQVADQIIPVSLELGGKAPFIVFEDADLDAAVEAAADARLWNTGQVCTCNEVTYVHADLHDEFVRRVVDRFASVTPLDPFAAGSRLGPLVAERERTRVQGMVDAAVAAGARVRTGGGRPDGEQYQSGAWFAPTVLTNVRPEMDIARREVFGPVLPIIPFDAEAEVVSAANSTAYGLTAYVYTRDLSRAMRMIDALEFGEVYVNQAGPEQVQGFHTGWKSSGLGGDDGPHGYEKYLRRKTVYVRHAV

SEQ ID NO: 15015 - protein, 838 aa, Mesorhizobium loti MAFF303099
MNGESRYDRGNRTRGSMTRAMTSETLPPLLENPDPKTLAREVLVVLKYRVGKDTTVATQYDWLTASIKVVRDRIVDRWMQATKEAYDQQEKRVYYLSLEFLIGRLMRDAFSNLGLMDNMREALSSLGVDLDLIAALEPDAALGNGGLGRLAACFMESMATVDIPAHGYGIRYANGMFRQEIHDGWQVELPETWLDHGNPWEFERRERSFEVGFGGSVESITSKDGRLERHVWKPTEHVLAVAYDTPVVGWRGNRVNTLRLWSGMPVDPILLDKFNAGDHIGALAESNKADALSRVLYPADSHMAGQELRLRQEYFFSTASLQDIVQRHLSQYGDLKSLPDKAAIHLNDTHPAIAVPELMRLLMDVHGMDFDLAWDITKRTFGYTNHTLLPEALESWPVPLFERLLPRHMQIVYAINAQVLLEARATDQFSGEQISHISLIQENGDRRVRMGNLAFVGSHSINGVSALHTELMKETVFADLHKLYPDRINNKTNGITPRRWLIQCNPGLTSLAREAIGDRFLDDIDAIKGLDSFADDSAFREKFAGVKRQNKARLANLVADRLGIKVDPSALFDIQVKRIHEYKRQLLNILEAIALYDQIRSHPERDWMPRVKFFGGKAAPSYHNAKLIIKLANDVARVINRDPAVRGLLKVVFVPNYNVSLAEVMMPAADLSEQISTAGMEASGTGNMKFALNGALTIGTLDGANVEIKECVGDDNIFIFGLTTAEVAERRNNGYNPRAVIEGSPELSQAVAAVSSGVFSPDDPDRYRDLINGLYDSDWFMVAADFDDYSAAQRDVDAVWRNSPDWYARAIRNVARVGWFSSDRTIRQYAKEIWNVPA

SEQ ID NO: 15016 - protein, 289 aa, Amanita muscaria
LETDLDVVAINDPFIDLAYMVYMFKYDSVHGRFSGSVETKDGKLWINQKPITVFRKRDPVQIPWGSAGAEYIVESTGVFTTTEKASAHLKGGAKKIVISAPSADAPMFVCGVNLDKYDPKFQVVSNASCTTNCLAPLAKVVNDKFGIVEGLMTTVHATTATQKTVDGPSAKDWRGGRSVNNNIIPSSTGAAKAVGKVIPELNGKLTGLSFRVPTLDVSVVDLVVRIEQSATYDEIKEAFREASKGSLKGIIEYTDEHVVSTDFIGHTASSIFDSLAGIQLNANFVKLIA

SEQ ID NO: 15017 - protein, 591 aa, Cicer arietinum
MSSTNDIGPLSLENFKNNLSASWRVVGLKTSNATYQISQPETHLREEKQKEKDGRSSVGLPQWTDSPVKLARRQLIEKRMANRAAELVKQDDEVIVKLEDSAIERSKSVDSAVLGKYNIWRKENENENADNTVRLMRDQIIMARVYLSIAKMKNKLQLYQELQSQLKESQRALGEATSDADLHHNEHEKIKAMGQVLSKAKDQLYDCKLVTGKLRAMLQTSDEQVRGLKKQSTFLSQLAAKTIPNGIHCLSMRLTIDYYLLPPEKRKFPRTENLVNPNLYHYALFSDNVLAASVVVNSTVVNAKDPSKHVFHLVTDKLNFGAMNMWFLLNPPGKATIYVENVDEFKWLNSSYCPVLRQLESATMKEYYFKAGHPTTTGASNLKYRNPKYLSMLNHLRFYLPQVYPKLDKILFLDDDIVVQKDLTGLWDVDLHGKVNGAVETCGESFHRFDKYLNFSNPHIAKNFDPNACGWAYGMNMFDLKVWKKKDITGIYHRWQNLNEDRVLWKLGTLPPGLMTFYGLTHPLNKSWHVLGLGYSPSVDRSEIENAAVVHYNGNMKPWLEIAMTKYRPYWSKYVKYNHPYLRNCKLSEWS

SEQ ID NO: 15018 - protein, 317 aa, Xylella fastidiosa Ann-1
MDERVLLTCLGCSYVSGNVLASMTGMTEATIAACIQALRAVGIPIKSRAEQGYALAAPLSLLTAERIRAELSHSIAAELRVLDVAWTLESTNTSLLARPALADGVEVLLAERQTGGRGQRGRSWISPLAANIYLSLSRVFSSGAAQVMGLSVAVGVAIAEALIAAGFSHVRLKWPNDLVDNGRKLGGVLVERQGVARAVIGLGLNVRMPTNFAEQIDQPWVDLETLAGSTVERNALVALLLSALLPALHLFQLEGLAPFLPRYTKLDCLVGCAVWIEEANLKYVGIARGLAADGALLVEINGVLRPFHTGQVSVRPI

SEQ ID NO: 15019 - protein, 530 aa, Triticum aestivum
  misc_feature (188)..(188): Xaa can be any naturally occurring amino acid
  unsure (1)..(530): unsure at all Xaa locations
MEAGTWAVVVAAAAAYLAWFWRMSRGLSGPRVWPLVGSLPGLLQHAEDMHEWIVGNLRRTGGTYQTCIFAVPGVARRGGLVTVTCDPRNLEHVLKARFDNYPKGPFWHGVFSDLLGDGIFNSDGDTWVAQRKTAALEFTTRTLRTAMSRWVSRSIHHRMLPILSDAAASGAHVDLQDLLLRLTFDNIXCGLAFGKDPETLARGLPENAFATSFDSATEATLNRFIFPECVWRCKKWLGLGMETTLARSVAHVDRYLSAVIKTRKLELAGKSDGSTPHDDLLSRFMRKGTYSDDSLQHVALNFILAGRDTSSVALSWFFWLVSTHPDVERKIVRELCAVLAASRGADDPALWLAAPFDYEELDRLVYLKAALSETLRLYPSVPEDSKHVVADDYLPDGTFVPAGSSVTYSIYSAGRMKTVWGEDCLEFRPERWLSADGTKFEPHDSYRFVAFNAGPRICLGKDLAYLQMKNIAGSILLRHRLAVAPGHRVEQKMSLTLFMKHGLRMVVRPRDLAPTLDELPAAAPAVAACA

SEQ ID NO: 15020 - protein, 308 aa, Oryza sativa (japonica cultivar-group)
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFW

SEQ ID NO: 15021 - protein, 357 aa, Triticum aestivum
  misc_feature (206)..(206): Xaa can be any naturally occurring amino acid
  unsure (1)..(357): unsure at all Xaa locations
YCWLIYLADELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAXCYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 15022 - protein, 357 aa, Mesembryanthemum crystallinum
MTAYRGKYADELIANAAYIGTPGKGILAADESTGTIGKRFAGINVENVESNRRALRELLFTTPGAVQYLSGVILFEETLYQKTAAGKPFVEVLKEGNVLPGIKVDKGVVELAGTNGETTTQGLDGLGARCAQYYAAGARFAKWRAVLKIGPTEPSPLAILENANGLARYAIICQENGLVPIVEPEILVDGPHDIDRCAEVTERVLAACYKALNDHHVLLEGTLLKPNMVTPGSESKKVAPEVIAEYTVRALQRTVPPAVPAVMFLSGGQSEEEATVNLNAMNKLQGKKPWTLSFSYGRALQSSTLKAWSGKEENVEKAQAVFLARAKGNSEATLGKYQGGAGGADASESLHVKDYKY

SEQ ID NO: 15023 - protein, 498 aa, Aspergillus oryzae
MASSFASILKDASLFVERSYVNGQWVSSNSNATFNVTNPANEAQVGVAPESTLDDLNVAIEAAADAFPTWRSVPGRQRGRILRRIADLLVENKEDIGKIITAENGKAKGDAEGEVMFAASFFEWFGEEASRIYGDIIPHSSAAGRTRVIKEPVGVCGLIVPWNFPLAMGARKVAAALAAGCTVVMKSDGLTPFASNAMAVVAERAGVPKGVFNVVTALNNTPQLGLAMCESDIIKKISFTGSTRVGKLLMKQSSSTLKKLSLELGGNAPFIVFNDADIETAITSALISKFKVTGQTCVCANRFYVQEGIYDRFAQRLVEEVSKFKVGNGLEDPSVTHGPLTNGVAKVEEHIKDAVSKGAKVLLGGNRLPALGKNYHELTILGDANDSMLVSKEETFGPVAALMKFKTEDEVVQRANNCEVGLASYLITSNLGTSHRVSERLEFGMVAINTGVISDAPAPFGGVKHSGMGREGSKYGVDDYMTIKMITTGGINTVYTRL

SEQ ID NO: 15024 - protein, 360 aa, Bacteroides thetaiotaomicron VPI-5482
MTNMDNYCVIMGGGIGSRFWPFSRKTLPKQFLDFFGTGRSLLQQTFDRFQKVIPTENILIVTNAMYADLVKEQLPELDEKQILLEPARRNTAPCIAWAAYHIRALNPNANIVVAPSDHLILKEEEFRAAIIKGLEFVSHSEKLLTLGIKPNRPETGYGYIQIDEPTGDGFYKVKTFTEKPELELAKVFVESGEFYWNSGLFMWNVNTIIKAAEILLPELVSKLAPGKNIYATDKEKAFIEENFPACPNVSIDFGIMEKADNVYVSLGDFGWSDLGTWGSLYDLSERDREGNVTLKSHSLIYNGKDNMIVLPKGKLAVIDGLEGYLIAESDNVLLICRKDEEHSIRKYVNDAQMQLGDDFI

SEQ ID NO: 15025 - protein, 472 aa, Candidatus Kuenenia stuttgartiensis
MNNYRKTKIVCTIGPASNSPAMIEQLICAGMNVARLNFSHGELSQHKECISHIRAISEKLMQPVAVLQDLSGPKIRIGMLSGDAVTLKTNDTFTLTTRNIVGNERVISINYSDLPMNVSIGDTLLLSDGEIEVEVIQKDDRNIHCKVIVGGVLTSRKGINIPARSLPVSSLTEKDKKDLEFGIEQGVDYVAMSFVKTAEDITELRDLIQKKGKTIPIIAKIEKHEAVDNIEKIVNTADAIMVARGDLGVEIPLERVPSVQKMIIRLANRYGKPVITATQMLASMVNNYRPTRAEVTDVANAILDGSDAVMLSEESAIGRYPADAVLMLTKIAKQIEPDLTQSNTFEKFRIPENRTTIPDAISIATCQVANELNMNTIITCTQSGSTARFISKYRPRQKILAVTPSVCTYRRLALVWGVIPILTESMENTDDMMKKGIEAAKQAGYIGENETIAITGGVPVGIPGSTNLLRVY

SEQ ID NO: 15026 - protein, 175 aa, Triticum aestivum
MAPTVMASSDTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFLAFQATGCQESGKA

SEQ ID NO: 15027 - protein, 249 aa, Oryza sativa (japonica cultivar-group)
MLAVFDRAVAPSPEGLRHPGAAGDGAAGLAERFRDARPGAVTVALGPGGANSLAYSSHGQSPLLPRLFAATDEIFCLFQGTIENIAVLKQQYGLHNKGSTEINIIIEAYRTLRDRGPYPADQVVRDINGKFAFVLYDCSNNSVFMATDADGSVPFYWGVDPDSRLVVSDDDEIVNKACGKSSAPFPKGFFFTTSGGLQSYEHPMNEVKPVPRLDSKGEVCGTTYTVDAKAKKDSSIPRVGSAADWSSQY

SEQ ID NO: 15028 - protein, 280 aa, Campylobacter jejuni subsp. jejuni NCTC 11168
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 15029 - protein, 398 aa, Dehalococcoides sp. CBDB1
MTSQVGTDKGFISDRAKELKPSGIRKFFDLAAKMGSGAISLGVGEPDFTTPWHIRESAIYALEKGYTMYTSNAGLLELRQEISKYLYQTYGLEYNPETEVLITVGSSEALDLVMRATLNPGDEVLMTDPAYVAYPSCVFMSYGNPVQIPTFEANNFEISAADIAPRITPKTRSILLGYPSNPTGAVMPKNKLAEIAKLACDKNLLVVSDEIYDKIIYSGFEHTCFATLPGMRERSVIINGFSKTYAMTGWRIGYAVGPAAIIQAMTKIHQHTMLCAPIAAQKAALEALRNGQDDVRLMVEEYDRRRRFIVKNFNDMGLSCFEPKGAFYTFPSVRKTGLSSNEFAEKLLMEEKVAAVPGTAFGESGEGYLRCCYATSLKDIEEAMKRFRHFLKHNCPQM

SEQ ID NO: 15030 - protein, 429 aa, Bacillus anthracis str. 'Ames Ancestor'
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTVHSDADIEATIAAAEIAMSKLKA

SEQ ID NO: 15031 - protein, 338 aa, Glycine max
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 15032 - protein, 489 aa, Polaromonas sp. JS666
MNLKRPSLFRQQCHIDGQWVDASDQATLAVVNPANDEVIACVPRLTDKDVQSAIRAADKALPAWREMSAKDRSKILRRWYDLCMTHQEDLATILTTEQGKPLSEARGEIAYGSGFIEWFSEEAKRVYGDIIPAPTADRRIIVIKQPVGVVAAITPWNFPNAMITRKAGAALAAGCTIVVKPASATPFSALALADLAVEAGIPPGVFNVVTGRSDVVGGALTSSPVVRKLSFTGSTEVGKQLMAQCAGTVKKVSMELGGNAPFIVFGDADLDAAVAGVMASKFRNAGQTCVCANRIFVQDMIYDVFAAKLKVAVEAQVVGDGMQAGVNLGPLIDAAAVNKVQEHISDAIALGANVLTGGQAHALGGHFFQPTILINVSSEAKLMNEETFGPVAPLIRFSTEEEVVSMANDTPFGLAAYFYTGSYERAWRVSEALECGIVGLNEGIISTELAPFGGIKESGVGREGSKYGIEDYVEVKYICAGGLGKKRAA

SEQ ID NO: 15033 - protein, 959 aa, Photobacterium profundum SS9
MTDMTLLNALSDDQDFAGRHNGPNAAQQNIMLKAISAESVEQLIAQTVPADIRLPEPMKLDPAQSEADMLTSLKAIASKNIINRSYIGQGYYNNLTPNVVLRNVLENPGWYTAYTPYQPEISQGRLESLLNYQQMIMDLTSMELANASLLDEATAAAEAMTLCLRAGKSKSKAFFVSNDLHPQTVDVVRTRAEYIGIEIITGSVEELDNHDVFGALVQYPGTTGSITDLTDIIEKAHAKKTLVAVASDLLALTLLKAPGEMGADVVIGSAQRFGVPMGFGGPHAGFMATKDKHKRTMPGRVIGVSKDARGNQSLRMAMQTREQHIRREKATSNICTAQALLANMAAFYALYHGPEGLRKIGRRVHHLTAILAAGLRNSGIELASDTFFDTITLNTGKKTDDFYKKALAAGINLRKFDVQLGISLDETTKVSDVEELLAIFTGNKLKASMFTADIAADEFAAIPESCRRTSKYLTHPVFNEHHSETQMMRYMKKLENKDYSLTHGMIPLGSCTMKLNAAAEMIPITWPEFGSLHPFAPADQTKGYQELASKLSEMLCSVTGYDAFSLQPNSGAQGEYAGLIAIQRYHQHNGDSHRNVCLIPSSAHGTNPASAAMVSMKVVVVGCDEKGNVDVEDLKVKIEKHRDNLSCIMITYPSTHGVYEEAVREVCDLVHDAGGQVYLDGANMNAQVGLTNPGFIGSDVSHLNLHKTFCIPHGGGGPGMGPIGVKSHLAPFLPGHVQSTSDEGQQYAVSAAELGSASILPISYAYIAMMGEEGLTEATKLAILNANYVMERLRPHYPVLYRGTEGRIAHECIIDIRPLKEASGISEEDVAKRLMDYGFHAPTMSFPVAGTLMIEPTESEDLAELDRFCDAMIAIRQEIARVQEGEWPIDDNPLVHAPHTQADLMETEWNRAYSREIACFPTDHTRASKYWPTVNRVDNVFGDRNLICSCPSIDSYIED

SEQ ID NO: 15034 - protein, 403 aa, Streptomyces avermitilis MA-4680
MQVIQSTKLANVCYEIRGPVLEEAMRLEAAGHRILKLNTGNPAAFGFECPPEILEDILRNVSSAHGYGDAKGLLAARRAVVMHNQTLGIETDVEHVFVGNGVSELIVMAMQGLLDDGDEVLVPAPDYPLWTASVSLSGGTAVHYHCDEQSDWMPDLADVERKVTDRTKAIVIINPNNPTGAVYDEAMLRGLTDIARRHNLLVCSDEIYDKILYDGATHTPTAAVAPDLLTLTFNGMSKAYRVAGYRVGWMAISGPRAHADSYIEGLTILANMRLCANMPGQHGVVAALSGRQTINELVLPGGRLKEQRDVAHELLTQIPGVSCVKPKGALYLFPRLDPKVFKIKDDRQMVLDLLRREKIMVVQGTGFNWPDPDHFRVVTLPTVGDLTSAITRIGNFLDGYSQP

SEQ ID NO: 15035 - protein, 51 aa, Brassica napus
  misc_feature (49)..(49): Xaa can be any naturally occurring amino acid
  unsure (1)..(51): unsure at all Xaa locations
MPPKQQPKADLAKKQKQVEDKTFGLKNKNKSKNVQKYVQSLKQSVQPKXDA

SEQ ID NO: 15036 - protein, 393 aa, Staphylococcus aureus subsp. aureus MRSA252
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHKLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 15037 - protein, 432 aa, Medicago truncatula
MSGKHHNNLTLKVPLLSKWKLGHFRDDEEKVIASHPSNKNAISFFRTCLNGVNAISGVGILSVPYALASGGWLSLALLFCIAAAAFYSGILMKRCMEKNSNIKTYPDIGELAFGKIGRLIVSISMYTELYLVSIGFLILEGDNLSNLFPIEEFQVFGLSIGAKKFFVILVAVIILPTIWLDNLSLLSYVSASGVFASGVIILSISWTAAFDGIGVHQKGDIVNWSGIPTAVSLYAFCYCAHPVFPTLYNSMRNKHQFSNVLIVCFILSTAGYASMAIIGYLMFGSKVDSQITLNLPLNKISSRIAIYTTLVNPISKFALMATPITNALKDLLPRTYKNNRVTNMFVSTVLVISTVIVALAVPFFGSLMSLVGAFLSVTASILLPCLCYLKIFGSYSKFGFETVTIVVIILVAIAMGISGTYISFVEIVQNLQ

SEQ ID NO: 15038 - protein, 276 aa, Corynebacterium efficiens YS-314
MASILIVMSGIDAKKIRTRHIHEAKANGTKISVLTSYDAMTAAIFDEAGIDMLLVGDSAANVVLGRETTLSITLDEMIVLAKAVTIAAKRALVIVDLPFGTYEVSEQQAVESAVRVMRETGAAAVKIEGGVEMASTIRRIVDAGIPVCGHIGFTPQSEHALGGPVVQGRGSGADKLLADAHAVQAAGAFAVVLEMVPAEIATEVTNQLDIATIGIGAGNGTDGQVLVWQDAFGFNRGRKPRFVREYATLGDQLLEAARAYADEVGSGAFPGEVESY

SEQ ID NO: 15039 - protein, 820 aa, Photobacterium profundum SS9
MTTRGQTQQFDKALFKASVEKHLVTTYAKTPETADSRSWYLAVGKALAEISTGSLLETEKQLAEQNVRSVNYLSLEFLIGRLTGNNLISMGLYEEVSAAVEELGLNLTDLLEEERDPALGNGGLGRLAACFMDSLAAQEYPAVGYGLHYEYGLFSQSFEGGHQVEAPDAWRGIEGYPWEVVRPELGQTVGLFGSVETYTDKAGTICRRWVPAMTVEGVAWDLPIVGYDNKSVYPLRLWECRSPAPFNLARFNDGDYVGAQYGQLEAGNVTKVLYPNDNHDQGKTLRLMQQYFHCACSIADILRRHFAAGNKIEDLAKLESIQLNDTHPTIAIPELMRILIDEHKLGWDAAWAISSKVFAYTNHTLLPEALERWSESLIADMLPRHMEIIFEINHRFMTLVEEKWPGNNEIKRKLSIIEEGQQRMVRMANLCVVSTYAVNGVAALHSELVKRDLFPEFNELFPGRLHNVTNGVTPRRWLKFCNPGLTELVNEKIGTEWPAKLDQLSGLAKFAEDKKFQKRYLAVKKDNKQRFADWVQDNMGIELDTNAIFDVQIKRLHEYKRQHLNLLHILSLYHRLLNEPTFDMHPRVFIFAAKAAPGYALAKDIIFAINKVADKVNNDPRLGGKLKVVFVPDYRVSLAEIIIPAADVSEQISTAGLEASGTGNMKLALNGALTIGTMDGANVEIREEVGDENIFIFGLLVDEVLKQKEEGHDPYRYYHADSLLRASLDLLNTDEFTPGNPGQLSAIRQNLLDGGDPYLVLADFADYVKAHEKIDAEYRDQATWARKTILNTALVGKFSSDRSIRDYVNNIWKLKAVSVK

SEQ ID NO: 15040 - protein, 310 aa, Salinibacter ruber DSM 13855
MSTRPESLATVTDIDCTGQTALVTGSTSGIGRVAAYALGRLGAEVIVHGRDREAGEAVVEGIREEGGEAAFVAADFTEAAAIRTLAETVRTETDGLDLLLNNAGGLFREGRLVEGIERTFYVNHLAPYLLTAELLDHLREDARVVTMASDAHRGAELDLDRVRTVDGYSGMGAYAHSKLANVLFASELARRLDAAGRPAVSNSLHPGFVPGSQFGRFLPGPLSGLFQMLGVVPGTSSVADGAAELLHVAVSPDTADVSGRYFSGQSPTTPAAAARDRAAAERLWHRSAELLGMDVPLSDAVSGSAATDAS

SEQ ID NO: 15041 - protein, 358 aa, Moorella thermoacetica ATCC 39073
MTYMIPEKMKALVLFGPNDVRLVEKPVPKPGPGEVLVRVAACGICGTDVKIITKGMPKMPPYGEFTFGHEWAGTIVALGETVDEFQVGDRVAIEAHKGCGRCENCIDGKYTACLNYGRLDKGHRAAGMTVDGGFAEYAVQHVNSVYKIPDNITFNEATYVTTAGCALYAIDKSGGYIAGDTVLVIGPGPIGLSVVQGARSLGAEKIILMGTREDRLVKGRELGATHTINIREVADPVAEVMAITGGKGCERVFECAGNSQSFEYGIKAAKKGGVMVLVSFYKEPVMANLDYVVLNQISLLTVRGEGNQNCKRALSLMAQGKIDAKPIMTHAFPLEEFQKGLDYFVNRKDGAMKVVINP

SEQ ID NO: 15042 - protein, 149 aa, Arabidopsis thaliana
MQAVSVDETKNTVVLRAEHKNEEGRKSVDKFEVKTRNPETIKSVERKLMEKGVQRMDRHPSDGIPLRRPPSKSGHGGKYTWEGPDRMEDYEMQPDPPAMDEGDPNYDEEQVKKSGDDVAVELVKGEVEVAKEAPAGVARVEVDPRLVGR

SEQ ID NO: 15043 - protein, 92 aa, Brassica napus
MSAYCGKYKDELIKNAAYIGTPGKGILAADESTGTIGKRLSSINVENVEENRRALRELLFCCPGALQYISGVILFEETLYQKTKDGKPFVDV

SEQ ID NO: 15044 - protein, 469 aa, Vibrio cholerae O1 biovar eltor str. N16961
MSVENVLSLIQENEVKFVDLRFTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLQQALQYLDADREFLTAGGVFSDDFIDSYIALKTKDVERVNVAVHPLEFELYYSV

SEQ ID NO: 15045 - protein, 380 aa, Kineococcus radiotolerans SRS30216
MKAVVYQGPKDVVVKEVPDARVEEPTDAVVRITTTNICGSDLHMYEGRTSVEEGKVLGHENTGVVEAVGSGVSRVKVGDRVSVPFNIACGSCRNCVHGWTSFCLRMNPTEGMDGAAYGYANMGPYDGGQAEFLRVPHADFNLLDLPAGTEHENDFTMLSDIFPTGWHGVELSGMVPGDDVAVFGAGPVGLMAAHSALIKGASRVFVVDKAPDRLRLAASIGAVPVDFSAGDPVEQITEQTRGRGVDRGVEAVGYQAHDPSGEEHPELVLDNLVKVVRATGGIGVVGVYMPEDPGAANEGAKQGRIGWDYGTFFTKGQSMGTGQAPVMRYNRQLRDLIVAGRATPGFIVSHELPLEQAPEGYRNFDDRVEGWTKVLLHPGS

SEQ ID NO: 15046 - protein, 291 aa, Ralstonia solanacearum
MSSAPIPARWRLTRDRIRPTGIAAGWPVEVVESTGSTNADLMAAVRDAAWPVAAGVPAGTAPLVGGRVLAALRQTAGRGRQGRPWDGDHGLTFSVACAFAAEPAQLAGLSLAVGVAVAEAVAAYAQTHGGNAQALALKWPNDVQIAGRKLAGILVETMRAAPGQTWAVIGIGLNLERPHALEAALGRSLSGVEELVERPEPNAVLAALLSALGEHLQRFGSHGLAPFVAPFAARDAFAGRPVRLWQDGAVVLEGVAHGIDAQGRLAIESGGRVQWIHSGEVSLRAADAEQP

SEQ ID NO: 15047 - protein, 261 aa, Aspergillus oryzae
MGHEDAVYLAKLAEQAERYEEMVENMKVVASADVELTVEERNLLSVAYKNVIGARRASWRIVTSIEQKEESKGNESQVTLIKEYRQKIESELAKICDDILEVLDKHLIPSAQSGESKVFYHKMKGDYHRYLAEFAIGDRRKGAADASLEAYKAATEVAQTDLAPTHPIRLGLALNFSVFYYEILNSPDQACHLAKLAFDDAIAELDTLSEESYKDSTLIMQLLRDNLTLWTSSEAEPAAENASTEKKEEAPAAEGEKPAAE

SEQ ID NO: 15048 - protein, 365 aa, Oryza sativa
MANNVMRRHGGPPCSTSSELPVIVIASSNQLDNVGYRGGHLIVASSYPADPTSFLARAEVVLAMQIDVTRRGSASNGDEMEPQRGRLEAFVHLLVRHIMEGATSSLPSQSARVAVVTGGNKEIGLEVCRQLAADGITVVLTARDETRGVEAAERLRGMGLSSVVFHQLEVNNAAVGGMEYAQGVDNNEEQGRETYDTAKNGVQTNYYGAKHVIQGLLPLLLSSSEGKIVNVSSALGLLRFLGNEDLRKELDDIDNLTEERLDEVLASFLKDFEAGELEAHGWPMGSAAYKVAKVAMNAYTRISARKHPALRINCAHPGYVKTDLTINSGFLTPEEGARNVVTVALLPDGGPTGAFFDEGKEASFV

SEQ ID NO: 15049 - protein, 636 aa, Prosthecochloris aestuarii DSM 271
MHDGGFFFQAFVYLTAAVVSVPLAKKLGLGSVLGYLIAGVVIGPFVFGFIGEEGQNVMEFAEFGIIMMLFLIGLELQPQMIWKLKGPILGMGGLQVTVTALLVLAGALLFGLEWKTGLALGLVLALSSTAIVLQTLHEKGLMKTDGGQNSFSVLLFQDIAIIPILAVLPLLAAGHSAGETFHAGDAHHGPVTWVEGLPLWGQTVTVLGVVSGIVVAGKYLINPAFRLIARTRLRELFTAAALLLVIAITILMGKVGLSPALGTFLAGVILAQSEYRHELETNIDPFKGLLLGLFFIAVGASIDFHVIGENPLLILQLVVALMVLKFLVLALIGKVFRMSYDNILLFAFALAQGGEFAFVLFSFGLNNNVFEPSLVNPMIAVVAITMALTPLLLLLNEKLIQPRFGTKEKAAPEERSSSSIDESSRVIIAGFGRVGSTVGRFMQANDENATYLDMDPDNVDLLRKLGLNVFYGDASRYDLLHAAGAAEAQLLIIAVDDPEKTVAIARTAMKHFPHLEIIARTNGLVDSHELIDLGVKRVYPETLDSSLRIGVDALSLLGHRRYQAIRSMHTFRHHEERHFHELAALRHDRKELIRETKKRIEDLEELMLTEKREEHKDKELGWDAAGHMSDKGHMPG

SEQ ID NO: 15050 - protein, 334 aa, Erwinia carotovora subsp. atroseptica SCRI1043
MKTLGEFIVEKQHDFSHATGELTALLSAIKLGAKIIHRDINKAGLVDILGASGISNVQGEVQMKLDLYANEKLKAALKARGEVAGIASEEEDEIVIFEGDKAENAKYVVLMDPLDGSSNIDVNVSVGTIFSIYRRITPLGTSVTEADFLQPGSQQVAAGYIVYGSSTMLVYTTGHGVHAFTYDPSLGVFCLSHEKVCFPEKGNMYSINEGNYIKFPSGVKKYIKYCQEQDEETQRPYTSRYIGSLVADFHRNLLKGGIYLYPSTASYPKGKLRLLYECNPMAFLAEQAGGKASDGKHRILDITPEKLHQRSPFFVGTESMVDDVERFIREFPDA

SEQ ID NO: 15051 - protein, 413 aa, Burkholderia xenovorans LB400
MNGPVSIEVLRQHLIDPEICIRCNTCEETCPVDAITHDDNNYVVKADICNGCMACVPPCPTGAIDNWRTVLKADAYPIDEQFTWDVLPEQNTMAVAAADELSGAGASGDTPADASGIEVDTVRGSVVPPWSAAKPYVNLYTHKAPTTATVVGNYRLTDGSTDSDIHHIVLDFGAMPFPVLEGQSIGILPPGSTADGRAHHARQYSIASPRDGERPGYNNISLTVKRVSQQHGDSTDGVCSNYLCDLKKGDVVNVIGPFGGTFLMPNHPNSHLLMICTGTGSAPMRAMTEYRRRRRLKGATGKLMLFFGARTKEELPYFGPLTNLPKDFIDTNLAFSRTPGQPKRYVQDAMRERAVDVAHMLRDENTHIYVCGLKGMEDGVLQALKEIGEQHQLDWDGLWARLKREGRLHLETY

SEQ ID NO: 15052 - protein, 303 aa, Ehrlichia ruminantium str. Welgevonden
MQYCILINLCFTNLFNHYILMYTLYNVVAYKTMNILLIGCGNLGSILLNKWSLNDQISDIVVVQPSLSKKNIFNTINKITFVRDHKEINKSFMPQIVVIAIKPQQVANAIPDYKAYNKSASFISLCAGIDIEFLKKHLDSTTIIRVMPNIAMSLGESVNLAYMEEEIDQEKQKVHTVFNGTGLLYWLQKEDVFDKLSPITGSGPAYFFSLAEELVKNTMKAGIREEDAITLISQTFIGSAKLLETRKDSISNLISSITSRGGITQAALEILNSHLPNIMSLSLKSATERLVHLKNSDDNKKNT

SEQ ID NO: 15053 - protein, 424 aa, Campylobacter jejuni subsp. jejuni NCTC 11168
MTNKKAFKETCKFIAGGVNSPVRAFANVQSEPKFISHGKGAYIFDIDGNSYIDYVQSWGPLLFGHCDKDIQKACQKALHKGSSFGAPTLLETELAKLVLSDFPHLEKIRFVSSGTEATMSAIRLARGFTKKDKILKFEGCYHGHSDSLLVSAGSGAATFNSPSSLGVLEDVAKHTLVAKYNDINSVKELFEKNKDIACVIIEPIAGNMGLVPAKQDFLEELAKICKNNQTLLIFDEVMSGYRASYLGSYGINHIQADIITFGKVIGGGLPAAAFASRAEIMDILSPLGGVYQAGTLSGNPLAMAAGIASLTKAKKKTKLYDKLGKLAKKLTQGMKKLADEKGLPLQACHVGSMFGYFFTKDPVSNYQDALKSDLALFSKFHKNMLENGIYLAPSQFETGFICSKMDDKIIDTTLEAVRESFKRI

SEQ ID NO: 15054 - protein, 446 aa, Moorella thermoacetica ATCC 39073
MTAKDIAIIATVDTKEAEARFLQEFITSHGWQAPVLDVSTHRPHNFQATYSREEICRRAGVEYKDLGTLRRDAMMATMGRGAARVLMELYDRGELAGVLGIGGNQGTAIAAMAMRSLPVGLPKLIVSTVASGNVRPYVEYKDITMMFSVADLLGGPNTVSRTILSNAAGAVIGMAAWGQPLKAGERPVIAITALGNTDPAVAAARGRLVELGYEVIAFHASGTCGSAMEELIEAGLINGVLDLTPHELIGEVHGADIYTPLRPRLEAAGRRGIPQVVSLGGLDYFCFGPADTIPQRFQGRKTHYHNPYNTNVRATGGELAQVGEVMAAKLNAARGPVVVMVPLKGWSENGRAGGPLYDQEADAALVASLEANLNPGIKLMKLNAHINDPIFAASAVAVLHQLMEVSRPVDGTFPREAVEKGTLPPKNPKWRRSLTPESAIVKQAPR

SEQ ID NO: 15055 - protein, 730 aa, Moorella thermoacetica ATCC 39073
MPGDLGVKLRVCEGMVEDARKGIVRVLTPVMDELGLKPNDVVAITGKRTTVARIMPAFQDGCPPGNIQMDGLQRQNAQVGIGEGVTLSPVEWETARTVVLAPVLPGWTLGGEHEIVHLKKHLIGRAVVPGDQVTIPQFSGGDEAFTVEGAAPRGAVVITRDTAVRFKGGEATEGRGQRVTYEDIGGLAREVQRVREIIELPLKYPQLFQRLGVEAPKGILMHGAPGTGKTLIARAVASETEAHFIHVNGPEIMHKYYGESEARLRQVFDEARRKAPSIIFLDEIDALAPRRADVHGDVEKRVVAQLLALMDGLESRGNVIVIAATNIPDLVDPALRRPGRFDREIAINVPDQRGRREILQIHTRGMSLAEDVSLDRLAAITHGFVGADLAALCREAGMYALRRALKSFQLGNERTEDLQLQVTMRDFLDALTEVEPSATREFAMEIPTATWEDIGGLEKIKERLQAMVEWPLRYPELFQQFGLQTPKGILLSGPPGTGKTLVAKALARESGINFIPVNSSLLFSHWWGEAEKTLHEVFRKARQASPCLLFFDELDALVPARKAGEGSSIGSRLVSQFLMELDGLEELREVIVLGATNRIDMIDPAVLRPGRFDQILEFPYPDQAARKEIFQIYLRNRPVDPGINLDSLAGAAEGLVGSEIEALCKRAALLAVSEVINHKGAGAYIKTCHLEQALAEIQAEKQQARTGAENHTLRPVWNNVVPGAISQVGR

SEQ ID NO: 15056 - protein, 746 aa, Mesorhizobium loti MAFF303099
MSQRIVSFVMSGGVGSRLWPLSREDNPKQFHDFSGDGSMLAKTLRRLAARPDGQTPIFLIASERHADRVRADLAGLDLAGGGPLFEPTGRNTAAAVALATLRTLSEFGDSLVLVVPSDHEISTAGQFWQSVEAGTEAARAGRLVVFGIKPTQPETGYGYIEVSAEKGGVSDVSRFVEKPDLATAQGYLEAGNFYWNTGIFLFRAAAMRDAFAVFQPDIWRATEAAYKAATSDLSGLYMPLDLYAAIPSNSIDYAIMERARDIAMVPAGFRWNDLGSWQSLLDVGPADDQGNVIVGDVVAIDCENSYIRSEGRLLSAIGMKDVAIVSTADATFVAPVSHSQHVKKVVEQLEKSGRLETRFTPAHDRVIESGAWRRRVHHWLFQETLPLWSTSGVDERHGGFHEALGFDGAPLMKPKRMRTQARQVYAFAVAKEHGWTGPAERLIAHGIDFMAGKGRTERGGWVRTLNVDGAVADATEDAYDHSCVLLALAHAHMSGNTDALRLGEETFAFLDAHLEDSRMTGFLETSDGEGERRSNPHMHLLEAFLAWYQATGERAHLRRAARIIDLFRSHFFDAESWTLGEYFDAEWKPSTGEKGSWTEPGHHFEWASLLVDFAERSGQAELSGFARKLYASAIANGLNRATGLAYGAVSRQGLPLDLISRSWPQAEAIKAAIALDGSGGPDLKPEIEARVGRLFRWHIDPAPLGLWIDRIDERGRSLASDVPASIFYHLVCALTQYLDRTAKKAV

SEQ ID NO: 15057 - protein, 416 aa, Actinosynnema pretiosum subsp. auranticum
MAAPAGDSLVALLFLDLAVVLALGALLGALARRLGQPSVVGEVAAGIALGPSLLGLLPGDPVALLFPPEARPPLAFAAQLGLVLFMFLVGCELDVAELRGAGRVVGAVSAGSVVLPFCLGLGVAALLWPQGGDALALFTAAALSITAFPVLARILAERRMQRTRSGVVALASAAVNDVVAWCALAVVAGIVTARGPWSAVATLAWTAALVLVAVLLVRPLVGWVARTVGGSPRADAVLFAVVVQGLLLFALATTAIGLHAVFGAFLFGAVVPKDALREAAPTLVDRVGGLSSLLLPVFFVVAGLSVDVGGLGWSGAAEALLVLVAACVGKLVGAAGGGLLAGLPARDAAEVGVLMNARGLTELVVLGVGLELGVLDGRLFTVLVVMALVTTAATGPLLTLIARRSGREVAALEGLR

SEQ ID NO: 15058 - protein, 308 aa, Triticum aestivum
  misc_feature (171)..(172): Xaa can be any naturally occurring amino acid
  misc_feature (253)..(254): Xaa can be any naturally occurring amino acid
  misc_feature (257)..(257): Xaa can be any naturally occurring amino acid
  unsure (1)..(308): unsure at all Xaa locations
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKVTFVDPKLRGKYCVCFDPLDGSSNIDCGVSIGTIFGIYMIKNQDTVTLEEVLQPGKDMIAAGYCMYXXSSCTLVLSTGNGVNGFTLDPSLGEFILTHPNIKIPNKGKIYSVNEGNARNWDAPTAKYVERCKFPQDGSSPKSLRYIGSMXXDVXRTLLYGGYSVPADKKTQREALFVQGSMSSDGQPRQSSRKVPTSAQRSGHIE

SEQ ID NO: 15059 - protein, 530 aa, Kluyveromyces lactis NRRL Y-1140
MVRVRKRTSKRTSTRMKEGIKKKAAAQHRKERKLAKKDVTWKSNKSKDPGIPANFPYKNRIIEEIEAKRRTDLEEKERRKQERLEAKRRTRELGEDVGDDDESMDEDENDGNNGLSALLESAQQAAKEYNGEGIDDTMNGEQEDLEVAEYDVDFYADADDDDSELEKSRKAYDKIFKTVVDASDVILYVLDARDPEGTRSRRVEQAVLQSQGKRLILILNKIDLVPPYVLQQWLTFLKSSFPTIPLRAAPGATNSTSFNRTLTQATTASSLLEALKTYSNNSNLKRSIVVGVIGYPNVGKSSVINALTSRRGGSSKACPVGNQAGVTTSMREVKVDNKLKILDSPGICFPSENKKMSRVEQEAELALLNALPPKFIIDPYPAVLKLVKRLSKSEEMTESFKKLYELPPIPAADADSFTKQFLIHIARKRGRLGKGGVPNLASAGISVLNDWRDGKILGWVLPNASKESAAEHAATSGEANQPTLGTGAVAAPAKVEQTTIVQEWSKEFDLDGLFASLDNAIEAEQDNLGN

SEQ ID NO: 15060 - protein, 480 aa, Escherichia coli O157:H7 EDL933
  misc_feature (284)..(284): Xaa can be any naturally occurring amino acid
  unsure (1)..(480): unsure at all Xaa locations
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGINYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITAXQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 15061 - protein, 131 aa, Brassica napus
MAKQYVKAVAAPDMNRNTEWFMYPGVWTTYILIIFFGWLAVLSVSGCSPGMAWTVVNLSHFLVTYHSFHWMKGTPFGEDQGIYNALTWWEQMDNGQQLTSNRKFLTVVPIVLYLIASHTTDYRHPWLLLNT

SEQ ID NO: 15062 - protein, 162 aa, Arabidopsis thaliana
  misc_feature (95)..(95): Xaa can be any naturally occurring amino acid
  misc_feature (118)..(119): Xaa can be any naturally occurring amino acid
  misc_feature (121)..(121): Xaa can be any naturally occurring amino acid
  unsure (1)..(162): unsure at all Xaa locations
MKDGDSLPISTSSVAATTVTGKKETGYSALFSKGRYKFWALAAILLLAFWSMLTGTVNLRWSAGNINHFTDDLVFPIHEDLDVLEMEEREKVVKXMWDVYNNGRRIRLPRFLQEAFEXXYXELTSDDLMWFRFHFRDRWLFVHCKGRLRLFPGKLKLWQRWD

SEQ ID NO: 15063 - protein, 437 aa, Methylobacillus flagellatus KT
MHNHVFKTIARHGLIALFFFFSISAMAAEVAKMDRIVAIVDQGVITEKELEDRIQTVIAQLEKQGTQLPPRDVLQKQILERLINDRLQLQYAAQTGLRVDDAQLDKTIERIAEQNKLSTGEFRKALEAEGIPYRKFREDIRNEIILARLREREVDNRVNVTESEIDNFLTTQSSRNDIQDEFEVAHILIRAPEESTPEELQKLKAKAEAALKELQSGADFAQVSAGYSDAPNALEGGILGWKASSQLPSLFVDALQALQPGQLSPVLRSPNGYHILKLLNRRGGSSPLVVDQTHVRHILIKLSEVVSELEAEQKINSIKERLDHGADFAELARQYSEDASANNGGDLGWTNAGDTVPAFEKAMNALDINEISAPVRTPFGWHIIQVLERRKQDMTQESARLKARQEIRARKADDAFQDWLSELRDRAYVEYRLEDKY

SEQ ID NO: 15064 - protein, 532 aa, Oryza sativa (japonica cultivar-group)
MGIVSMLIDFSGFCFGFSAGIVIGYFLFIYFQPTEVKDVKVCPLVEYDSNSLDGILHEIPLWVKNPDCDRIDWVSRFLEMMWPYLNKAICKTAQDIANPIIAENKEKYKIDSIEFETLTLGSLPPTFQGMKAYVTEEQELIMEPSLKWAANPNVTVVVKAYGLKATIQVVDLQVFASPRITLKPLVATIPCFAKILVSLMEKPHVDFGLKLLGADVMAIPILYSFVQETIKKQVASMYLWPKTLEVPIMDPSKASKRPVGILLVKVLRAQNLQKKDLLGKSDPYVKLTMSDDKLPSKKTTVKRGNLNPEWNEDFKFVVTDPETQELEIKVGKHDKMGMNKILLKELPPEETKVTTYNLLKTMDPNDIHNEKSRGQITLEMTYKPFKEDDIEKDVQGTDVVGKAPDGTPAGGGLLYVVVHEAQDLEGKHHTNPYARIIFKGNEKKTKVIKKNRDPRWEEEIEFVCEDPPANDKLHVEVLSKPPKKWLIHGKETLGYIDINLADVISNKRINETYHLIDSKTGQIQIELQWRTS

SEQ ID NO: 15065 - protein, 255 aa, Methylobacillus flagellatus KT
MKHVAKKRFGQNFLTDRAIINSLIDAIAPQPQDCMVEIGPGLGAMTQPLLERLQHLHVVEIDRDIIQWMQGHYPQDKLTIYASDALKFNFGNISDRLRVVGNLPYNISTPILFHLLDNVPHIIDMHFMLQKEVVERMVAAPSSAAYGRLSVMLQYRLHMEYLLTVPPEAFDPAPKVESAFVRAVPYTVLPHPAKDEALLGRIVTAAFAQRRKTLRNTLKGLLDDTGFASLGIDPQLRAENIAPAGFVAIANYLAA

SEQ ID NO: 15066 - protein, 359 aa, Glycine max
MAANNAFQTNPAAICFYLRSFHLRRTMSEAPPSQPPPPTANASPPPYWCYHCEKRVSIETLANLPDVVCGECKNGFVESIHTPSRSRSPSASSDDPYFGSQFLQVLRLIAQSARDDDASPPPPPSRSPENDFLRIELGGWDNDEENDNDNNDDEEFEEHEEAEDRSGNEDPHGRDDEDLRRRRRELLRLRIRDLATRTRSMRNRILDWAEILMGLEDNSIEFRLQLPESDRYVGNPEDYVDAAEYEALLHTLAESDGGGRRGAPPASKAAVEALPTVKVASESEAVACAICKDLLGVGDLAKRLPCGHGYHGDCIVPWLSSRNSCPVCRYELPTDDKEYEEERVVNSASSSGGDGSAIA

SEQ ID NO: 15067 - protein, 313 aa, Shewanella sp. ANA-3
MAIQWYPGHMHKARKEIEEAMPQVDLVIEVLDARIPYSSENPMVSKLRGDKPCIKLLNKSDLADPEITAQWIEYLEREQGVKATAITTLQPGMLKMLPDLCRKLVPSRDKTEKDIRTMIMGIPNVGKSTIINTLAGRVIAKTGNEPAVTKSQQRINLRNGIVLSDTPGILWPKVDNEASSYRLAVTGAIKDTAMEYEDVALFAAGYFLKAYPKEICERYNISELPKDDMALLEEIGRKRGALRPGGRIDLHKASEVVLHDYRSGRIGLLSLETPAMAEIEKAEVERILAEKAAEKAAKLEAEKLKRSGKRHNV

SEQ ID NO: 15068 - protein, 213 aa, Arabidopsis thaliana
MFMNRLFGKPKQETSTLQTLDKLNETLEMLEKKENVLLKKATGEVEKAKEFSRAKNKRAAIQCLKRKRLYEQQVEQLGNFQLRIHDQMIMLEGAKATTETVDALRTGASAMKAMQKATNIDDVDKTMDEINEQTENMKQIQEALSAPFGANDFDEDELEAELDELEGAELEEQLLQPVPIHVPQGNKPARAPAQKQPTAEEDELAALQAEMAL

SEQ ID NO: 15069 - protein, 495 aa, Taxus canadensis
MDAMDLTVAKFKEFTQLQSSAILLTVVSGIIVIVILLLRSKRRSSLKLPPGKLGLPLIGESLSFLWALRSNTLEQFVDKRVKKYGNVFKTSLLGQPTVVLCGAAGNRLILSNQEKLLSRTVSDRVAKLTGDTSISVIAGDSHRIIRAAVAGFLGPAGLKIHIGEMSAHIRNHINQVWKGKDEVNVLSLARELVFAISASLFLNINDREEQHQLHKTLETILPGYFSVPINFPGFAFRKALEGNSKRRKHFSVLQEKRRRDLSVGLASRTQDLLSVLLAYEDDKGNPLTDEEVLDNISALIDGSYESTSSQMAMLLKLLSDHPECYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRKCPGWEFAKTEILLFVHHFVKTFSAYTPIDPHESIWGRPLPPVPANGFPIKLISRS

SEQ ID NO: 15070 - protein, 1071 aa, Erythrobacter sp. NAP1
MATNATLTPIPQPPGKPLIGNALTVDASQQIQSLMELAEEYGPIFQLDMMGTPIVIISGADLVAEVCDEKRFDKSVRGPLKRLRLIGGDGLFTGDTDAPNWSKAHNILLPSFSQKAMGSYLPMMTDIATQLVMKWERMNSDDVIDVPKDMIRLTLDTIGVCGFGYRFNSFYREDFHPFIRALTRTLETTQKIRGIPGEKLLKGDAVKQLHRDAKYMNNLVDEIIRERQRSGGDGPEDLLDFMLSGRDPLTGERLSDENIRYQINTFLIAGHETTSGLLSFTLYYLLKNRDVLTRAYAEVDTVLGRNIDQPPSLKQIGQLPYIRAILFEALRLWPTAPAFGLAPFEDEVLGGKYLIPKGTFTTVLIPSLHRDKSVWGENPEVFDPENFTAEAEAARPPHAYKPFGNGQRACIGRQFAIQESILVLAMILQRFELFDHSDYKLDIKETLSIKPDEFTIKARMRKDVERGGKATEDAEEASTEPAEPKVPKHDTPLLVLYGSNLGSSESFAREVAQKGEFSGFEVEMAPLDDYVGKLPEDGAVAIACASYNGMPPDNAAKFIDWIEGKDGAAPDLSGVSYMMLGCGNSDWAATFQAVPRLIDARMEELGAKRIVPTTELDARSDVDTQFHTWLDALMPQLGEHFDLDLSGEAAGIAEPLYKVEVTQSVTANTVASRVGAHAVKMVANRELKNTDIGEGRSTRHIEVELAQGETYQPGDHLCVVPENDDAVVERLLRRFNLDADTYVRIESRSEMRGPFPSGSTFSVYNLAKTAGELQAVATRKDIATLALYTECPNSKPALEKLAQPPQEDGTDQYATDVLAKRKSVLDLLEDYPACDLPLAVFLEMIPFLSPRYYSISSAPGDTPQTCSITVGVVKGPALSGKGTFKGTCSNYLAELEPGASFNAVVREPTANFRLPDDPKVPLIMVGPGTGLAPFRGFLQERDALASSGEELGPARLYFGCRTPDEDFLYRDELEDYDKRGIVTLRTAFSRVDEGKCYVQDHIADDADAIWEMLEAGGRIYVCGDGARMEPDVRAALAKIHSDKTGSTPAEAQSWVGDLITNERYSLDVWVG

SEQ ID NO: 15071 - protein, 151 aa, Triticum aestivum
MRRGKEEDDEVEQLLQAAQDEMILKLSVDSHASRSRPDYLDPDLHSRFLALRSKPSQQKKNKKTTEQKRRPVSPPKSKDVEETPDDLMLRFAALKSTLPSSSVPPSVLRPGEMGDEADELGEDDEVEKLIQWAVDAARLDPSPPSDDDDDD

SEQ ID NO: 15072 - protein, 228 aa, Chlamydophila pneumoniae CWL029
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQNGKNVFVSAHGNSLRSLIMDLEKLSEEEVLSLELPTGKPVVYQWKNHKIEKHPEFFG

SEQ ID NO: 15073 - protein, 192 aa, Chlamydophila pneumoniae CWL029
MKVIYYEIEEIPSTNTMAKSYMHLWDPYALTVISTKCQTAGTGKFGKSWKSSKGDLLNTFCFFITDLHIDVSRLFRLGTEAVVALCKDLGITEAKIKWPNDVLVHGEKLCGVLPETLPVEGLLGVVLGIGLNGNTTKQALKDVGQPATSLQEILGHPIDLETTRELLIHHLLGVLQENLPDSLATKSNRGNI

SEQ ID NO: 15074 - protein, 399 aa, Glycine max
  misc_feature (187)..(187): Xaa can be any naturally occurring amino acid
  unsure (1)..(399): unsure at all Xaa locations
MASASASLLKSSLVLDKSEWVKGQTLRQPSASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYEQGARFAKWXRTVVSIPNGPSALAVKEAAWGLARYAAIAQDNGLVPIVEPEILLDGEHGIDRTFEVAQKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALAFRAKSNSLAQLGKYTGEGESEEAKKELFVKSYSY

SEQ ID NO: 15075 - protein, 404 aa, Rhodobacter sphaeroides 2.4.1
MAMDTKFDDVLTGEQKLRNFNINFGPQHPAAHGVLRLVLELDGEVVERCDPHIGLLHRGTEKLMESRTYLQNLPYFDRLDYVAPMNQEHAWCLAIERLTGVAVPRRASLIRVLYSEIGRVLNHLLNVTTQAMDVGALTPPLWGFEEREKLMVFYERASGARLHAAYFRPGGVHQDLTPRLIEDIEEWAEHFPKVLDDLDELLTENRIFKQRNVDIGIISEKDILDWGFSGVMVRGSGFAWDLRRSQPYECYDEFDFQIPVGKNGDCYDRYLCRMEEMRQSTRIIQQCLAKLRVEKGDVLARGKLTPPPRGEMKTSMEALIHHFKLYTEGFHVPAGEVYAAVEAPKGEFGVYLVADGTNRPYRAKIRAPGFLHLQAIDYIAKGHLLADVSAIIGTLDVVFGEIDR

SEQ ID NO: 15076 - protein, 563 aa, Cryptococcus neoformans var. neoformans B-3501A
MVCVVSDPDWWRQAVVYQIYPRSFADANGDGIGDLKGITARVPYLKALGVDAIWLSPFYPSALRDGGYDVADYRDVDPKIGTLEEFDEMTAAFQKVGIRVIVDIVPNHSSDDHEWFQAALKAGKGSPERERYIFRDGLGPNKDQPPTDWICSFGGSAWSPSGMNDGQWYFHWFDSSQPDWNWENPDVKADFLKTLKFWGDRGVSGFRIDVAHGLAKDMSEPLPNWEQLTKLTHQKLTNGNSELDHPLLDRKEVHDIYRSWREVFNQFNPPLMAVAEAWVAPDQKPLYASSEGLGQTFSFDILLCNFDAEEYRQCIKSSLAGSKKSDSTTTWVLSNHDVMRHPTRFGLPNVPNANHAMTTDTYNKFLKTKLTDPKVDIEQGLRRAKAATLMILALPGSTYLYQGEELGLQEVVEIPDEERQDPIFIRTKGEEVGRDGCRVPIPWVADEKNFGYGPGKRAHLPQPAWFKDYAVDVEEKDANSVLSLYRRALGLRKELQSAEELEWVENPNKEVLHFRRPGGWEVVVNIGKDSVDLPKGSVLISSSNNALKGGSIPGETTVWLKSA

SEQ ID NO: 15077 - protein, 445 aa, Haloarcula marismortui ATCC 43049
MSKTPPGPKGEPLFGSSRTYARDPFRFISALERAYGDVARFDMGPMDTVMLCDPTAIERVLVSEADRFRKPDFQGDALGDLLGDGLLLSEGETWEQQRKLANPAFSMARLSGMADRITGHAEDRIADWSHGDVIDAEQSMTRVTLDVILDLMMGVELSEQRVQTIEEQLLPLGQRFEPDPIRFAMPQWMPMPDDAEFNRAVRTLDEVLDDIIEVREDSLGTDEDGPMDFLSVLLRARDDGNQSPEQLRDEMMTMLLAGHDTTALTLTYTWFLLSEHPEVEQRVHEELDDVIGDDRPGMEHVRELDYLEWVIQEAMRLYPPVYTIFREPTEDVTLSGYEVEAGTTLMVPQWGVHRSERFYDDPETFDPERWKPERASERPRFAYFPFGGGPRHCIGKHLAMLEAQLITATTASQYRLEFQGETPLELLPSLTAHPRQKMSMRVQER

SEQ ID NO: 15078 - protein, 116 aa, Triticum aestivum
  misc_feature (81)..(81): Xaa can be any naturally occurring amino acid
  unsure (1)..(116): unsure at all Xaa locations
MKRVRGFKIGHRFVKIFRWIRSKRTQTMKRQCPTRITNPIAGIRSLARSLSRRAKRLCGGKKNSGQSQIRLGKDPRTSASXKVVPKGHLVVHVGESDGDTRRVVVPVIYFNHPLFG

SEQ ID NO: 15079 - protein, 287 aa, Synechococcus elongatus PCC 6301
MSAPQIQWYPGHIAKAERQLQEQLKRVDVVLEVRDARIPLATDHPRLKSWLGSRERLLILNRLDMIPAPARQAWIDWFRSQGDRVLLTDAHAGTGVAQLSQAAQAAGAAMNARRKQRGMLPRAVRAVVIGFPNVGKSALINRLVKKKVVESARRAGVTRSLRWVRVSEHLDLLDAPGVLPSRLDDQTAALKLALCDDIGEAAYDNQRVAAALVDCLQALEAQPLSGVTPTLFFDRYGLSVDDTGEAYLAALADHRCQGDRERTALMLLNDFRRGSLGPIALELPPTA

SEQ ID NO: 15080 - protein, 204 aa, Zea mays
MASSMLSSAAVATSPAQATMVAPFTGLKSSAAFPVTRKSNTDITSIANNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQWISFIAYKPPSFTGGLISFQKQPKKNPNPFPFPMAGFT

SEQ ID NO: 15081 - protein, 321 aa, Candida tenuis
SASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPKSNLPERLVQNRSFNTFDLTKEDFEEIAKLDIGLRFDDPWDWDNIPIFV

SEQ ID NO: 15082 - protein, 244 aa, Zea mays
  misc_feature (54)..(54): Xaa can be any naturally occurring amino acid
  misc_feature (93)..(93): Xaa can be any naturally occurring amino acid
  misc_feature (142)..(142): Xaa can be any naturally occurring amino acid
  unsure (1)..(244): unsure at all Xaa locations
LPRNQPVPALSGRPWRRRAGSPCPSSCWSSMDVAGRAAAQDYDFFYLVLQWPGXHCDTKQSCCYPNAGKPAAYFGIHGLWPNRDDGTYPQNCXPTRPRTDERERDLLSNIRGPGSSCWWPAGDGIGPFWGHQWKDYGTWLFXLFQQKGYFQAGLPPHKRGNPSGVNPPPGVKPDGGFYPLSQIKGPIPQGPGFEPYVEGNPDEAGNNQLYQLYFWVDPPGDNFVDCPVPPNGRPCGNRIHPPPF

SEQ ID NO: 15083 - protein, 115 aa, Triticum aestivum
ALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 15084 - protein, 230 aa, Rickettsia sibirica 246
MKVDSLHNLSYKEEFEGDMKRSTAAYKKVSEDASIGSTYIADTSEVGSQISDEPVQHIKIPEHRQILKFNIPNLEVSKVYKLPLEGGYARSLIKPVIMAGGNGKRLWPLASKDKPKQFKKILSDLTLLQQTLNRNKFLGQPTIITSKKYESITKEQAAEIDVEIALITEPLQKNTAVCAIITALSATALGFDIVVLLPSNHHIADDINYLNTINKALHYVNECGICTIFL

SEQ ID NO: 15085 - protein, 240 aa, Brassica napus
  misc_feature (222)..(222): Xaa can be any naturally occurring amino acid
  unsure (1)..(240): unsure at all Xaa locations
MTMVKCVLFTTLMAILIMTSQGRSQAREGEKQAEADRITSLPGQPNVTFEQFSGYVTVAKHSGRSLFYWLTEASHLPLSKPLVIWLNGGPGCSSVAYGASEEIGPFRIRKGGSGLYLNKFAWNSIANLLFLEAPAGVGFSYTNRSSDLFNTGDIRTAKDSLQFLIKWLQRFPRYNRREIYITGESYAGHYVPQFAREIMNYNKRSKNPINLKGIMVGNAVTXNHYDNLGTVTYWWSHAMI

SEQ ID NO: 15086 - protein, 345 aa, Streptococcus pneumoniae R6
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDCQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 15087 - protein, 418 aa, Chlamydophila pneumoniae CWL029
MIETREEVGSANFVSLERAIEDLRAGKFVIVVDEASREDEGDLIIAGEKITVEKMTFLLQHTTGVVCAALSQERLLSLDLPPMVKDNRCRFKTPFTVSVDAAHGVTTGVSAADRTKVVQLLADPKSKPEDFISPGHFFPLASSPGGVLKRAGHTESTVDLMELAGLQPCGVLAELVNEDYSMMRLPQILEFARKHNIAVIPVTSIIAHRMLSDRLVSKISSARLPTIYGDFTIHVYESLLEGMQHLALVKGNVAGKSNVLVRVHSECVTGDILGSKRCDCGEQLSSAMSYIAEKGTGVLVYLRGQEGRGIGLGHKVRAYALQDNGYDTVDANLAMGFPVDSREYGIGAQILVDLKLTTIKLITHNPQKYFGLQGFGLSITERVPLPVRISEDNEQYLRTKQERMGHWLDLPCCNNRVQ

SEQ ID NO: 15088 - protein, 159 aa, Pyrococcus abyssi
MCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 15089 - protein, 188 aa, Oryza sativa
MAAAAAAAAAEEEIAVKEPLDLIRLSLDERIYVKLRSDRELRGKLHAYDQHLNMILGDVEEIVTTVEIDDETYEEIVRKNTDSKRQRRRRDARAMGVTKEDVEAAITSSLSPSSLVVTDTSGGCGASYEIEVVSEKFEGKRLLERHRMVNTALAPHMAEIHAVSIKKALTPAQAQPQPEPAADKAPQA

SEQ ID NO: 15090 - protein, 315 aa, Digitalis purpurea
MAEEIRFFKLNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFIPTDIPGTWKAMEALYDSGKARAIGVSNFTLKKLSDLLDVARIPPAVNQVGCHPSCAQTKLRAFCKSKGVHLSGYSPLGSPGTPWVKHDVLENPILVDVAEKLGKTPAQVAIRWGLQMGHSVLPKSVHESRIKENIDVFSWCIPDDLFAKFSEIEQVSPGKPEFPVHPEISQYKTVEEMWDGGI

SEQ ID NO: 15091 - protein, 485 aa, Thermoanaerobacter tengcongensis MB4
MLKEYNSLIFELSKEGKKAYTLPPLDVEEKPLEDMLPKEMLREKEVDLPEVSEVDVIRHYTLLSQKNYGVDIGFYPLGSCTMKYNPKINEDMASLPGFTELHPYQPEETVQGALKLMYELEKALCEITGMDRFSLHPAAGAHGELTGLMIIKAYHEHRNDKKRKKIIVPDSAHGTNPASAAVAGFDVIEIKSNKEGAIDLEALKAVLNDEVAGLMLTNPSTLGLFEENIVEIARLVHEAGGLLYYDGANLNAIMGISRPGDMGFDVVHLNLHKTFSTPHGGGGPGSGPVGVKKELADFLPVPTVEEKDGRYFLDYDRPLSIGKVRSFYGNFNVMIKAYSYILTMGAEGLKRASELAVLNANYLKEKLKGYYKVAVDKTCMHEFVLAGLAEKSGDVRTLDVAKRLIDYGFHPPTIYFPLIVEEALMIEPTETETKETLDAFAETLIKIAKEAKENPELLKEAPHNTPVRRLDEVLAARNPVIRWTK

SEQ ID NO: 15092 - protein, 648 aa, Shewanella sp. MR-4
MEHGFLIQILLMLVIAIIAIALLRRIGLPAILAYLLTGVLSGPSGFHWFTQQQMQSVAELGVVLLMFTLGLEFSVPRLWAMRRTVFGLGSAQVLVTTVLTMLVALACGQNWIESLVIGAAIALSSTAIVLKLLNEQGWLRRRHGELSVSVLLFQDLAVVPLLILLPLLGQNDEPLMLAAIALALLKGILAFFLLMALGKWALPRLFDEVARSRSNELFVLSTLVVALVTGAFTQWLGLSMALGAFMAGMLLGESQYRRQLEADIRPFRDLLMGLFFISIGMMLDFALVIQFWWQILLILLAVVVGKALIIHGLLRLVGEPFRIAISTALSLAQVGEFSFVVLALAVSYGLLSNETSTMLVMVAVLSMSIAPWLVRHSVDIAKWLLGIRQSGHVDEVVPIVTDDHDLVLILGYGRVGQTIARFLKTEAVPYLVLDLDPTRVSEARRAGEPIYFGDVCKRAILKQVGIKHAKMIVITFCETRSLEEALPLCKQLAPDAKILVRTRDDSELDMLQKAGANQVIPESLEGSLMLVSQVLHQCGVPLARILKRLESERRNHYQFLHGFFSGTETDFTLESLHAVLLHRGADAVGKQVADIDWELLRVELRAIRRSGQEIEHPASDWIFRAGDILLIVGKPRRLEKAEAKLLHG

SEQ ID NO: 15093 - protein, 315 aa, Digitalis purpurea
MAEEIRFFELNTGAKIPSVGLGTWQSSPGDAAQAVEVAIKCGYRHIDGARLYENEKEIGVVLKKLFDDGVVKREDLFITSKLWSTDHAPEDVPVALDKTLEDLQLDYIDLYLIHWPVRLKKGSVGLDPENFVPTDIPGTWKAMEALYDSGKARAIGVSNFTLKKLSDLLDVARIPPAVNQVGCHPSCAQTKLRAFCKSKGIHLSGYSPLGSPGTPWVKHDVLENPILVDVAEKLGKTPAQVALRWGLQMGHSVLPKSVHESRIKENIDVFSWCIPDVLFAKFSEIEQVSPGKPEFPVHPEISQYKTVEEMWDGGI

SEQ ID NO: 15094 - protein, 90 aa, Triticum aestivum
MAAPVKASWMVAMSVGAVEALKDQARLCRWNYALTSIHRAAKARTNVRGSVSQGPKQLPASAAAVAERRRAEKAEEGLRTVMSLSCWGPN

SEQ ID NO: 15095 - protein, 431 aa, Oceanobacillus iheyensis HTE831
MEYKDQQLTEEKVFKDPVHRYIHVRDRVIWDLIAAPEFQRLRRVKQLGTTNLTFHGAEHSRFNHSLGVYEIVRRIMMNFQDRVNWDNEDRLLCLCAALLHDLGHGPFSHSFEKVFKLDHEKFTQRIILEETTVNDILNKVSPNFAQKVADVIAKTYPDKLVVSLISSQIDADRMDYLQRDAYFTGVSYGHFDMERILRVMRPMDDQVVIKSTGMHAVEDYIMSRYQMYWQVYFHPVTRSAEVILSKIFQRAKYLYEDDSYTFKLKPTHFISFFSGGVDLQDYLKIDEMIVYYYFQLWQEENDEILADLCERFINRRLFKYVEYNPDPQINAGMELYQLFNDAGINPDYYLVVDSSSDLPYDFYRPGEEEERLPIHLLMPDGGLKELSRHSDIVESISGKKRTDHKLYFPKDRIQEIEDETLKQRIIDILYG

SEQ ID NO: 15096 - protein, 95 aa, Zea mays
  misc_feature (40)..(40): Xaa can be any naturally occurring amino acid
  unsure (1)..(95): unsure at all Xaa locations
MAAAAAATKASSWMVAMSVGAVEALKDQGGLCRWNYALRXSVHRTAKANVRSSRSFAAQRDTELVPAAEKGRQEDKAAAEEGLRTVMYLSCWGPN

SEQ ID NO: 15097 - protein, 479 aa, Polaromonas sp. JS666
MSTFVDRHGLWSEDQLKQARDLVHRIDAGEIDVVRFAWPDQHGLLRGKTLVASEARAALWDGVNLTSTLLAKDTSHQTVFPVFAAGGGFAIEGFQGGADFTVVADPSTFKVLPWTPRTGWVLCDAYMPDGKPCPYATRQILQRAVRQLGEIGLNFIAGLEVEFHVFKLEDARMGLGDSGQPGEPPRVSLLSHGHQYLTELRYDRVDAVMELLRSQLLALGLPLRSLEVEYGPSQFELTFGPTAGVLPADTMVLLRSAIKQICQRAGYHATFMCRPRIPNVMSSGWHLHQSLTRKSDGVNAFMPEVAGQVLSDIGLHYLGGLKQHACGAAVLASPTINGYRRYRPFSLAPDRAIWARDNRGAMLRVLGGVGQTATRIENRVGEPTANPYLYLASQLFSGLDGIRKKTNPGPSADAPYETPAESLPRSLGDALTCLRKDEMLNEQMGKTFVDYLCDIKEAEIARFNLEVSEWEHREYFDMF

SEQ ID NO: 15098 - protein, 363 aa, Solanum tuberosum
MSCYKGKYADELIKNAAYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIQKCADVTERVLAACYKALNDHHVLLEGTLLKPNMVTPGSESPKVAPEVIAEYTIRALQRTMPPAVPAVVFLSGGQSEEQATVNLNAMNKLQNQKAMVAFLLLWTCSSAEYPQGVGRKRRECAESTSCIPYQVQGQLRCYTRKVCRSFQLKRGRFREPPCQGLQVLDQSF

SEQ ID NO: 15099 - protein, 276 aa, Desulfitobacterium hafniense DCB-2
MSIQWFPGHMAKAKRLLLEQLRWVDVVIELGDARLPESSRNPLLQEMLGDKPKIIILNKVDLADPYWTEIWTRKLRQSNPVLAVSATSGAGVGKIVPEVERLMAHKIEKWTAKGIRARSIRVMIVGIPNCGKSSLVNNLIGSAKAKTGNKPGVTRGNQWIRIHERVELLDTPGLLWPKFEDPEVGKKLGAVGAIRDEVLNLEELSLWVLEQLKENYPEALTRYTEDVQNLDLEGIGRKRGCLVKGGQVDILKAAQIFLREFRAGSLGKFTLDHTVK

SEQ ID NO: 15100 - protein, 301 aa, Rickettsia sibirica 246
MLPSIAKHAALHQVNPLKKHGQNFIFDSSLCDKIVRASNLAENSRVLEIGPGTGGLTRSILQKNPESLTVIETDERCLPLLNEIKEYYPNLNIIKQDALKINLTDLSCDIVNSVGFAYKKREAKPITNRRANDIGESKSIDYKVTIISNLPYHIGTELVIRWLKEARLITSMTLMLQKEVVERICAIPSTKAYGRLSVICQLIAKVEKCFDVAPTAFYPPPKVYSAIVKLIPLENSPSIALINKVEQITKLAFAGRRKMIKSSLKNLVPNIHEVLTQLKINDNYRAENLAPQDYLRIAEIL

SEQ ID NO: 15101 - protein, 270 aa, Bartonella quintana str. Toulouse
MFDRYRFTILGCGSSPGVPRPNGDWGACDPNNPKNKRYRSSLLVERIQASGKKTTVVIDTGPDFRSQMIDARVNHLDAALYTHSHADHIHGIDDLRSYALAQKCLIDIYADAFTLKHLKNAFSYCFQTQKGSFYSPILKEHLINEDSQFIIQGQGDTITVKTHLQFHGTIHSLGFRIGNVAYCTDVSKFPEKTLQKLMNLEVLIIEALQFESHPSHLSVDQALQWIKYLKPKQAILTHMDRSLDYNEVINYVPAYVKPAYQGLTFETNVL

SEQ ID NO: 15102 - protein, 305 aa, Glycine max
MAATSTSLFFSNLHSLNPQPFSSSLSFFRNVHSTLSFPSSSKPSRGVVAMAGSGKFFVGGNWKCNGTKDSISKLVSDLNSATLEPDVDVVVAPPFVYIDQVKNSITDRIEISAQNSWVGKGGAFTGEISVEQLKDLGCKWVILGHSERRHVIGENDEFIGKKTAYALSEGLGVIACIGELLQEREAGQTFDICFQQLKAFADAVPSWDNIVIAYEPVWAIGTGKVATPEQAQEVHAAVRDWLKKNVSAKVASKTRIIYGGSVNASNSAELAKQEDIDGFLVGGASLKGPEFATIINSVTSKKVAA

SEQ ID NO: 15103 - protein, 338 aa, Mucor racemosus
MVTQVGINGFGRIGRIVLRASLSNPEVQVVAINDPFIPLEYMVYMFKYDSVHGRFQGTVEAKDGKLVVNGKEISVFSERDPAQIPWGSVEAAYVVESTGVFTSIDAASAHLQGGAKKVIISAPSGDAPMFVCGVNLEKYTSDLKVISNASCTTNCLAPLAKVINDNFGIVEGLMTTVHATTATQKTVDGPSNKDWRGGRGAGANIIPSSTGAAKAVGKVIPELNGKLTGMAFRVPTPDVSVVDLTVRLEKGATYEEIKAVIKKASENELKGILGYTNDQVVSTDFVGDAQSSIFDAAAGIALNDKFVKLVSWYDNEFGYSNRVIDLLAYAAKVDAAAQ

SEQ ID NO: 15104 - protein, 339 aa, Mucor racemosus
MSTINTGINGFRSHWPYCLACSLENPKVKVVAINDPFIDLEYMVYMFKYDSTHGRFKGTVEHKDGKLVVNGHEIAVHAERDPAQIPWGSHGADYVIESTGVFTTKDAASAHLKGGAKKVIISAPSADAPMFVVGVNLDKYTSDLTVISNASCTTNCLAPLAKVIHDNYGILEGLMTTVHATTATQKTVDGPSNKDWRGGRGAGANIIPSSTGAAKAVGKVIPELNGKLTGMAFRVPTPDVSVVDLTVRLEKPASYDEIKATIKKASESEELKGILGYTEDQVVSTDFVGDAHSSIFDAKAGIQLSPTFVKLISWYDNEFGYSTRVVDLLAYVAGKDGAL

SEQ ID NO: 15105 - protein, 583 aa, Saccharophagus degradans 2-40
MMEAEHTSMTIPYLYETIAFLLTVVIVVPLFKRIKMSPILGYLAVGAIIGPYGAAVIHDANAVQHFAELGVIILLFTIGLELSFARLKSFSKLIFGLGAAQVLVSASIISGLAFWWGNTIEAAVIIGLCLALSSTAMVMQILHERSESATTYGRASFAILLFQDLAVVPILILLTILGDTSSGDSSLWLTVGSALLKAAITIGFIIFVGRFLLSFLFRHVARLRNIDVFTALMLLVILATSVITGLAGLSMALGAFLAGLLLAETEFRHQIESEIAPFKGLFLGLFFMGVGMNLDLVMAFEYGVWVVLSVVGLLALKATIATLFARLFGLSWQDALRTGLIVSEAGEFAFVVIGQATLSYQLIEPNIGQFMVVVAGLSMIFTPFLAMFGKWLADKYNLSQTPNAAPDALHDHIIIAGFGRVGQAVAHILTQQSIPYIALDTNADEVRRLQKQGAHIFLGDASKQEVLHMASVDNASVLLVTMDDSHASIRTTHGARQHHPELKIVVRSKDEQHSTALLHAGANQVVPETLEASLQLCAHTLQASGMSREEATACVEIERSEAYSRLLHEAKAIGNQNPACDKP

SEQ ID NO: 15106 - protein, 382 aa, Vibrio sp. Ex25
MTVEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKDAPLEEVCLLGCGVTTGMGAVMNTAKVEKGDTVAIFGLGGIGLSAIIGARMVGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLADVNKAFDLMHEGKSIRTVIHMDQ

SEQ ID NO: 15107 - protein, 449 aa, Thermoanaerobacter tengcongensis MB4
MIVMFPYLPISSEDEKEMLKTIGKNSIEELFEVIPKEVRLNRPLNLGKPMSELEVRKRLGSYADENKNLSQLVSFLGAGVYDHYIPSVVKHIISRSEFYTAYTPYQPEISQGTLQAIFEYQTMITNLTGMEVTNASMYDGASACAEAAMMACDATKRKSIIVSKTVNPETRKVLKTYMHFKEVEVVEIEDADGVTDIEKLKEVIGPNTAAVIVQYPNFFGIIENLQEIEKITHEQKAMLITYVHPIPLGILKSPGEIGADIAVGDGQSLGNGLHYGGPYLGFLATTQKLLRRMPGRIVGQTKDVDGKRGFVLTLQAREQHIRREKATSNICSNHSLNALTAAVYLATIGKKGIKEVAYQCLQKAHYAYTVLTESGKYKPAFNKPFFMEFALKTDKDVAEINKKLLEEGILGGYDLQRDYEKYKNVMLLAFTEKRTKEEIDRLKSLLEVM

SEQ ID NO: 15108 - protein, 333 aa, Magnetospirillum magnetotacticum MS-1
  misc_feature (239)..(239): Xaa can be any naturally occurring amino acid
  misc_feature (244)..(244): Xaa can be any naturally occurring amino acid
  unsure (1)..(333): unsure at all Xaa locations
MGPLAFHGSRRVNGVSALHSELLKSTVFKDLHAIEPEKIVNKTNGITFRRWLHNANPELTALAVEVAGEGVLDDPEGLRKLEPFADDAEFRTRYAAMRKTRKKRLAQVIAERTGIVVDPAALFDVQIKRIHEYKRQLLNLVETVALYQAIKQAPNKDWTPRVKIFAGKAAPSYVQAKLIIKLAGDIARVVNEDPEIGGKLKVVFLPNYSVSLAEVIIPAADLSEQISTAGMEASGTRHXMKLAXHTARSPSARSMAPTSRSRTMSARTTSSSSASTPRRCWPAPASRITRARPSPPHRGWRRLWTPSATAPSRRRSRAASPRSSTSCATATAT

SEQ ID NO: 15109 - protein, 398 aa, Streptomyces avermitilis MA-4680
MAAMTSSARPLLNRRLAEFGTTIFAEMSALAMSTGAINLGQGFPDTDGPEEIREAAVRALRDGRGNQYPPGPGVPELRTAIAAHQQRRYGLTYDPDTEVLVTAGATEAIAATLLALLEPGDEVIAFEPYYDSYAACIAMAGGTRVPVTLRPHPEDGRFRLDLDELRDAVTDRTRLLLVNTPHNPTGTVLTREELTAIAELAVERDLLVVTDEVYEHLVFDDAEHLPLATFPGMRERTVSISSAGKTFSFTGWKVGWVTGAPGLVTAVRSAKQFLTYVASGPFQYAVAEALALPDTYFEAFRADMLAKRDLLAAGLTAAGFEVFRPAGTYFITTDIRPLGERDGFAFCRALPERAGVVAIPNAVFYDHREAGAPFVRFAFCKRTDVLEEAAKRLGTLRG

SEQ ID NO: 15110 - protein, 566 aa, Kluyveromyces lactis NRRL Y-1140
MSSNLSEKAVDQQKEFGLLKSTSSVDSVHEVEAGVKVGEDDDNYFFSEDQILTQIKVYEDEIANTPVTKTLRQRMRRMEFCEVNFSNKTYMVIMLGFFASFAGILSGVDQSTISGASYGMKASLKLTSDEDSLISSLMPLGAVGGSILLTPLSEYFGRKVALVISCIFYTIGGILCAAAQDVHTMYAGRFLIGVGVGIEGGGVGVYIAESVPSTVRGSLVSLYQFNIALGELVGYVIGVIFFDVKGGWRYMLGSSLVFSTILFVGLFFLPESPRWLIHKGYDVEAYKVWRRLRDTSDLGNKREFLEMKHAAEQDRQLKEQESRFKSMFDLILIPRNRRALLYSIMMVSLGQLTGINAIMYYMSTLMGQIGFSPKQAVAMSMVGGAALLIGTIPAILYMDKFGRRPWSMTIIGFSVGLVLVGVGYQIDLNTNLAAAEGVYLTGQILYNIFFGTYATLTWVVPSESFSLATRSIGMTICSAFLYLWAFTVTYNFNKMKDAFTYTGLTLGFYGGIAIVIGIPYQLLFMPETKDKTLEEIDDIFEMPTRQLVKQNLKNLKDYVSGNRKSI

SEQ ID NO: 15111 - protein, 593 aa, Nicotiana tabacum
MSQALNFFVSSSSRSPATFTISRPSVFPSTGSLRLLVKKSLRTLVVEASSAAASDLDEPQSSPVLVSENGSGGVLSSATQEYGRNAAPGTDSSSIEVDTVTEAELKENGFRSTRRTKLICTIGPATCGFEQLERLAEGGMNVARINMCHGTREWHRMVIERLRRLNEEKGFAVAIMMDTEGSEIHMGDLGGASSAKAEDGEIWNFTVRSFDPPLPERTVTVNYDGFAEDVKVGDELLVDGGMVRFEVIEKIGPDVKCLCTDPGLLLPRANLTFWRDGKLVRERNAMLPTISSKDWLDIDFGIAEGVDFIAVSFVKSAEVIKHLKSYIQARARDSDISVIAKIESIDSLKNLEEIIQASDGAMVARGDLGAQIPLEQVPSEQQKIVQICRQLNRPVIVASQLLESMIEYPIPTRAEVADVSEAVRQRGDALMLSGESAMGQFPEKALTVLRSVSLRIERMWREQKRHEVIELPSIASSFSDSISEEICNSAAKMANNLEVDALFVYTKNGHMASLLSRCRPDCPIFAFTTTTSVRRRLNLQWGLMPFRLSFSDDMESNLNKTFSLLKARGMIKSGDLIIAVSDMLQSIQVMNVP

SEQ ID NO: 15112 - protein, 388 aa, Thermoanaerobacter tengcongensis MB4
MNFEDRIAKRAKAIEISTIRYFFNMAREVEGAISLAIGEPDFITPEHIRNAAKKALDEGMTGYTVNAGLIELRREIADYLKRRYSLYYDPEKEILVTIGATEAIYVTLSTLAEEGDEVLIPEPSFVAYHPCTVIAGAKSVFVPTYEEDDFILRADVLEKYITERSKVLILPYPNNPTGAVMPKEALEEIAKVVEKHDLIVVTDEIYSELVYGGFKHTSFASLPGMWERTITINGFSKSYAMTGWRLGYIAAPEHFTKHIAKLHQYAVTAAATMCQYAGIEAMRNGDEDIIKMREEYDKRRKFLLESVREMGLSCFEPKGAFYIFPSIKTTGLTSMEFAKRLLYEAKVAVVPGNAFGEHGEGYVRLAYATSMENLEEAVKRMKEFMAKL

SEQ ID NO: 15113 - protein, 470 aa, Salmonella typhimurium LT2
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 15114 - protein, 562 aa, Nicotiana tabacum
MATMNLPTGLHVAAKPASLDRLSSAKNVGDLFFSDSRHRKRVNTSNQIMAVQSLEHIHGVNNNVYANYVNFNVPSSGYSLGQESVYLNSPRKTKIVCTIGPSTSSREMIWKLAEAGMNVARLNMSHGDHASHQRTIDLVKEYNAQFEDKVIAIMLDTKGPEVISGDVPKPILLKEGQEFNFSIKRGVSTEDTVSVNYDDFINDVEAGDILLVDGGMMSLAVKSKTSDIVKCEVIDGGELKSRRHLNVRGKSATLPSITEKDWDDIKFGVNNQVDFYAVSFVKDAKVVHELKDYLKSCNADIHVIVKIESADSIPNLHSIISASDGAMVARGDLGAELPIEEVPLLQEDIIRRCQSMQKPVIVATNMLESMIDHPTPTRAEVSDISIAVREGADAVMLSGETAHGKYPLKAVKVMHIVALRTESSLQKSTSSPSQSAAYKSHMGEMFAFHSSSMANTLSTPIIVFTRTGSMAIILSHNRPSSTVFAFTNNERVKQRLALYHGVVPIYMEFSSDAEETFSRAIKLLLSKSLVKDGQYVTLVQSGAQPIWRRHSTHHIQVRKVQS

SEQ ID NO: 15115 - protein, 448 aa, Oceanospirillum sp. MED92
MEAVTRFLEENAITEVESTLPDMTGNARGKFYPTQKFLAEKGGRIPETLLVQTVTGDWADNHYDIVDASDRDMVLKPDPNTLRLVPWANEPTAQVINDCYTVDGELHPLSCRSVLRKVLALYEKEGLKPVIAPEVEFYLIQKNTDPDYELKPAIGRSGRRETARQSYSIDAVNEFDPIIDTLYDYCEAQGLDVDTLIHETGAAQMEINFLHGDPLDLADQVFTFKRTLRETGMKHGVYATFMAKPMQVEPGSSMHIHQSLVDIETGENIFAGKEGERFSEQFYHYLGGLQKFTPNAISFFAPNVNSYRRFTPEMSAPVNMKWGIDNRTTGLRAPEAVPAATRIENRFPGADCNPYLAIAATLACGYLGLKNKLQPTKPTTDAAAEEGDAVELARTLEEALRLLEECPELREIMGSEFVEAYIGVKRAEFETFHKVISSWEREYLLLNV

SEQ ID NO: 15116 - protein, 343 aa, Anabaena variabilis
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 15117 - protein, 285 aa, Triticum aestivum
  misc_feature (196)..(196): Xaa can be any naturally occurring amino acid
  misc_feature (204)..(204): Xaa can be any naturally occurring amino acid
  misc_feature (232)..(232): Xaa can be any naturally occurring amino acid
  misc_feature (239)..(239): Xaa can be any naturally occurring amino acid
  misc_feature (256)..(256): Xaa can be any naturally occurring amino acid
  unsure (1)..(285): unsure at all Xaa locations
MAAATSHNVIVSAQSHRWNSKNSRLDRRGVYVRLVSVGSCCSGNRKLGLVCASGSQSSVIDPVHLPSNGKGDHSPKKSSESSLILIRHGESMWNEKNLFTGCVDVPLTPKGVDEAIEAGKRICNIPIDVIFTSAMIRSQMTAMLAMMQHRRKKVPIITHKESEQAQSWSKIYSEDTKEQPIPVITVWKLNERMYGXWNGLIKQXTDNRFGKDKVLKGAGITNIPPPNGETLXMCANRAXSYLKDQGCPHLHGWKDXMVVGIAKSLRTNIMALKKLLPRKVNGFNC

SEQ ID NO: 15118 - protein, 267 aa, Ralstonia solanacearum
MTQRVPATAQVFSLLIMAVMHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 15119 - protein, 128 aa, Lycium parishii
NKNTLLNNCAPGATYHKIDDPGMFKQMDDRWTELTSDAKDSKKYQGFWEHEFLKHGTCCEGHDTEEAYFKLAMRLKDRFDLLTILRASGIIPGNYYSIDSIQKAIKGVTRAVPNLYCNPDPNNPRMEL

SEQ ID NO: 15120 - protein, 456 aa, Escherichia coli CFT073
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 15121 - protein, 128 aa, Lycium parishii
NKKTLLNNCAPGATYNKIDDPDMIEQMDKRWTELTSEAQDSKKHQGFWGHEFLKHGTCCEGHATEEAYFKLAMGLKDRFDLLTILRARGIIPGNYYTIDSIQKAVKAVTRAVPNLYCSPDPKTPRMEL

SEQ ID NO: 15122 - protein, 481 aa, Burkholderia xenovorans LB400
MAIPSYTDTRLLINGEWCDAASGKTLDVINPATGQAIGKVAHAGIADLDRALAAAQRGFEAWRKVPANERATTMRRAAALVRERASDIGRLMTQEQGKPFAEARIEVLAAADIIEWFADEGRRVYGRIVPSRNLAAQQLVLKEPIGPVAAFTPWNFPVNQVVRKLSAALACGCSFLVKAPEETPASPAALLQAFVEAGVPAGTVGLVFGDPAEISGYLIPHPVIRKVTFTGSTPVGKQLAALAGAHMKRATMELGGHAPVIVAEDADVALAVKAAGGAKFRNAGQVCISPTRFLVHNSIREEFAAALVKHAEGLKLGDGLAEGTTLGPLANARRLSAMSKVLDDARKTGAKVETGGERVGSEGNFFAPTVLTNVSLEADVFNNEPFGPIAAIRGFDKLEEAIAEANRLPYGLAGYAFTKSFSNVHLLSQQVEVGMLWINQPATPSPEMPFGGVKDSGYGSEGGPEAMEGYLVTKAVSVMAV

SEQ ID NO: 15123 - protein, 751 aa, Cryptococcus neoformans var. neoformans JEC21
MGPNTRPAPQAPTHYSRHRPQSITGNNAPQSRTKPRIGQYIVERTLGTGSFGKVKLATHAVTGHQVALKLINRSKITTPDMNARVKREIQYLKVLRHPHIIKLYEVITTPTDVIMVMEYAGEELFNYIVQKGKHGMTEDEARRFFQQMIGAIEYCHKHHIVHRDLKPENLFLDSRRNIKIGDFGLSNLMTDGDFLKTSCGSPNYAAPEVISGKLYSGPEIDVWSAGVIMFVLLCGKLPFDDEHIPTLFKKIENGVFHIPSHVSEPARHLLKRMLEVDPLKRCTIAEIRQMPFFQENLPRYLQPLPELADMERYPSLTMDDMTTLLLINEGQADPKKVAEDKGLVFSEDLGVIDPDIVEELLEKITTYSEGMVWEALKMPGDNQVKVAYQLVRDHRRILKDSNAYEDEDSSAMEEFMASSPPAWNADIAPPIDVQQNGADEYPDLEDVDLEIQDIPNAHFDVLDSSLPGWMTPPSSSTSAMSTPTTTHPTSAQNSANPSFSSVTSDTTASGSTAEEAARALLSPAPSSASQSVTSFSSPTPQPQPQRRLDKSMTKPKWHFGIRSRSPPMEVMLEIYRTLNVLGMQWRLKDIPLPDIGGAPPGGYSEEVELVLEDLKEKNGERPVMGRKPPSKKDAMAQEKLAQGLYHVETRARYGDVMVRMDLQLYRVDDQHYLVDFRNLGYYMVSEKDMSLPDVSRQGHSHEEGASNAGGSVPSATSATAAGAKEAGIGGVSGPFHFLEMACQLIAELASG

SEQ ID NO: 15124 - protein, 261 aa, Oryza sativa
  misc_feature (260)..(260): Xaa can be any naturally occurring amino acid
  unsure (1)..(261): unsure at all Xaa locations
ERAARTAEYATLTRHYYNLATDLYEYGWGQSFHFCRYSHGESFYQAIARHEHYLAAQIGIKEGMKVLDVGCGVGGPAREIAKFTGAHITGLNNNDYQIKRATHYAQKQELSHQLKFVKGDFMQMSFPDNSFDAVYAIEATCHAPTLEGIYSEIFRVLKPGGVFGVYEWLMTEEYDNDNLRHREIRLGIEQGDGISNMCKVSEGLAAMKAAGFEMLHNEDLADRPDPFPWYWPISGGLRYIQSIYDVFTIVRMTKWGRWAXH

SEQ ID NO: 15125 - protein, 464 aa, Escherichia coli
MSSPLIPVILSGGNGTRLWPLSREEYPKQFLKLTDSISMLQSTISRLDSLNTSSPVVICNELHRFIVAEQLRHLNKLDNNIILEPSGRNTAPAICIAALILKMKHPNENPLMLVLPADHSVKKVKTFCNTIKSAIPFAEAGNLVSFGIKPTHPETGYGYIQKGKVLSDSDIYEVSEVRTFVEKPNLKTAESFIEKDEYYWNSGMYLFSVERYLQELSLYRPDIVKVCQETVKNIHYDMDFIRLDDKIFRNCPQESIDYAVMEKTKDAVVATMDIGWNDVGAWSSLWELGKKDSSGNVITGDIVCHETENSYIYTESGLVATIGIQDLVIIHTKDSLLVSRRDSVQNVKNIVQHLDLSGRKEHKEHREVFKSWGRCDSIDSSEKYHYQVKRITVNPSENYRCNYIITVRNIGVVVMGIAKLTVAEEIKILKENESVYIPAGIKHSLKILDNTTCVNRSLDRFLSC

SEQ ID NO: 15126 - protein, 865 aa, Oryza sativa
MASTAAIAALALVFFVLLCVRDGGGVDAADTLSQGQSLGANDMLVSANGTFKVGFFTPAGGDPGKVYLGVMYATSNVQTVMWVANRDAPVRTAAGAASATVTGSGELLVKEGDRVAWRTNASAAGRSKHTLTIRDDGNLVISGSDAAGTDVEWESFHHPTDTFVPGMEIALRQTNGDRTLYTSWRSDADPATGDFTLGLDASAQLYIWRSQGGKNSTYWRSGQWASGNFVGIPWRALYVYGFKLNGDPPPIAGDMSIAFTPFNSSLYRFVLRPNGVETCYMLLGSGDWELVWSQPTIPCHRYNLCGDNAECTADDNEPICTCFTGFEPKSPQEYNNGNWTQGCVRSVPLTCSSERNNTTAGGAGAGGGDGFTVIRGVKLPDFAVWGSLVGDANSCEKACLGNCSCGAYSYSTGSCLTWGQELVDIFQFQTGTEGAKYDLYVKVPSSLLDKSSGRWKTVVVVVVVVVVVVLLASGLLMWKCRRRIKEKLGIGRKKAQLPLLRPARDAKQDFSGPAQSEHEKSEEGKNCELPLFAFETLATATDNFSISNKLGEGGFGHVYKGRLPGGEEIAVKRLSRSSGQGLEEFKNEVILIAKLQHRNLVRLLGCCIQGEEKILVYEYMPNKSLDAFLFDPERRGLLDWRTRFQIIEGVARGLLYLHRCARLRVVHRDLKASNILLDRDMNPKISDFGMARIFGGDQNQVNTNRVVGTLGYMSPEYAMEGLFSVRSDVYSFGILILEIITGQKNSSFHHMEGSLNIVGYAWQLWNGDRGQELIDPAIRGTCPAKEALRCVHMALLCVQDHAHDRPDIPYVVLTLGSDSSVLPTPRPPTFTLQCTSSSSGRDMYYRDKEESYSANDLTVTMLQGR

SEQ ID NO: 15127 - protein, 471 aa, Escherichia coli
MLLPVIMAGGTGSRLWPMSRELYPKQFLRLFGQNSMLQETITRLSGLEVHEPMVICNEEHRFLVAEQLRQLNKLSSNIILEPVGRNTAPAIALAALQATRHGDDPLMLVLAADHIINNQPVFHDAIRVAEQYADEGHLVTFGIVPNAPETGYGYIQRGVAVTDSAHTPYQVARFVEKPDRERAGAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRTEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGSYLGEDDIIRIKDQYGRC

SEQ ID NO: 15128 - protein, 426 aa, Erwinia carotovora subsp. atroseptica SCRI1043
MNKSESLYAAAQQLIPGGVNSPVRAFNGVGGTPLFIERADGAYLYDVDEQAYIDYVGSWGPMVLGHNHPSIRDAVIAAAERGLSFGAPTEMEVQMARLVTSLVPSMDMVRMVNSGTEATMSAIRLARGYTGRDKIIKFEGCYHGHADCLLVKAGSGALTLGQPNSPGVPADFARHTLTCVYNDLSSVRTTFEQYPDEIAAIIVEPVAGNMNCVPPLPDFLPGLRALCDEFGALFIIDEVMTGFRVALAGAQSHYGVVPDLTCLGKIIGGGMPVGAFGGKREVMQALAPTGPVYQAGTLSGNPIAMAAGFACLTEVAKPGVHEKLTALTNQLADGLLAAAKAENIPLVVNQAGGMFGLFFTDAESVTCYQDVMKCDVERFKRFFHMMLEEGIYLAPSAFEAGFMSLAHTPQDIERTIEAAQICFSRL

SEQ ID NO: 15129 - protein, 291 aa, Streptomyces avermitilis MA-4680
MTPKDASDAHDGRWSDLDRPPLNAASLRRALVREGSLWSSLDVVPVTGSTNTDLAARAGTLDEGAVLVAEEQTAGRGRLDRQWTAPARSGLFFSVLLKPSEVPVHRWGWIPLLTGVAVATGLSRAAGADTALKWPNDLLVSVGGQERKAGGILAERTGEDGVVVGVGVNVTLHEDELPVPAAGSLTLAGAVSTDRDPLLRAVLRSLERWYGTWREADGDPAVSGLQEAYAAGCATLGRTVRAELPGGRSLTGEAVAVDGDGRLVLATAEGVQQPVGAGDIVHLRPAGAGEM

SEQ ID NO: 15130 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 15131 - protein, 430 aa, Helicobacter pylori J99
MELLHSINDFNEAKQVIAGGVNSPVRAFKSVKGTPPFILKGKGAYLYDVDNNHYIDFVQSWGPLIFGHADEEIEENIINVLKKGTSFGAPTELETTLAKEIISCYEGLDKVRLVNSGTEATMSAIRLARAYSQKDDLIKFEGCYHGHSDSLLVKAGSGCATFGSPSSLGVPNDFSKHTLVARYNDLNSTEECFKKGDVGCVIIEPIAGNMGLVPAQKEFLLGLKALCEKYQAVLILDEVMSGFRASLSGSQEFYGVVPDLVTFGKVIGAGLPLACFGGRAEIMDLLSPIGGVYQAGTLSGNPLAVCAGLSALYKIKRDKTLYTRLNALAVRLTQGLQKSAQNYNIALETLNMGSMFGFFFNENAVRDFDDALKSDTEMFAKFHQKMLFKGVYLACSSFETGFICEPMTEEMIDLAISKADESFDEIINGV

SEQ ID NO: 15132 - protein, 294 aa, Staphylococcus aureus subsp. aureus MRSA252
MVIQWYPGHMAKAKREVSEQLKKVDVVFELVDARIPYSSRNPMIDEVINQKPRVVILNKKDMSNLNEMSKWEQFFIDKGYYPVSVDAKHGKNLKKVEAAAIKATAEKFEREKAKGLKPRAIRAMIVGIPNVGKSTLINKLAKRSIAQTGNKPGVTKQQQWIKVGNALQLLDTPGILWPKFEDEEVGKKLSLTGAIKDSIVHLDEVAIYGLNFLIQNDLARLKAHYKIEVPEDAEIIAWFDAIGKKRGLIRRGNEIDYEAVIELIIYDIRNAKIGNYCFDIFKDMTEELANDANN

SEQ ID NO: 15133 - protein, 82 aa, Nicotiana langsdorffii x Nicotiana sanderae
YKKMKEMTAAERKAKYVPRVCIFGGKAFATYVQAKRIVKFITDVGATINHDPEIGDLLKVIFVPDYNVSVAELLIPASDLSE

SEQ ID NO: 15134 - protein, 141 aa, Pseudomonas putida
MAVQRTFSIIKPDAVAKNVIGKITTRFEEAGLKIVASKMKQLSKAEAEGFYAEHSERGFFGDLVAFMTSGPVVVQVLEGENAIAKNRELMGATNPKEAAAGTIRADFAESIDANAVHGSDSEAAAAREIAYFFAATEVTTR

SEQ ID NO: 15135 - protein, 324 aa, Zea mays
  misc_feature (307)..(307): Xaa can be any naturally occurring amino acid
  unsure (1)..(324): unsure at all Xaa locations
IGYLEAGRDHIPTSRTRTNCYPLASPSPPPLQFSPTNRSSSETENGRGAVVPRVLPSLPPRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLRXPDFATIINSVTAKKVAA

SEQ ID NO: 15136 - protein, 232 aa, Gloeobacter violaceus PCC 7421
MAHLILIRHGQSLWNAANKFTGWVDVPLSERGRAEATIASCKLRDYRVNVCFTSMLMRAIETAVITLTECDDICGGKIPIIKHEADDENWHGWDNYDGDPAAELPIYPTATLDERYYGDLQGLDKAETTAKYGKEQVQIWRRSYSVRPPGGESLEDTRKRVYPYFTNRILGHIKQGDNVLVAAHGNSLRSIIMILETLSEEEVPKVELATGVPIVYELDKAAHMLSKAVLTN

SEQ ID NO: 15137 - protein, 175 aa, Oryza sativa
MAPSVMASSATSVAPFQGLKSTAGLPVNRRSSSSSFGNVSDGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 15138 - protein, 491 aa, Helicobacter pylori J99
MAQKTLLIITDGIGYRKDSDHNAFFHAKKPTYDLMFKTLPYSLIDTHGLSVGLPKGQMGNSEVGHMCIGAGRVLYQDLVRISLSLQNDELKNNPAFLNTIQKSHVVHLMGLMSDGGVHSHIEHFIALALECEKSHKKVCLHLITDGRDVAPKSALTYLKQMQNICNENIQIATISGRFYAMDRDNRFERIELAYNSLMGLNHTPLSPSEYIQSQYDKNITDEFIIPACFKNYCGMQDDESFIFINFRNDRAREIVSALGQKEFNSFKRQAFKKLHIATMTPYDNSFPYPVLFPKESVQNTLAEVVSQHNLTQSHIAETEKYAHVTFFINGGVETPFKNENRVLIQSPKVTTYDLKPEMSAKGVTLAVLEQMRLGTDLIIVNFANGDMVGHTGNFEASIKAVEAVDACLGEILSLAKELDYAMLLTSDHGNCERMKDENQNPLTNHTAGSVYCFVLGNGVKSIKNGALNNIASSVLKLMGIKAPATMDEPLF

SEQ ID NO: 15139 - protein, 393 aa, Oryza sativa
MSLPLTRKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVIEYQQLITQNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRRFKKAKNSEWNDFEYRFLGKKPSPNFELSKQELYARVEAPKGELGIYLVGDDSLFPWRWKIRPPGFINLQILPQLVKKMKLADIMTILGSIDIIMGEVDR

SEQ ID NO: 15140 - protein, 817 aa, Vibrio cholerae O1 biovar eltor str. N16961
MKPTQQKQFDKKLFQENVKRHLTATYATTVEHASARAWYLAMGRALAEFTTFDLLETEQDERILNSKSLNYLSLEFLIGRLTGNNLISMGVYEAVGQAMEELGQNLSDLLEEERDPSLGNGGLGRLAACFMDSCAAQEYPTVGYGLHYEYGLFKQSFEEGRQKEAPDAWCGVEGYPWEVARPELKQEIGFYGHVEVVNENGKERRRWVPGMLVQAMPWDLPIVGYQSDTVYPLRLWECRAIAPFSLESFNNGNYFEAQHALIDAGNITKVLYPNDNHEKGKTLRLMQQYFHSAASVRDILRRHEAAGHALADLPKYETIQLNDTHPTIAIPELMRILIDEKLMSWEAAWAICSHTFAYTNHTLLPEALETWSESLIQRLLPRHMEIIYEINHRFLQQVRAKWPGDVAKQQKLSIIEEGFHRMVRMANLCVVGSYAVNGVAALHSELVKRDLFPEFVELYPGKIQNVTNGITPRRWLKFCNPGLSALISEKIGHEWPAKLDQLTKVAQYAEDAAFQKRFMEVKKANKARLADWVKDHMGIELDTNAIFDVQIKRLHEYKRQHLNMLHILSLYHRLINDPSFDMHPRVVFFAAKAAPGYHLAKEIIYAINMIAQKVNNDPRVGNKLKVVFIPDYRVSMAEIIIPAADVSEQISTAGKEASGTGNMKMALNGALTIGTMDGANVEIREEVGDDNIYIFGLEVDGVEALKARGYNPYDFYHADPLLKASLDLLVGEEFTPGAPGKLRATYDSLLDGGDPYLVLADFASYVKAHEAIDKQYRDQAGWAKKAILNTALVGKFSSDRSIRDYVNNIWKLSAVQR

SEQ ID NO: 15141 - protein, 485 aa, Oceanospirillum sp. MED92
MPIQLKDSGLLKTNAYINGQWVAGEAGETFPVINPATGEELAQVASVTAVQTKEAINAAEKAMKAWRALPAKERSDLLERWYGLILDNQEDLAQLMTAEQGKPLFESRGEVMYGASFLKWFAEEGKRVYGDVLPATQDRRSIVIKQPVGVVAAITPWNFPNAMITRKVAPALAVGCAMVLKPAAETPLSALALAELGERAGLPAGLFSVLTTADAVAVGGEMTSNPVVKKVTFTGSTGVGKLLMKQCADTVKRTSMELGGNAPVIIFDDADLDKAVAGALVSKYRNSGQTCICANRIMVQAGIYDAFVEKFSAAVAEFRIGDGLEEATTHGPVITEKAVGDIHSKVTAAVESGATVVQGGQPSELGSYFYEPTVLTNVTRDMSLFKEEIFGPVAPIFKFETEEEAIDMANDTEFGLASYVYTNDLGRIWRVSEGIEYGMVGVNETMISSEVIPFGGVKESGQGREGSKYGLDDYLETKYICMGGL

SEQ ID NO: 15142 - protein, 128 aa, Lycium parishii
NKNTLLNNCAPGATYNKIDDPDMLEQMDIRWTELTSDEINSKKHQGFWGHEFYKHGTCCEGYNTEEAYFKLAMGLKDRFDLLTILRARGIIPGNYYTIDSIQKAIKAVTRAVPNLYCNPDPKNPRMEL

SEQ ID NO: 15143 - protein, 122 aa, Brassica napus
  misc_feature (110)..(110): Xaa can be any naturally occurring amino acid
  unsure (1)..(122): unsure at all Xaa locations
MGRRGEPYYVEAVPPVDVNKNTEWFMYPGVWTTYILMLFFAWLLVLSVSGCSPGAAWTVVNLAHFAITYHFFHWKKGTPFAADDQGIYSRLTWWEQIDNGQQLTRNRKFXTVVPVVLYLIAS

SEQ ID NO: 15144 - protein, 517 aa, Methylobacillus flagellatus KT
MTVTPALLVILDGFGYREDSHDNAIALANTPNIDRFWTQYPHTLINASETFVGLPRGQMGNSEVGHLNIGAGRVVFQDFERINQAIASREFFSNPVLIEAVNKAKAGHKAVHILGLLSDGGVHSHQDHIHATIEMAVNAGVEKVYVHAFLDGRDTPPISAKPYLEKLEQACASIGGGKIASICGRFYAMDRDKRWPRVEAAYNLITDGQGEFASASALQGLEAAYARDEKDEFVKATAIAAAGEQPVTMEDGDVVIFVNFRSDRARQLTHALLDPDFEGFNRRRQPKLAGFYTLTLYDKAETRAKPIFAPVEIRNTFGEYVAQHGLKQLRIAETEKYPHVTFFFNGGEEQVFAGEDRILVPSPKVATYDLQPEMSAYEVTDRLEAAILSRKYDAIICNYANCDMVGHSGDLSASIKAVETIDTCIARIVKAMESIGGQMIITADHGNVEQMRDYENNQPHTQHTTNQVPLFFIGKPATLAAPGTGSLCDLAPSLLAMMGLKQPPEMTGKSLVAFQAA

SEQ ID NO: 15145 - protein, 283 aa, Oenococcus oeni PSU-1
MVLSRSVPNIVLNDGHSLPAIGLGTYLVRGGQGVDQILSAIEDGYRLIDTSTNYDSEGAVGEAIRRSGIPRSEFIVTSKLPGKYHHYQDALMMIQESIFRMGIDYLDLYLIHWPLPKRDHYVKAWKALVDAQKLGLIRSIGVSNFLPEHLDRIINESGVTPAVNQIEVHPYWVQEDMLAANKSRGIVSEAWSPLGRGSAALKEDIIKNLADKYGKNTGQIILRWHTQRGIIPLPKSSSLIHQRSNIDIFDFSLTSSEIEQINALNRSDGRVDGQDPNTYEEFD

SEQ ID NO: 15146 - protein, 129 aa, Lycium parishii
NNSVMLNNCPVNPPLHYNKFTDARKITELDKRWPQLKYEYYFSRDKQYLWKNEFLKHGSCGIKRYKQPAYFDLAMNLKDKFDLLSTLRNNGITPGSTYQLDDIEKAIKTVSIKVPSLKCVEKHPGDVEL

SEQ ID NO: 15147 - protein, 428 aa, Zea mays
ASGRTKHAARTRMAIVREEAVDTSISPRVSALRPSKTMAITDQAMALRQAGVPVIGLAAGEPDFDTPPAIAEAGMDAIRNGYTRYTPNAGTLELRKAICTKLQEENGVSYLPDEVLVSNGAKQCITQAVLAVCSPGDEVLIPAPYWVSYPEMARLADATPVILPTNISENFLLRPELLTDKINEKSRLLILCSPSNPTGSVYPKELLEKIADIVKKHPRLLVLSDEIYEHIIYQPAKHTSFASLPGMWERTLTVNGFSKAFAMTGWRLGYLAAPKHFVAACGKIQSQFTSGASSISQKAGVAALNLGYAGGEAVSTMVKAFQERRDYLVKNFKELPGVKISEPQGAFYLFIDFSAYYGSEVEGFGTIKNSESLCIFLLEKAQVALVPGDAFGDDKCIRISYAASLTTLQTAMSKLKEAVALLKPCVAA

SEQ ID NO: 15148 - protein, 129 aa, Lycium parishii
  misc_feature (121)..(121): Xaa can be any naturally occurring amino acid
  unsure (1)..(129): unsure at all Xaa locations
NNSVMINNCVVKPPLRYNKITDARKISELDKRWPQLKYEYYFSRDKQYLWKNEFLKHGSCGIKRYKQPAYFDLAMNLKDKFDLLSTLRNNGITPGSTYQLDDIEKAIKTVSIKVPSLKCVXKHPGDVEL

SEQ ID NO: 15149 - protein, 341 aa, Oryza sativa
  misc_feature (137)..(137): Xaa can be any naturally occurring amino acid
  misc_feature (153)..(153): Xaa can be any naturally occurring amino acid
  unsure (1)..(341): unsure at all Xaa locations
MASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSXANCYKSEHLKKPENWXLVEKAKYIYIAGFFLTVSPDSIQLVAEHAAANNKVFLTNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 15150 - protein, 424 aa, marine gamma proteobacterium HTCC2207
MKHFMPELKKSLKLANVCYDIRGPVLDHANLLEDEGQRIIKLNIGNPGAFGFDAPDEIMHDVIHNLREAQGYCHSKGLFSARKAVMQRAQTQGIADVVVDDVIMGNGVSELIVMAMQALLNNDDEVLIPSPDYPLWTAAVSMAGGTPVHYQCNEDDNWQPNVADIESKITANTRGIVVINPNNPTGAVYSENNLKQIVSLAEKYNLVVFADEIYDRILYDDAVHIPLATLVKKVLCLTFNGLSKTYRLAGFRSGWVITSGAKHNARSYIEGLEMLASMRLCANVPAMLAVQTALGGYQSINDLILPNGRLLAQRDLAYELITQIPGVSCVKPKSAMYLFPKLDPVMYPIADDEDLVLELLKQERVLLVQGSAFNMVGTQHFRIVFLPDKDQLIEAIGRLATFLERVRVTSGTNSLTAAIRETPA

SEQ ID NO: 15151 - protein, 195 aa, Lactuca sativa
IQVAAQNCWVKKGGAFTGEVSAEMLANLGVPWVILGHSERRALLNETNEFVGDKVAYALSQGLKVIACVGETLEQREAGTTMEVVAAQTKAIADKISSWDNVVLAYEPVWAIGTGKVASPAQAQEVHAGLRKWFCDNVSAEVSASTRIIYGGSVSGSNCKELGGQTDVDGFLVGGASLKPEFIDIIKAAEVKKSA

SEQ ID NO: 15152 - protein, 254 aa, Solanum tuberosum
MGRTFFVGGNWKCNGTSEEIKKIVATLNAGQVPSQDVVEVVVSPPFVFLPLVKNELRSDFHVAAQNCWVKKGGAFTGEVSADMLVNLGIPWVILGHSERRAILGESNEFVGDKVAYALSQGLKVIACVGETLEQRESGSTMDVVAAQTKAIAERVKDWSNVVVAYEPVWAIGTGKVASPAQAQEVHAELRKWLQANVSAEVAASTRIIYGGSVSGANCKELAGQPDVDGFLVGGASLKPEFIDIIKAAEVKKSA

SEQ ID NO: 15153 - protein, 148 aa, Striga asiatica
TLVGDQGIAGLFTSAGNVLTKVNLQSLNISDVSLAVIGHYGSALAELALADLQNVNERGFWVMGKGQRLQKLKSLFVASYMGVSDVALDAIGHGFPELKTVSLLKCPFVSDNGVVAFSKAAVSLESLKLEEIHRVTQFGVFGVLVTAM

SEQ ID NO: 15154 - protein, 399 aa, Pseudomonas fluorescens Pf-5
MSGNRGVVYLGSGKVEVQKIDYPKMQDPRGRKIEHGVILRVVSTNICGSDQHMVRGRTTAQVGLVLGHEITGEVIEKGSDVENLKIGDLVSVPFNVACGRCRSCKEQHTGVCLTVNPARAGGAYGYVDMGDWTGGQAEYVLVPYADFNLLKLPNRDKAMEKIRDLTCLSDILPTGYHGAVTAGVGPGSTVYVAGAGPVGLAAAASARLLGAAVVIVGDVNPVRLAHAKAQGFEIADLSKDTPLHEQIADLLGEPEVDCAVDAVGFEARGHGHAGAQHEAPATVLNSLMGVVRVAGKIGIPGLYVTEDPGAVDAAAKMGSLSIRFGLGWAKSHSFHTGQTPVMKYNRQLMQAIMWDRINIADVVGVEVISLDDAPRGYGEFDAGVPKKFVIDPHKLFSAA

SEQ ID NO: 15155 - protein, 264 aa, Erwinia carotovora subsp. atroseptica SCRI1043
MKPTTISHLRQWKQEQRKFATITAYDASFSRLFFEQGIRVMLVGDSLGMTVQGHDSTLPVTTHDIVYHTQCVRRGAPLALVLSDMPFMTYATPEQTFSQAAELMRAGANMVKLEGGSWLAPTVKMLTERAVPVCGHLGLTPQSVNIFGGYKIQGRSESDANQLLADALALEEAGAQLLVLECVPVALAKRVTEALSIPVIGIGAGNVTDGQILVMHDALGITGDSTPKFAKNFLAQSGDIRTAVRLYSQEVEQGIYPAEEHSFH

SEQ ID NO: 15156 - protein, 215 aa, Xylella fastidiosa Ann-1
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMTLTDGQPVWREGVITDNGNVILDVHHLCITDPVKLEQELNQIPGVVCVGLFARRCADLVIIGSEPPHIL

SEQ ID NO: 15157 - protein, 333 aa, uncultured crenarchaeote 4B7
MPYTSFDNVGLVKVLSFFQTHDSEYLSGQDLSDVLKISRVAVWKHIKKIQTLGYKIESKQKLGYRLVDDTEKLLPWEITRDLKTKVIGKRIYYFEEIDSTQNFAKQIAYDKKENGTIIIAEKQTAGRGRLDRKWTSPKGGMWFSLIIHPKFDVSNSTLIPILSAVALSKSIKSVLGIKTEVKWPNDITMNGKKVAGMLVDASFQANNIDYLILGIGVNFDIDAKKLEKRLAKTPNFYGVNSLRKKDDKTPPKLLLKEFLLQFEEKLSQLDNGEKSKIVKEWTKRAAGIGKKITINTSNGKISGISQGIDNDGALKIKTRKETKKIFVGDVVLS

SEQ ID NO: 15158 - protein, 458 aa, Listeria innocua
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALGCVLILLLFNLATVKAFGEIEFWFAIIKVVVIIALIVIGFVLVFIGYKHGTSTASFSNLIDYGGFFPNGVAGFLLAFQMATFSFVGIELVGVTAGEADDPERTLPKAINNIPIRILIFYIGALLVLMSIYPWSNIDPDTSPFVSVFTMIGIPAAAGIINFVVLTAAMSSCNSGIFSTSRMLYTLSAEGKAPKKMHHLSSNGVPATALITSTACLLIGVFLNYILPEQVFILVTSIATICFIWVWGIILVAHLRFRHKHPEISAKSKFKMPLSPFMNWVSLIFFAGLLIILGFAADTRIALFVTPVWFLILAIAYQILKASNRKTKIRHN

SEQ ID NO: 15159 - protein, 516 aa, Arabidopsis thaliana
MARSVDTEAMTTRDPSSKRGGWKTFPFMIATLLGLSIASFGWVMNLVVFLIKEFNIKSIAATQNSNIVNGCVSMLPVVAAILADSFFGNIPVISVSAFISLLGIILLTMITSLDHLRPPPCETGSILCESPSKLQLGILYIALALVIIGSAGTRFTLASAGANQYEKPKEQGSFFNWYFLTLYTGAITGATAIVYTQENASWKLGFGLCAVANLISFIVFVSGKRYYKHDKPMGSPFTNLIRVVVAATRKRKAVISSREEDYHHGLGREGKTSSAMPSKSFRFFNRAALKTEDDSVNNNWRLCSVQEVEDFKAVFRVLPLLLAIIFVSTPMVTQTSLIILQALVTDRGLGPHFKIPAGSLQVIVIITACIVILMNNCLVYPMYQKLAHKPLTPLQKVGIGHVFIILSMAISAIVEAKRLKTVTNGHSMSVLWLHRDFIASVVIGISFYLSTALITLIQKTTKWLPNDINHGRVDNVYWLLVIVGVLNYFLVCAWFYRYRNLNDDDDQEQDPKDDTT

SEQ ID NO: 15160 - protein, 151 aa, Archaeoglobus fulgidus
MERTFVMVKPDGVQRGLVGEVIGRLERKGLKIVAMKMLWIAREMAENHYAEHREKPFFSALVDYITSGPVVAMVVEGKNAIKVVRTLVGATNPAEAAPGTIRGDFGLDVGRNVVHASDSPQSAEREISLFFSDDEIVNWEKADEDWIYEER

SEQ ID NO: 15161 - protein, 548 aa, Arabidopsis thaliana
MANSDSGDKEAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSAPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 15162 - protein, 151 aa, Methanothermobacter thermautotrophicus str. Delta H
MMEKSFVMLKPDAVKRRLAGRIIARFEDRGLKIVAFKMLQIPEDLAMEHYQEHREKPFFRDLVDYITSAPVIAMVIEGKDCISLIRKMVGATNPAEADLGTIRGDFALETGRNIIHASDSPESAEREIKLFFDESEICSYEMPDREMIYEE

SEQ ID NO: 15163 - protein, 556 aa, Arabidopsis thaliana
MADSKSGDTEVAHRSSDPSEKRGGWITLPFMLGMSITSFGWGMNLIVFLIEEFHIKNIAAAQISNVVNGVVNMLPVVAAILADSFFGNIPVISTSTFISLAGTSLLTLITSLNYLMPRPCETGSILCQSPSKLQLGILYVALALVIIGSAGTRFTLAAAGANQYKKPKEQGRFFNWFFLALYIGAITGTTAIVYTQDNASWKLGFGLCAVANLISFIVFIAGVRFYKHDKPLGSPYTSLIRVLVAATMKRKAVISSKDEDYHQYGLGKEAKTYTTMPSKSFRFLNRAALKNKEDLNTSGDSSNNMWRLCSVQEVEDFKAILRLVPLWAAVMFLSTPVAVQMSMTVLQALVMDRKLSPHFEVSAGSLQVIVLVFGCVFIMLNNWIIYPMYQKLIGKPLTPLQQVGIGHVFTILSMAISAVVEAKRLKTVENGGHPMSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDVKT

SEQ ID NO: 15164 - protein, 123 aa, Lycium parishii
  misc_feature (20)..(20): Xaa can be any naturally occurring amino acid
  unsure (1)..(123): unsure at all Xaa locations
NYSTTLNHCDHTKTYKKFRXTKEKSDLYKRWPDLTITEFDCLDKQAFWSREYMKHGTCCSDKFDRVQYFALAMALKDKFDLLKSLRNHGINRGYSYTVQKINSTIKAITRGYPNLTCAGPREL

SEQ ID NO: 15165 - protein, 339 aa, Cryptococcus neoformans var. neoformans JEC21
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGGAKKVVISAPSADAPMFVCGVNLDAYKPEYQIVSNASCTTNCLAPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 15166 - protein, 200 aa, Triticum aestivum
MSAVNITNVAVLDNPTAFLNPFQFEISYECLVPLDDDLEWKLTYVGSAEDETYDQQLESVLVGPVNVGTYRFVFQADPPDPLKIREEDIIGVTVLLLTCSYVGQEFMRVGYYVNNDYDEEQLREEPPAKLLLDRVQRNILADKPRVTKFPINFHPEPGTSSEQPQQDAEQQQQPTSPEPQTAPVEPHMAPLENVPIAADQ

SEQ ID NO: 15167 - protein, 373 aa, Methanocaldococcus jannaschii DSM 2661
MMVRVMRYKKVPVKKIVNKIIDECDVILLVLDARDPEMTRNRELEKKIKAKGKKLIYVLNKADLVPKDILEKWKEVFGENTVFVSAKRRLGTKILREMIKQSLKEMGKKEGKVGIVGYPNVGKSSIINALTGKRKALTGSVAGLTKGEQWVRLTKNIKLMDTPGVLEMRDEDDLVISGALRLEKVENPIPPALKILSRINNFDNSIIKEYFGVDYEEVDEELLKKIGNKRSYLTKGGEVDLVRTAKTIIKEYQDGKLNYYKVDLKKYGQDRERDISFITKYLKDFPFIEDAKMIVTHLKDFDGLYKKIKKPVLGSEEIDGNIVVVSFGEKTKDACRKKVENLCRERNIEVLSKFGDKIGANNIYVAVGKRVKE

SEQ ID NO: 15168 - protein, 385 aa, Brassica napus
  misc_feature (180)..(180): Xaa can be any naturally occurring amino acid
  misc_feature (335)..(335): Xaa can be any naturally occurring amino acid
  unsure (1)..(385): unsure at all Xaa locations
MERARRLAYRGIVRRLVNESKRHRNGEITPHHVPSVVPHAPSRYISSLSPFLSNNHHRSVNLPKHHHHNHNQTRSISVDAVKAGDTFPRRHNSATPDEQAHMAKYCGYDHIDSLVDDTVPKQIRIDSMKFSKSARAPAESEMIAHMTELASKNKVFKSFIGMGYYNTHVPTVIIRNILEXNPAWYTQYTPYQAEISQGRLESLLNFQTMITDLTGLPMSNASLLDEGTAAAEAMAMCNNIQKGKKKTFVIASNCHPQTIEICKTRADGFDLKVVTKDLKEIDYSCGDVCGVLVQYPGTEGEVLDYGEFVKNAHANGVKVVMATDLLALTVLKPPXEFGADIVVGSAQRFGVPMGYGGPHAAFLATSSEYKRMMPGRIIGVSVDST

SEQ ID NO: 15169 - protein, 510 aa, Listeria monocytogenes str. 4b F2365
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVNAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 15170 - protein, 462 aa, Bacillus subtilis subsp. subtilis str. 168
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 15171 - protein, 856 aa, Arabidopsis thaliana
  misc_feature (594)..(594): Xaa can be any naturally occurring amino acid
  unsure (1)..(856): unsure at all Xaa locations
MATSSSNLLGKRNPEEDDLVTKKTLFNGHIPPQTKISDIINFFKDAGEVVRVRLFVTAKRIHRCYGLVDFASANEAKKVLYKKNGEYLHDYKIFLYVYSRRPQPPRRPRPPGLNYNDYLQRESLPIEENETPSDFVEEVLYVANLSPQTKILHVRCKRRMVNICMIIRFFFKWLRQLHTLHDPILSFSLKSRANTLGCYIQAVAVRKKTLFVSRLSPEAQISDIINFFKDVGQVVHVRLIVDYTGEHVGDGFVEFASANEAEKSQVSLKEEQQKQYSKSTAKYRTLDKRSGATPIKLQRRCFSREDLRAAINRFPRRRKKGFINTIIWFWAYVLERPPFKIAFSILVVVPISVSLNVTASRRRVSEFDVKFQLMGAYCDENLSSLPVFSSGAPANELRFSKHVYDNVHGNIYLDPLCLKFIDTEQFQRLRELKQLGVTNMVYPGAVHSRFEHSLGVYWLAGETAQRLKNFQGMELGIDNYDLQTVRLAGLLHDIGHGPFSHMFEREFLPKVISDCQWSHELMSVNMIDHMVDTHHIDIDAQMLKRVKDMILASTEFSQLKGNAEKRFLYDIVANGRNGIDVDNFFLSLFTHHGXDYLVRDSRACGLGSNFQFQRLTETMRVLDNEICFRAKEYLSVHKLFATRADLYRTVYTHSKVKAIELMIVDAMVKANNHLEISSMINDPSEYWKLDDTILKTIEIAPDPELAEAKELILRVRRRQLYQFCNEYAVPKDKIDHFKAVTPQDIICSQKHTSLTLKEEDIAVTNVKIDLARGRENPLECINFYKDYDSAEKFVIPEDRVSHLLPTTYQDMIVRVYAKKPELVEAVSEAFENFQMRTYGIKAQVHATPEKKKRRVM

SEQ ID NO: 15172 - protein, 455 aa, Methanosarcina mazei Go1
MTKVVEISPTTRHEGHSKLTLKVNDQGIVERGDWLSITPVRGVEKLAIGKTMEQVPKIASRVCGICPVAHCLASIEAMEASIGCEIPKDAKLLRVILHAANRLHSIALHNILILPDFYIPGTETKINPFSKEEPFRSVATRIFRIREIAQTIAAIAGGEAIHPSNPRIGGMYQNVSPRAKQKIADLAKEGLVLVHEQMEFMLDVIRDMQNREYVTVGGQNIPIPKTLGYHNQGVMATSPMYGSSSLDENPTWDVTRWKETRPWEWYMGEVTIDLEDPNYPIGGTTKAGTRANPQMEACNSVPTYDGQPVEVGPRARLATFKNFNEKGTFAQHIARQMEYPDCLYTILKCLDDLDTSGKVIADHIPQGDGSMGWAANEAPRGTDIHLAKVKDGRVLWYEMLVPTTWNFPTCSRGLKGAPWQIAEMVVRAYDPCVSCATHMIVVDEKNRIVAQRIIQ

SEQ ID NO: 15173 - protein, 615 aa, Pinus pinaster
MPQAKREEGIESVQESIIIATTERNRKALDFIEHATIHAAEVQAEVLLEILTRNAYTEYLERYQLTGRTDRKSFKERLPVITYEDLQPEILRIANGDMSPILSAHPISEFLTSSGTSAGERKIMPTIHEELKRRTLLYSLLMPVMNQYMKGLDKGKGMYFLFVKSETRTPGGLLARPVLTSYYKSQDFIERPYDPYNVYTSPMEAILCSDSYQSMYCQLLCGLAQNHEVLRVGAVFASGLLRAIRFLEEHWQSLCQDIRSGTVNDEEVTDPCLRESVMKILHPNTQLADLIRTECSKESWQGIITRLWPNARYLDVIVTGAMAQYIKTLDFYSGGLPQVCTMYASSECYFGINLKPLCQPWEVSYTLMPNMAFFEFLPVYRNKNEDAGPVTTATEQPAELVDLVDVKVGQEYELVITTYSGLYRYRVGDVLRVTGFHNAAPQFQFVCRKNVMLSIDADKTDEAELHNAVMNAVKHLEPLEATLVEYTSYTDTSTIPGHYVLYWELRTSALPVPPSVFEDCCLTVEESLNSVYRQCRVADKSIGPLEIKVVEMGTFDKLMDYAISRGSSINQYKAARCVKFAPMVDILNSRVSASYFSPRCPKWTAGRTQWGALPR

SEQ ID NO: 15174 - protein, 486 aa, Listeria innocua
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLLLIFGLNALSVKAYGESEYWFSIIKVATVIIFLIVGVLTIVGILGGEVIGFSNFTAGDAPFKGGFFAILGTFLIAGFSFQGTEMVGIAAGESATPEKSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLNELKYKAKFFPFGPILALILCILVIVGQDYAAFLKPEFTNPAWWQKIGISYIGLPIFLIFWLSFKFTNKTKVIPLEDCKFDQK

SEQ ID NO: 15175 - protein, 110 aa, Arabidopsis thaliana
  misc_feature (83)..(83): Xaa can be any naturally occurring amino acid
  unsure (1)..(110): unsure at all Xaa locations
MPSSMLSSATMVASPAQATMVAPFNGLKCYAAFPATLKANNDITSITSNGGRDNCIAVWPALGKKKFETLSYRSDLTDSELAXGVHYLIPNQGVSCVKFEVEHGFVYPEH

SEQ ID NO: 15176 - protein, 618 aa, Arabidopsis thaliana
MIPHQEVNEEEASLFDFLWLLLASVIFVPLFQKIPGGSPVLGYLAAGILIGPYGLSIIRNVHGTRAIAEFGVVFLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPFVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 15177 - protein, 328 aa, Clostridium perfringens ATCC 13124
MSVKESVLKILEENRERSISGEELAKHLSVSRAAIWKAIKSLRGEGYNISAVTNRGYQLTKDNDLISAEGIKIFLNPKYRENYIRVYKTIDSTNQEAKKLLMDNDIPHGTILIAEEQTAGRGRFQRKFFSPSNKGIYMSVILRPNIELSKAIHITTSAAISVCRAIETLTKKRPKIKWVNDIFLDDKKICGILTEATGNFESGRVENVVVGIGVNFKTDSKDFPEDIKNIAGSVFGGEKPTITRNQLVAEILNELFELCENLEDKSIMTEYRILSLVLGKEVSFLKNNKLNKGLAIDITDEGALVVKYENGEIEYLNSGEVSVKTLNK

SEQ ID NO: 15178 - protein, 101 aa, Arabidopsis thaliana
  misc_feature (6)..(6): Xaa can be any naturally occurring amino acid
  misc_feature (33)..(33): Xaa can be any naturally occurring amino acid
  misc_feature (41)..(42): Xaa can be any naturally occurring amino acid
  misc_feature (45)..(45): Xaa can be any naturally occurring amino acid
  misc_feature (53)..(53): Xaa can be any naturally occurring amino acid
  misc_feature (59)..(59): Xaa can be any naturally occurring amino acid
  misc_feature (61)..(61): Xaa can be any naturally occurring amino acid
  misc_feature (69)..(69): Xaa can be any naturally occurring amino acid
  misc_feature (78)..(78): Xaa can be any naturally occurring amino acid
  unsure (1)..(101): unsure at all Xaa locations
MASSMXSSTAVVTSPAQATMVAPFTGLKSSASXPVNRKGNXXITXITSNGGKXSCMKVXWXPIGKKEVXTLSYLPDLXSDVEFAKEVLPFSEFPSFLKVGT

SEQ ID NO: 15179 - protein, 129 aa, Brassica oleracea
VSCSAGPVGDDMFHWQATIMGPTDSPFSGGVFLVSIHFPPDYPFKPPKVSFAPRFTTDINSNGSICLDILKEQWSPALTISKVLLSICSLLTDPNPDDPLVPEIAHTYKTDRVKYESTARSWTQKYAMG

SEQ ID NO: 15180 - protein, 264 aa, Escherichia coli CFT073
MKPTTIASLQKCKQDKKRFATITAYDYSFAKLFAEEGLNVMLVGDSLGMTVQGHDSTLPVTVADIAYHTAAVRRGAPNCLLLADLPFMAYATPEQAFENAATVMRAGANMVKIEGGEWLVETVQMLTERAVPVCGHLGLTPQSVNIFGGYKVQGRGDEAGDRLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 15181 - protein, 282 aa, Schizosaccharomyces pombe
MSGFCVLGCGTMGKALLTGIFDSIAENGNDVSDEIIIPNKFYACVKFPKEKEDVQKLFGDRVKVVMGAKENAEMAAISNVLLLSCKPQAAEDVLNSPKMKEALKGKLILSILAGKTISSLQSMLDESTRVIRIMPNTASRIRESMSVICPGPNATEEDIKFAEWVFNGIGRSMKLPEKLIDAATAVCGSGPAFVATMIEAMTDGGVMMGIPFPQAQELAAQTMVGTGRMVLQGQHPAMIRNDVSTPAGCTISGLLALEDGKIRSTIARGIEQATKTASGLGK

SEQ ID NO: 15182 - protein, 431 aa, Bacillus licheniformis ATCC 14580
MRSYEKSKAAFEEAQRVMPGGVNSPVRAFKSVNMDPIFMERGKGSKIYDIDGNEYIDYVLSWGPLILGHSNEKVVKEIQKAAEHGTSFGAPTELETELAELVIDRVPSIEIVRMVSSGTEATMSALRLARGYTGRNKIVKFEGCYHGHGDSLLIKAGSGVATLGLPDSPGVPESIAKNTITVPYNDLESMKLVFQEFGDDIAGVIVEPVAGNMGVVPPVKGFLEGLRELTETHGALLIFDEVMTGFRVDYNCAQGYFGVTPDLTCLGKVIGGGLPVGAYGGKAEIMEKIAPSGPIYQAGTLSGNPLAMTAGLETLKQLTPESYREFSRKADRLEKGISEAAEKNGIPCTFNRAGSMIGFFFTNGPVINYDTAKQSDLGLFAEYYKGMADEGVFLPPSQFEGLFLSTAHTDDDIEHTIKAAERVFERISRSR

SEQ ID NO: 15183 - protein, 531 aa, Triticum aestivum
MVPYMLCFQFVACCLLVLLYSLRSGSTSSAGHGPRSYPVIGCLLAFYENRRRLLDWYTEMLSASPTQTIVVDRLGARRTVVTANPANVEYILLGNFGNYPKGKPFTDVLGDLLGNGIFNVDGDKWFAQRKLVSHEFSARTLRELEIAVLEAEALDRLVPAMEAAAEPGGGAVDMQDVLRRFAFDVICRVSLGVDPGCLDPALPAPRLATAFDAAAGIIARRGAAPLAAVWKIKRALNIGSERRLREEVQVIHEAVMDLIRSRKKKRFLVNAGDVRNDLLSRMIDCGYADEDIRDMVISFIMAGRDTTSSALTWFFWLLMRHRDVERDVLEEITSMRRDSSNGTYTGEGFDLDDFRRMRVLHAALSETMRLYPPVAWDSKHAAAADVLPDGTRVASGDRVTYFQYGMGRMEAIWGSDAGEFSLERWLALPADGNAASGGVSPFKYPVFQGGPRTCLGREMAFVQMKFVAGAILRRFDLRPVDEGRTPAFLPLLTSHMHGGLKVTVRRRKVESTTGNALHDAATDKSRSSFFS

SEQ ID NO: 15184 - protein, 304 aa, Oryza sativa
MAAPSSLASSHLSRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 15185 - protein, 311 aa, Streptococcus pneumoniae R6
MKSYQAVYQILSKETDYISGEKIAEKLSLSRTSIWKAIKRLEQEGIEINSIKNRGYKLMNGDLILPEILEENLPIKVSFKPETKSTQLDAKEAIDLGHEANTLYLASYQTAGRGRFQRSFYSPQGGIYMTLHLKPNLPYDKLPSYTLLVAGAVYKAIKNLTLIDVDIKWVNDIYLNNHKIGGILTEAMTSVETGLVTDIIIGVGINFTIKDFPQELKEKAASLFKATAPITRNELIIEIWRAFFETPAEELLYLYKKQSFILGKEVTFTLEQKDYKGLAKDISENGKLLVQCDNGKEIWLNSGEISLNSWK

SEQ ID NO: 15186 - protein, 254 aa, Listeria monocytogenes str. 1/2a F6854
MRKPLVGINMKNYINTRAQTSEWLEATIPLLGNFSDVDTFIFPSMGTLETTANLLSGTSFGFGPQNMAPEKSGPLTGEFSVESIIDLSANYVEIGHAERKNLFHEKTSEIAKKIKLALDEKITPVVCVGEGIRANDTNELKNALKKQIEALFDTIQVTQFKNVVLAYEPEWAIGKANSADTNYIESAHQALREIIRELGGDETLVRIIYGGSVSKENAAEIVRQKNVDGLFVGRFGHKPQNFADIVSIVSKTKG

SEQ ID NO: 15187 - protein, 444 aa, Solanum tuberosum
MGQGTPGGLNRQLPGDRKNDGDKKEKKFEPAAPPARVGRKQRKQKGPEAAARLPTVTPLTKCKLRLLKLERIKDYFLMEEEFVANQERLKPQEEKTEEDRSKVDDLRGSPMSVGNLEELIDENHAIVSSSVGPEYYVGILSFVDKDQLEPGCAILMHNKVLSVVGLLQDDVDPMVSVMKVEKAPLESYADIGGLDAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVRTKRYDAHSGGEREIQRTMLELLNQLDGFDSRGDVKVILATNKIESLDPALLRPGRIDRKIEFPLPDIKTRRRIFQIHTGKMTLSDDVNLEEFVMTKDEFSGADIKAICTEAGLLALRERRMKVIHADFKKAKDKVMFKKKEGVPEGLYM

SEQ ID NO: 15188 - protein, 143 aa, Glycine max
  misc_feature (23)..(23): Xaa can be any naturally occurring amino acid
  misc_feature (25)..(25): Xaa can be any naturally occurring amino acid
  unsure (1)..(143): unsure at all Xaa locations
ALNLALGSLPQFTICNRAGAGGXVXFTVPLFTAGLPTRKTNNDITNIVSNGGRVRCMQVWAPVGKKKHETLSYLPDLDDAQLAKEVEYLPRKGWIPCLESEREHGLVYREHIRLPGYYDGRYWTMWKLLMIGCTDASQVLKEL

SEQ ID NO: 15189 - protein, 505 aa, Oryza sativa
MELLPWLLGFVVKYPEIMASAACFLLLFCRFRRRSKRIPTNWPVVGALPAIVANAGRVHDWVTEFLRAAAMSHVVEGPWGSPGDVLITADPANVAHMFTANFGNYPKGEEFAAMFDVLGGGIFNADGESWSFQRRKAHALLSDARFRAAVAASTSRKLGGGLVPLLDGVAASGAAVDLQDVFMRLTFDLTAMFVFGVDPGCLAADFPTVPFAAAMDDAEEVLFYRHVAPVPWLRLQSYLKIGHYKKMAKAREVLDASIAELIALRRERKAADANATGDADLLTAYLACQDEIGMDGAAFDAFLRDTTLNLMVAGRDTTSSALTWFFWLLSNHPGVEARILAELRAHPPSPTGAELKRLVYLHAALSESLRLYPPVPFEHKAAARPDTLPSGAAVGPTRRVIVSLYSMGRMEAVWGKGCEEFRPERWLTPAGRFRHERSCKFAAFNVGPRTCLGRDLAFAQMKAVVAAVVPRFRVAAAAAPPRPKLSIILHMRDGLKVKVHRRQED

SEQ ID NO: 15190 - protein, 437 aa, uncultured crenarchaeote 4B7
MTNTQEIYKKKTKNSAKLFTKSKKVHINGVHHNIRFFEPYPFITKSADGKFLKDVDSNKYVDYWMGHWSLILGHAQKQIQKKASGQLKKGWMHGTSNENAISLSEKISKAVPVAEKIRYASTGTEATMYSVRLARAVTGKKIIAKIDGGWHGYTTDLLKTVNWPFDVSESQGLTDEEHIISLPLNNLQESLKILNSIKNDLAGVLVEPILGGGGAIPATQEYLKGIQEMVKTNNALFMLDEIVTGFRFRYGCIYSKMKLDPDIVTLGKIIGGGFPIGVICGKDEIMEHANTSLNSKKNRTYIGGGTFSANPLTMIAGDTTLDVLKNKTNTLYKKLNGLGDNTSKMLKKIFSDDVIVTGKGSLFMTHFPRDEMTEINNAADAAKCDSTKLFNYHFEMITKNGIFFLPGKLGAFSDAHSTVDVKDMKKATEDFVSNFKK

SEQ ID NO: 15191 - protein, 123 aa, Zea mays
MFYFFQELMPGGVNSPVRAFKSVDGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAF

SEQ ID NO: 15192 - protein, 430 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEGESGSEDEYSDSENDHEGQEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVRIVNGAYRGSNARLLSVDTERFCAKVQVEKGLYDGKVLKAIEYEDICKIFH

SEQ ID NO: 15193 - protein, 308 aa, Triticum aestivum
  misc_feature (149)..(149): Xaa can be any naturally occurring amino acid
  unsure (1)..(308): unsure at all Xaa locations
MSSPHGGLDDQIERLMQCKPLPEAEVRALCEKAKEILMEESNVQPVRSPVTICGDIHGQFHDLAELFRIGGKCPDTNYLFMGDYVDRGYYSVETVTLLVSLKVRYPQRITILRGNHESRQITQVYGFYDECLRKYGNATVWKTFTDLFXDYFPLTALVESEIFCLHGGLSPSIETLDNIRNFDRTQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 15194 - protein, 514 aa, Shewanella sp. MR-4
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDVAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYDLITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 15195 - protein, 754 aa, Haloarcula marismortui ATCC 43049
MSDDELAKDLGLVSAMTIGIGTMIGAGIFVLPGVAANAAGPVVVVSFVVGGLIAMVNALSVSELGTAMPKAGGGYYYINKSLGPLFGSIAGMGDWMGLAFASAFYCIGFGQYLAVFVPLPEVAFLNPIQIGALIAGAIFVAVNYIGAKETGGVQTVIVFILLSILTVFAVAGFFAFDYATLAGADGLAPFGTGAILPATALVFVSFLGYAKIATVAEELKNPGRNLPIAIIGSVGIVTVIYAILVSMMLGVVPWPELSQDAPVAQAAQLAFPESIGPIGGVAAGAAAVMTVGALLATASSANASILASARINFAMGRDKIVTNWLNEIHPNYATPYRSILVTGGLIIVFIAFLGRDIEVLAKAASVLHLIVYALLNVGLIVFRETDAPEYDPDFTVPLYPITPILGAVLSLGLVAFMDSIEIALSAGFVLVAVVWYFVYARGKTTQKGVLSDYISDREEQLPDQVVNAADAVAPNGAGGPTIMVALANPRTESALITLASALAQHEDGRVLATHIATVPDQTALETAAANRDRIDATSESLLDTAKADAEAFDVPIETKTILSHRGIEEVFDAARTNHADTVVMGYGGTQFAGGRAEGTLDELAHDLPCDFLVLDGQDLDLSDVLVPTAGGLSSDLSAAVAKALEETFGVAVSLLHVVDPGEEESGRQFMYEWAAEHGLSDAELRIETGDIEATIERLGRDYSLVIVGATERGLLSRIVRGSLVFDVIETLDTPVLLAERPSSRSLRERLFGRE

SEQ ID NO: 15196 - protein, 357 aa, Agrobacterium tumefaciens str. C58
MRALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQGVVVQTGLHPHENPIDWFQVTFRDLEIKGSWAYPTHYWPRVIRLIASGLLPATKIVTKRITLDTAVTEGFDALLDPAGTHLKILIDLSK

SEQ ID NO: 15197 - protein, 346 aa, Solanum tuberosum
MSSSKPLKLLHLLEGASSPLIGSIATAGKKLASIGLDNTEANRQAYRQLLLTTPGLGDYISGSILFEETLFQSTTDGKKFVDVLRDQNIVPGIKVDKGLVPLPGSNNESWCQGLDGLASRSAEYYKQGARFAKWRTVVSIPCGPSALAVKEAAWGLARYAAISQDNGLVPIVEPEILLDGDNPIERTLEVAERVWAEVFYYLAENNVVFEGILLKPSMVTPGAEHKEKATPDTIAKYTLTMLKRRVPPAVPGIMFLSGGQSEVEATLNLHAMNQSPNPWHVSFSYARALQNTVLKTWQGRPENVDAAQRALLIRAKANSLAQLGKYSAEGESEEAKKGMFVKGYTY

SEQ ID NO: 15198 - protein, 511 aa, Bacillus licheniformis ATCC 14580
MSNKLAALIILDGFGLRDETVGNAVAQAKKPNFDRYWNKYPHQTLTASGEAVGLPDGQMGNSEVGHLNIGAGRIVYQSLTRVNVAIREGEFEQNETFLAAMKHVKEKGTNLHLFGLLSDGGVHSHIHHLYALLKLAKKEGVENVYIHGFLDGRDVGPQTAEKYIKELQDQIEEIGVGEIATLSGRYYSMDRDKRWDRVEKAYRAMAYGEGPKYQNPLDVVKDSYENGIYDEFVIPSVITKENGEPVATIKDNDAVIFYNFRPDRAIQISNTFTNDDFRDFDRGDKHPKNLHFVCLTHFSETVDGYVAFKPVNLDNTVGEVLSQNGLKQLRIAETEKYPHVTFFMSGGREEKFPGEERILIDSPKVATYDLKPEMSAYEVKDALVKEIEAEKHNAIILNFANPDMVGHSGKVEPTVKAIEAVDECLGEVVDAILAKGGYAIITADHGNADVLITEEGKPHTAHTTNPVPVIVTKEGVTLREGGILGDLAPTLLDLLGVEKPKEMTGSSLIQK

SEQ ID NO: 15199 - protein, 384 aa, Arabidopsis thaliana
MALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 15200 - protein, 664 aa, Zea mays
MATGEEHVAAPVVKETSEKKQASTTARTLRLDEEVRGEGLVPIRFDSFRVVKAYRVVKIFLSKGGSESLYSASVLVELDAPQSKRIWPKPVALLPAKAANENMQSSFWGKKESGKLLGGWDNDLFSLGSSLKKAYTDPAAMMVWSCGIILFVLMAGYLPFEDANLMRLYKLICHATFSCPPWFSSGARKFIKHILDPNPGIFRDERIQSMFLEQESWFDVVERTSKDNNKTLQFYFLNITKKLIQGNHFSFLLLLSGRYDVCCPMMSAWDLHKAWPESEFKVVADAGHSANEVGIAAELSIKGVYNAHPTADVFINFASFRRELRGFGFIQYFDPEDASDAKGKQEEALLTSAQARCIADVRADASSTTFLAGTLSLKEENEVHLIRLSPAESELVCDGVFYHPNEIWDLKSCPFDHRVFSTVYTSGEGFGASVWKIPELNGQSNSPQLEQLFELSGHTGKIRRKSSAIEHAHIRDVDYNPKKQHIIATTEDDFGICLWDLRMLKLPLKDLPGHSHWTWAIQHNPEYDELLLSAGTDSTVNLWLAKVSNNDSEPNSPSGSPNRQEEPLLNSYTDYEDSIYGTLQPSYFAYQLELREGITGLIKIVGIAWSSHDPSLFASLSYDGRQWQKKHNKDVAEIILLDIRSSTLLIEASNGSKTLRSSFS

SEQ ID NO: 15201 - protein, 253 aa, Bacillus licheniformis ATCC 14580
MRKPIIAGNWKMNKVLSEAVSFVEEVKSSIPAADKAEAVVCAPALFLEKLTSAVKGTDLKVGAQNMHFEESGAFTGEISPAALKDLGVEYCVIGHSERREMFAETDETVNKKAHAAFKYGIVPIICVGETLEEREANKTNELVADQVKKALAGLTTEQVAASVIAYEPIWAIGTGKSSTAQDANEVCAHIRKTVASEFGQTAADSVRIQYGGSVKPANIKEYMAESDIDGALVGGASLEPQSFVQLLEAGQYE

SEQ ID NO: 15202 - protein, 335 aa, Bacillus licheniformis ATCC 14580
MAVKVGINGFGRIGRNVFRAALNNPEVEVVAVNDLTDANMLAHLLQYDSVHGKLDAEVSVDGSNLVVNGQTIQVTAERDPSKLSWGEQGVEIVVESTGFFTKRADAAKHLEAGAKKVIISAPASEEDITIVMGVNEDKYDAANHHVISNASCTTNCLAPFAKVLNDKFGIKRGMMTTVHSYTNDQQILDLPHKDYRRARAAAESIIPTTTGAAKAVSLVLPELKGKLNGGAMRVPTPNVSLVDLVAELDKEVTAEEVNAALKEAAEGELQGVLGYSEEPLVSKDYNGNTNSSTIDALSTMVMEGSMVKVISWYDNESGYSHRVVDLAAYIAKQGL

SEQ ID NO: 15203 - protein, 113 aa, Brassica napus
  misc_feature (70)..(70): Xaa can be any naturally occurring amino acid
  misc_feature (79)..(79): Xaa can be any naturally occurring amino acid
  misc_feature (81)..(82): Xaa can be any naturally occurring amino acid
  misc_feature (86)..(86): Xaa can be any naturally occurring amino acid
  unsure (1)..(113): unsure at all Xaa locations
MSYSAAGFGKPGSGKRRIRELLTQSDNRFCADCGAPDPKWASANIGVFICLKCCGVHRSLGTHISKVLSXVTLDEWQMXKXXPCPXIAGNDLPLRGLYDGPPPRHLMLTHPPP

SEQ ID NO: 15204 - protein, 488 aa, Zea mays
  misc_feature (216)..(216): Xaa can be any naturally occurring amino acid
  unsure (1)..(488): unsure at all Xaa locations
EFHCVGKELSGLFMNQEIQAHNGSIWTIRFSPDGRYLASAGEDCVIHVWEVSDFERKREENGVCNPLVAMVCNGSPETTLALASSLDGSNREKKRRARFLEGRRSMSSDRLMVPEHVFALSEKPIRTFVGHSEDVLDLCWSKSQYLLSSSMDKTVKLWHISSTSCLKTFSHSDYVTCIQFNPVDDRYFISGSLDEKVRIWSIQNREIVDWKDFHEXVTAACYTPDGQSALIGSHKGSCHIYDTSDNKLLKKKQIDLQNKKKKSSQKKITGFQFLPGSTSRVLITSADSRIRVVDGLNLVHKYKGFRNTNSQISACLAANGRYVISASEDSHVYIWRNDGILERGSSKGNVTVTNSYEHFHCQDVTVAVAPPSNGSAVVSRSNSTKHDERDSVLEHPMLHAVPEKLQDSSDLQLQSGNILSTSSNHSGDRATWPEELMTPTKQSPQSSASLLSGADQAPCWSAWGTVIVTAGRGGQIRAFQNFGFPARV

SEQ ID NO: 15205 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 15206 - protein, 455 aa, Bacillus licheniformis ATCC 14580
MEKDMQKLERTMTSRHIMMMALGGAIGAGLFKGSSKAIDLAGPSVMIPYLIGGVILLFIMQGLAEMAVRNSEARTFRDLVQSILGPYAAYFLDWIYWKMWVLNIAAEAVVAAMFLQYWLPGLPIWVLALFVSLVITSVNLLSVKSFAETEYWLALIKITVIVVFIISGFILLFFSFGQHSAVGFTHLTDHGGFFPNGAGGLITAMLVVIYSYGGTEIIGVTLAETKNPEKVVPKAVRGTLTRIIAFYLLPFFVIVSLIPWNQVNGVSESPFVMVFKMIGVPGADHLMNAVILLAVISSMNSGLYGASRILYTQASDGRMPKIFSRLSARKVPVYSILLCTSFLYLGVLFSLFAGSQTFEYLMGSLGYTVLVIWMLIAAAHLKSRKRNQTAGNGYYVKWFPYTTWVAIISLTAILIGVILTTSIVITLVTAGIYLLISAAYFFKGRNQTAGQTAAS

SEQ ID NO: 15207 - protein, 249 aa, Silicibacter sp. TM1040
MTDWPIGYGRRVLAEVDSTLDEAARLAPALSGPEWILALRQTKGRGRRGRAWTDPKGNFAGTLVYRPEGAPDQIALRSFVAALALYDAVETVTGRTTGLALKWPNDVLLNGGKLAGILLESSGVKSGVDHLAIGIGVNLAETPMKEWLEPGAVWPVSLQSETGVRVDPETFLSALALAFARYEDQFTTYGFGPIRELWLSRAAKLGEVITARTAREETSGTFETIDDAGNLVLKTAKGIVTIPAADIFF

SEQ ID NO: 15208 - protein, 239 aa, Arabidopsis thaliana
MMNAVITSATINCNSLSPSWTCGDNSPSKLLLGEISAALSRRRTVKVSCGKSSPDDYHSTLKSLNSRGRFPRKSLGQHYMLNSDINDQLASAADVKEGDFVLEIGPGTGSLTNVLINLGATVLAIEKDPHMVDLVSERFAGSDKFKVLQEDFVKCHIRSHMLSILETRRLSHPDSALAKVVSNLPFNISTDVVKLLLPMGDIFSKVVLLLQDEAALRLVEPALRTSEYRPINILINFYS

SEQ ID NO: 15209 - protein, 246 aa, Silicibacter sp. TM1040
MARKLAAGNWKMNGTGEHLAELENLAQGDLPEGVDVLICPPATLISRAADRAGDIAIGGQDCHAKTSGAHTGDLSADMLRDAGATYVIIGHSERRADHGEGDADVRAKTEAAQAAGLVAVVCIGETLEEREAGTTLEVVGAQLAGSLPDGVTAENTVVAYEPVWAIGTGKVPTLDQIAEVHDALRADLVARFGAAGKDLPLLYGGSVKPGNAAEIFGVSNVDGALVGGASLKAADFGPIIAALAAS

SEQ ID NO: 15210 - protein, 339 aa, Synechocystis sp. PCC 6803
MLKIGINGFGRIGRLVARIAMANPQVTLVGINDLVPASNLAYLFKYDSTHGSYGGTVVAKEEGIVIDDQFIPCFSQRNPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 15211 - protein, 1312 aa, Coccidioides immitis RS
MVFKPFTHLARQTFSKTFAHGYAQSVVAASQSSYASSATSLNQITSVPGKFTRTAQLQSAFQNASGSSSSAGAKAGHAASNYASADSGLAAYFAAWQLAQQTGEDGDWKQYQFTRRIGWKAGAKESKEEESKPERESADEQDSASLSHSSLNDGRSVRSVESAPVDKDVSARVDEAVAREIQQIQEAAELTDSASVVDSAELLESKEATSAEITPVTSVEDVAPSPKAPRTPRTPVRALRSTQATNEESNRIVELAAARSFSQVPIAFEKLLKDGVVPSIGAYNALLQAAIHLHSDVYHAVPKALDIYSDMIRRNVMPNEQTYQTLVRLLSTRALDCQHMVQNLEQARIRYGGMDEPGKSLFRSSEVEHELLTEDHSLSIALKLFTLATSRHHGIVFSLDIYRSLLTACAMKGEVDKMIQIFAHMEKNKVAPHAAMFPPMIDAFAAGGDLKSAVECYNEYRTLAIADDSGVFGVVDRKDGEVYAAVVKAYMNCGKTDGALRFFDKIRTSFDGVENREQRLKVVEDVVVKDGMVQHSIKAGNFVEALKTAQNRLGGESLRSAVLKICESAADAGESAVASEAYDLLSAEKPGSGSSSETPVVAMMAMHIRQGDLVSAKSQWAILASNDHVNADLIQPTAMYAVALLRSGQTDEGLSQARNMFAKIRNASPNKQGQLREEIDEAIDLFGRVLMQSSPVLSAHAAMTLIWAMVENGGLVSPVAEHAIASLGPMEISQLSVHDLNLALQVQAGMLINGSPLFDAAHPARFAHMLELAMSTGLPFNHHTKQLLDQGVSKVSVGRPELLRKWQHFTQGSAKPTFVSPRYSPTQKVSPAVKPTHPEDSFDPYAHSTDFRGSSMIAEELENTRGRPEDHLNTAMIKFRNMRRIGRHPRYITYAKLITAAAKCGRMNLVHEILGMARHDVPLIPQYGAVKYGWTSILDAMVAASLTAGERGLAAKYHQELLNMGAAPSANTFGLYITTLKESTKTFDEATEAVKIFHRAMSEGVEPTSFLYNALIGKLGKARRIDDCLLYFAEMRANGVRPTSVTYGTIVNALCRVSDERFAEEMFDEMESMPNYKPRPAPYNSLIQYFLNTKRDRSKVLAYYERMKSKNIEPTMHTYKLLIDAYASLEPVNMEAAEGVLETIRSTGQQPEGVHFASLVHAKGCVLHDMEGARKVFDSALSSRAVRPQACLYQALFEAMVANHKVTDTPALLESMTKAGVEMTPYIANTLIHGWATEGNVNNAKSVYESIGIQKREPSTYEAMTRAFLAAEDRQSASAVVQEMLSRGYPSAVASKVVELVSGGNPPTPVGA

SEQ ID NO: 15212 - protein, 253 aa, Triticum aestivum
MAGGGGGGKKDRGEGLGRALVRQRNKQALAAKARGQQLVISRRAQQALPLESVIEVSDIDAVLQRAAEEELLHGDDAEGAAALTAALGSGLIDLDGTGDTEEERRLLREEQEALHADSLRVPRRPPWTAQMTTEELDTNEKRAFLEWRRNLARLQENEELVLTPFEKNLDIWRQLWRVLERSDLLVMVVDSRNPLFYRCPDLEEYAQEIDEHKRTLLLVNKADLLPLSVRRKWADYFKEHDILYLFWSAKAAT

SEQ ID NO: 15213 - protein, 558 aa, Candida albicans SC5314
MIYIWHALVYISCLSSCVLSQENSSDTSTSLVNKSDLYTPRSNRTLDYSPLIQYIPVFFQKNYSSIDTPHNNDFLALQSPATTQTDSNKNSQKNDSVLDECHFMSFEEWKKQKIESNTTTSNNYSMNGSSESKSITPSNHSSVISTNVTLMEADGKVYKDKFNFASVDCAATIMKTNAQAKGASAILKENKDSYLLNECSVKHKYVIIELCQDILVDSVVIGNFEFFSSIFKDIRISVSDRFPSQNWKELGQFTASNIRDVQTFKIENPLIWARYLKLEILSHYGNEFYCPISIVRVHGKTMMDEFKEDEEGNQHMGAIKEEEPPTPQTIEEDVLLINQTTLNECRVRLPHLQLNEFLKSFNSSNQEFCVPSDAEPQVTTAKTTTAITTQESIYKNIMKRLSLLESNATLSLLYIEEQSKLLSTAFSNLEKRQTTNFNTLISSVNSTLMNQLMVFKESYYELYEQYGNLFKMQENSHRQLLAETNKKVGLLSSELTFQKRVSIFNSIIIICLLVYVILTRDVAIEYPEDELNEKSPSPQSKKLSSPFIPIRYKKSKKR

SEQ ID NO: 15214 - protein, 469 aa, Solanum tuberosum
MEFVSMLCLFTFISFTLLLIHSIFKFLAFASKKLPLPPGTLGLPYIGETLQLYSQNPNVFFASKVKKYGSIFKTYILGCPCVMISSPEAAKQVLVTRANLFKPTFPASKERMLGKQAIFFHQGDYHAKLRKLVLQAFKPDSIRNIIPDIESIAITSLESFEGRLINTYQEMKTYTFNVALISIFGKDEFLYREELKKCYYILEKGYNSMPINLPGTLFNKAMKARKELAKIVAKIISTRREMKIDHSDLLGSFMGDKEGLTDEQIADNVIGVIFAARDTTASVLTWILKYLGENPSVLQAVTEEQENIMRTKEVNDEEKVLNWQDTRQMPMTTRVIQETLRVASILSFTFREAVEDVEFEGYLIPKGWKVLPLFRNIHHSPDNFPEPEKFDPSRFEVSPKPNTFMPFGNGVHSCPGNELAKLEILILVHHLTTKYRWSMVGPQNGIQYGPFALPQNGLPIKLSLKTSST

SEQ ID NO: 15215 - protein, 458 aa, Myxococcus xanthus DK 1622
MSIHPAGASTAAPLPPLSPGAPLIGHLRALRKDPLHFLQAQAREYGDVVRLPMGPADLVLVAHPDGVRHVLQDHARNYSKQSRGFRVLQELLGHGLLTSDGDHWLRQRRLAQPAFHRQRVAGFTRTMVDAAADLAATMEARADTGAAFNVAEDFTRLTLRIASSTLFGADVSSATHDIATVMSRLQVFVYKRLTQPVPLSLRLPLPAHRQFERDVGSLNRVVHGIIAKRRRESGEHHDLLQMMMEAHDDDTGERMSDSQLRDEVLTLLLAGHETTASALAWTIMLLSQHPGVRRDMESELARELGGRNPTHEDLPRLELTHRVVDESLRLYPPAWALSRIATKEDLVGGFRIPKGAHLLIAPWVTHRHPSIWDNPEGFDPDRFLPEREQARPRFAWFPFGGGPRQCIGNQFALMELVLVLATLLQRVRLNLTPGQVIHPTPAITLRPRPGVWVTASRP

SEQ ID NO: 15216 - protein, 300 aa, Zea mays
LDRIAVVTGGNKGIGLEVCRQLAGAGATVVVLTARDETRGAAAAQELRESGLSDVIFHQLDITDAASVSRLAEFLKARFGKLDILVNNAAVGAVEYVQDPADSSTSEEELSGMDMVQRLQCMLKRVRETYDAATEGIKTNYYGIKHVIEALLPLLQASSDGRIVNVSSDFGLLRVTTNQKLRQELNDVEKLTEERLDEVLAAYLRDFDAGEVGARGWPVDFSAYKVAKVAMNAYTRILARSHPGLRVNCAHPGYVSTDMTVHTGPLTPEQGAANVVKVALLPEGGPTGAYFALGEEASFM

SEQ ID NO: 15217 - protein, 291 aa, Haloarcula marismortui ATCC 43049
MSKSLDISTTEAEQTVTEVIDTIVATTPDVRRAVADYRGQSNSVNPTGDDQLAADLRADELFEQRVLGIDGVASYASEERADVKTTDGRLHVAMDPLDGSSNLEPNSGMGTIFGIYSEQPPTVGTNLLAAGFVIYGPITSMVVARDGSVREYILEDGDKRVVDDDVTVPEDPTVFGFGGGVDSWTDEFESYAEAVRHELKLRYGGAMVADINQVLTYGGIFSYPALESRPEGKLRVQFEGHPMAYILESAGGRSSDGDQSLLEIEPDELHERTPLYLGNDDLIDRLEANID

SEQ ID NO: 15218 - protein, 333 aa, Zea mays
MASPPRNVGTRTTSNPEIPEFLVGPAGRPVPAVGLGTASFPFVEENVRTAVLAALELGYRHLDTASLYRSERAVGDAVAEAARRGIVASREEVFVTTKMWCSQCHPDLVLPSLKESLQNLQMDYVDLYLVHWPIAAKPGKPQFPFKREDIMPMDLIGVWRAMEECHRLGLARMIGVSNFTTKKLQELLAIAKIPPSVNQVEMNPIWQQKRLAEFCKDKGIHLTAYSPLAGQSTSKVNPVMQSEVLQEVAKARGKSVAQISLRWIYEQGASVVVKSFGRDRLKENVEIFDWELTNEDRRKISQIPQHKRVTVLGILSPDGVSSVDLAELDIVEM

SEQ ID NO: 15219 - protein, 148 aa, Solanum tuberosum
MASKRILKELKDLQKDPPTSCSAGPVAEDMFHWQATIMGPADSPYSGGVFLVTIHFPPDYPFKPPKVAFRTKVFHPNINSNGSICLDILKEQWSPALTISKVLLSICSLLTDPNPDDPLVPEIAHMYKTDRSKYETTARSWTQKFAMG

SEQ ID NO: 15220 - protein, 553 aa, Oenococcus oeni PSU-1
MKDGTISDFANKVVYQVYPKSFKDSNNDGIGDLQGIIENLPYLAKLGIDYLWLNPIFPSPQRDNGYDISDYRAIDPIFGTMNDFKELVSKAAEHKISIMMDMVFNHTSIAHQWFQKALAGDKKYQAYYILRPKKADGSTPNNWQSKFGGSAWASFGDSDLDYLHLYDISQADLNWRNPEVVSEVNHVLKFWLDKGVKAFRFDVINVIGKDRKLLDDPTGGDGKAMYTDKPIVHDYLQNMYRDVFAKENNIMTVGELSSTSVENAVEYTAPGRHELSMAFTFHHLKVDYQNGNKWTKVPYDFQKLRQVLHQWGKGLSDGNGWPAWFWNNHDQPRAINRFVSNPKYYRLGAEMLAAVVHLNRGTPYIYMGEEIGMINPDFKSIDSYVDVESHNAYKELLKKGTSASEAFQIVKSKSRDNSRIPMQWNSEKYAGFSRHKPWLANGNYKDINVAKDLSDPNGLFSFYQRLILLRKQEKVIAKGDYQPFFPDIPEIIAFKRQFQEDSLLVINHFGEEKITLSLPVESLGGKIILSNYSNTKIARQITLKPYETLAIKY

SEQ ID NO: 15221 - protein, 406 aa, Parvularcula bermudensis HTCC2503
MADGTRTVVVEDSASDASSDRPFTINFGPQHPAAHGVLRLVLELDGEIVERVDPHIGLLHRGTEKLIEYKTYLQAIPYFDRLDYVAPMNQEHAFVLAAEKLLELDVPRRAKIIRTLYCEIGRQLSHLLNITTQAMDVGALTPPLWGFEEREKLMVFYERACGARLHAAYFRVGGVHQDLPQDLLDDIGEWCETFPQVLDDIEGLITDNRIFKQRNVDIGVVSREEAFAWGFSGVMLRGSGVPWDLRKSQPYEIYDELDFDIAIGKNGDCYDRYLVRIEEMKQSLKIMKQCLALIEPGPIMTEDPRIGPPRRGEMKTSMEALINHFKLYTEGPKVPAGEAYAAVEAPKGEFGVYLVSQGTNKPYRCKIRAPGYAHLQAMDWMNRGHMLADVSAIIGTLDIVFGEVDR

SEQ ID NO: 15222 - protein, 486 aa, Bacillus cereus G9241
MGSYYIRSYGNEKTGGESKVKSLLRKKALSTESPKQLDRTLTALDLTFLGIGAVIGTGIFVLTGIVAAKHSGPGIMLSFLIAAFTCACVAFCYAEFASSIPVSGSVYTYAYMTVGEVVAFIVGWCLMLEYLLAVAAVAVGWSGYLQSLLQGFNVHLPAIIASAPGVGKGGLIDLPAVCILLIITGLLSFGIRESARINNIMVLIKLAVIIAFIVAGAKYVKPENWTPFIPFGYDGIITGAATVFFAFLGFDAIATAAEETKKPQRDLPIGIIGSLLICTVLYMIVSFVLTGMVPYTQLDVSDPVAFALHFVGEDTIAGLLAVGAMTGMTTVLLVVMYGQVRVSYAMSRDGLLPKALARVNKRVKIPLLNTWITGVVAALLAGLLDLHVLANLVNIGTLTAFTFVCCAVLILRKTHPDLKRGFRTPFVPVLPVVAILCCLYLMINLSKTTWISFAVWLIVGLCFYFFYSRKHSHLATEKTNDEKKKA

SEQ ID NO: 15223 - protein, 516 aa, Escherichia coli O157:H7 EDL933
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 15224 - protein, 234 aa, Bartonella quintana str. Toulouse
MNVQQLKKRAAAKALEFVQDDMRLGIGTGSTANEFIRLLGERVADGLRVTGVATSQYSEQLCRKFGVPVTTLEQMPELDLDIDGADEIGPEMTLIKGGGGALWREKIVAAASRAMLVIADETKVVKTLGAFALPIEVNPFGMPATRRLIEKVADDLGLSGEIILRMNGENPFKTDGGHFIFDAFWGCILQPRLLSEALLAIPGVVEHGLFWGLASRAIVAMADGQIKVLESSDF

SEQ ID NO: 15225 - protein, 589 aa, Saccharomyces cerevisiae
MTISSAHPETEPKWWKEATIYQIYPASFKDSNNDGWGDMKGIASKLEYIKELGTDAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQLSDPFTMNGPRIHEFHQEMNKFIRNRVKDGREIMTVGEMRHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 15226 - protein, 337 aa, Oryza sativa
MVPKVGINGFGRIGRIVFRNATQAGTVDVVAVNDPFIEVHYAAYMLRYDSTHGQFKGTIEINGTEGLIVNGKKIRFYAERDPAAIPWGKEGADYVVESTGVFTTTDKASAHIKGGAKKVIISAPSADAPMFVMGVNNDSYTKDVNVLSNASCTTNCLAPLAKVINDKYGLVEGLMTTVHSYTATQKTVDGPSGKDWRGGRTAAQNIIPSSTGAAKAVGKVIPSLNGKLTGMSMRVPTANVSVVDLTCRIEKGATYEEIKATIKAASENELKGILGYTEDDIVSTDLNGDDHSSIFDAKAGIALNANFIKLVSWYDNEWGYSHRVVDLISYIAKVDGQ

SEQ ID NO: 15227 - protein, 171 aa, Glycine max
  misc_feature (162)..(162): Xaa can be any naturally occurring amino acid
  unsure (1)..(171): unsure at all Xaa locations
MESIAAQLKRGISRQFSSGSLRRNLSWQFTRQASLDPRRNNQRFSFGRQSSLDPIRRSPCSGNAELTVPENLDSTMQLLFMACRGDVKGVEDLLNEGIDVNSIDLDGRTALHVAACEGHVEVARLLLSRKANLDARDRWGSTAAADAKYYGNTEIYYMLKAXGAKVPKTRK

SEQ ID NO: 15228 - protein, 572 aa, Gloeobacter violaceus PCC 7421
MATGFHSVPEILDELRAGRAVVVVDDENRENEGDLICAAQFASPEMINFMATHARGLICLAMTAERLDQLQLPLMVSENTDRNQTAFTVSIDAGPHLGVSTGISAADRAKTIQAAIDSRTRAGDLTRPGHIFPIRAREGGVLKRAGHTEAAVDLARMAGLYPAGVICEIQNPDGSMSRLPELLQYARTFNLKIVTIAEIIAYRLQNERFIKRETVAMLPTAFGKFEIFAYRDTLDGKEHVALVRRPPAGSGLFDGAPPFAGSEEPVLVRVHSECLTGDTFGSLRCDCRQQLQAALKMIDHHGQGVVVYLRQEGRGIGLINKLKAYALQDMGLDTVEANERLGFAADLRSYGVGAQILNDLGVHRMKLITNNPRKIAGLSGYNLEVVDRVPLIIEETDYNSTYLNTKAQKLGHLLPGVRLLTLGVLWRRATMQPYDPERSNQVELLRELFGQQDLLIQEERRPVASAVFGPDAVVVHIGLPSAGNKSPNAWYTDPTSACRRAILAALEELVQNNPPQVLQFLVSSGADPLNHLSERLQHREEDLASLPDAIKGPLSPETVYIFKADATQPPTS

SEQ ID NO: 15229 - protein, 376 aa, Bdellovibrio bacteriovorus HD100
MEFNTIPEIIDDVRNGKMVILVDDEDRENEGDLILAAEFATPQNINFMVKEARGLVCLCLTAQQVERLQLPLMVRDDLNFAPNKTAFMVSIEASEGISTGISAADRALTCRVAANPHAKPSDIHMPGHIFPIRAQQGGVLKRAGHTEASVDLARLAGLNPAAVICEVMNDDGTMARVGDLREFAKKHDIKIGTIVDLIAYRLANETLVEELHSVPLPASFGENMQARVFRSTVDGLEHLVIQKGEIKKDHPTLVRVHVDNFTRDFMAVVQRGASSVLESIKAISQEESGAFVLLRGNNRTSGLTQELNVLVGLEDIRPTTPLMDERDYGIGAQILREIGANKIRLLTNKPEKKVGLKAFDIEIVEIVAMENLKGPK

SEQ ID NO: 15230 - protein, 352 aa, Mesorhizobium loti MAFF303099
MPDYDVLCIGNAIVDIIAQCDEAFLETNGIIKGAMNLIDTRRAELLYSRMGPAIEASGGSAGNTAAGVGSFGGRAAFFGKVSNDGLGEIYAHDIRAQGVAFDTKPLTGEPPTARSMIFVTPDGERSMNTYLGACVELGPEDVEADKASGAKVTYFEGYLWDPPRAKEAIRQTARLAHAAGREVSMTLSDSFCVDRYRDEFLELMPLGHGRHRLCQQPRDQVALPDIVLRRGAGQDPQGLQNSRRHPLGKRLGHRARRRDRGDPGDGDPGTGRHDGRRRSLRRRFPAWLYARPRPQDLRRPWLTGGRIGDPADRTQATAEPAPRGGTGGVAVGGRFSDELPVCPPGGCAEKCA

SEQ ID NO: 15231 - protein, 274 aa, Listeria innocua
MNLKDTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVEGKFKDTWRAFEKLYKDKRVRAIGVCNFHEHHLKELMEDAEIAPMVNQIELHPQLTQEPLRKFCAENNIVVEAWSPLGNGKLLANPEIKAIADAHGKSVAQVILRWDLQIGVVTIPKSVHQERIIQNADIFDFELSDEEVAKISGLNKDERTGPDPDNFNF

SEQ ID NO: 15232 - protein, 508 aa, Clostridium perfringens ATCC 13124
MTPFYVSPQKDNGYDIADYYKIDPRYGTMEDFEELVKEAKGRNIDIMLDMVFNHTSTEHEWFKRALKGEEKYKNYYIFKEGKKGEPPTNWISKFGGNAWEYVEELGEYYLHLFDVSQADLNWDNKELREEIYKVVNFWIDKGVKGFRLDVINLISKPEKFENDYEGDGRRFYTDGHRIHEYLKELNERTFGKDVEIVTVGEMSSTTIENCIKYSNPKEKELSMVFNFHHLKVDYKDGQKWSLMDFDFIELKKLFNNWQRGMINGGGWNAVFWCNHDQPRVNSRFGDVKKYFNESSKMLATSIHMMSGTPYVYQGEEIGMTNPGFESIEEYRDVESINYFNILKEEEIDEKEIMEILKSKSRDNSRTPVQWNEEKNAGFTTGTPWINIANNYREINVERALENKDSVFYHYKKLIELRKNEDVIAYGDYIQFLEDHPKVYAYERNYNGEKLLVINNFYGEECLVDLSKEIEGLENYNKSILISNYKDSTLDLLSLKLRPYESIVYKLEK

SEQ ID NO: 15233 - protein, 392 aa, Oceanospirillum sp. MED92
MADQSLVFSFFLIFTGAAIVASLALYTRQPLLVAYIVLGAVLGPYGMMMVTDTQLLSEISHIGIIFLLFLLGLDMQPSHLLHMLKKATLVAIFSSLIFFALGYSVGYAFGYTQTENMIIGIAVMFSSTIIGIKLLPTTVLHHRHTGELVVGLLLLQDVIAIMVLLFLYSGSGESSTSDTMAQFSKTIAALPLIIIGAFVFVKYVLLKLIQKFDRFHEYIFLLAIGWCLGLAEIANLAGLSAEIGAFVAGVSIATSPIAQYIATSLKPLRDFFLILFFFSIGASFNLGLVGQIAVPAIILALLVLAVKPAAFRYLLSSISESPKLGWEVGFRLGQISEFSLLIAYIAAGASMIGEEASHVIQATAILTFLLSSYVVIFNFPSPIAVSDKLRRD

SEQ ID NO: 15234 - protein, 376 aa, Vibrio angustum S14
MTDKFIKSKAAIAWGPKQPLSIEEVDVMLPRAGEVLVRIVATGVCHTDAFTLSGDDPEGIFPAILGHEGGGIVEMIGAGVTDLQVGDHVIPLYTAECGKCKYCLSGKTNLCQAVRETQGKGLMPDGTTRFYKDGQPIFHYMGCSTFSEYTVLPEISLAKISKEAPLEEVCLLGCGVTTGMGAVLNTAKVEEGSTVAVFGLGGIGLAAIIGATMAKASRIIAVDINEEKFELARKLGATDCINPMKFDKPIQEVIVELTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 15235 - protein, 476 aa, Arabidopsis thaliana
MDNIAAQLKRGISRQFSTGSMRRTLSRQFTRQNSLDPRRNNMRFSFGRQSSLDPIRRSPESLSCEPHMSVPENLDSTMQLLFMASKGDVNGVEELLNEGIDVNSIDLDGRTALHIASCEGHYDVVKVLLSRRANIDARDRWGSTAAVDAKYYGNVEVYNLLKARGAKAPKTRKTPMTVGNPKEVPEYELNPLELQVRKVDGISKGTYQVAKWNGTRVSVKIFDKDSYSDPERVNAFTNELTLLAKARHPNIVQFVGAVTQNLPMMIVVECNPKGDLSVYLQKKGRLSPSKALRFALDIARGMNYLHECKPDPIIHCELMPKNILLDRGGQLKISGFGLIKLSKIGEDSAKVVNHEAQIDKSNYYIAPEIYKDEVFDKRADVHSFGVILYELTEGVSLFHPKPPEEVAESICIEGKRPTIRTKSKSYPPELKELIEECWHPEISVRPIFSEIIIRLDKIVTNCSKQGWWKDTFKFPW

SEQ ID NO: 15236 - protein, 472 aa, Mycobacterium sp. MCS
MNRRGKIVCTLGPATGSDDAVRKLVEAGMDVARLNFSHGDYPDHEANYKRVRAASDHTGRAVGILADLQGPKIRLGRFADGPTVWAEGETVRITVDDVEGTHDRVSTTYKRLAEDATPGDRVLVDDGNVALVVNAIEGNDVVCEVTEGGRVSNNKGMSLPGMNVSAPALSEKDIEDLEFAVRLGVDLVALSFVRSPADVELVHEVMDRVGRRVPVIAKLEKPEAIDNLEAIVLAFDAIMVARGDLGVELPLEEVPLVQKRAIQMARENAKPVIVATQMLESMIENSRPTRAEASDVANAVLDGADAVMLSGETSVGKYPLEAVRTMARIIIAVEENSVVVPPLTHVPRTKRGVISYAARDIGERLDAKALVAFTQSGDTVRRLARLHTPLPVLAFTALPEVRSQLALTWGTETFIVPQIGTTDGMIRQVDKSLLELGRYKRGDLVVIVAGAPPGTVGSTNLIHVHRIGEDDV

SEQ ID NO: 15237 - protein, 404 aa, Streptococcus pneumoniae TIGR4
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDTDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 15238 - protein, 515 aa, Aspergillus parasiticus
MEDGTQVSTLERVVKEVQAPALQTPTDEQFWSPEDPSKPNLQFLKQHFYREGRLTEDQALWIIQAGTQLLKAEPNLLEMDAPITVCGDVHGQYYDLMKLFEVGGDPSETRYLFLGDYVDRGYFSIECVLYLWSLKIWYPNTLWLLRGNHECRHLTDYFTFKLECKHKYSERIYEACIESFCSLPLAAVMNKQFLCIHGGLSPELHTLEDIKSIDRFREPPTHGLMCDLLWADPLEEFGQEKTGDYFVHNSVRGCSYFFSYPAACAFLEKNNLLSIIRAHEAQDAGYRMYRKTRTTGFPSVMTIFSAPNYLDVYNNKAAVLKYENNVMNIRQFNCTPHPYWLPNFMDVFTWSLPFVGEKITDMLIAILNTCSKEELEDDTPTTVSPTGPPSPPVPMDVESSEFKRRAIKNKILAIGRLSRVFQVLREESERVTELKTATGGRLPAGTLMLGAEGIKQAITNFEDARKVDLQNERLPPSSEEVYKRSEEERQAALERAQREADNDAGLATVARRISM

SEQ ID NO: 15239 - protein, 480 aa, Methylobacillus flagellatus KT
MALRKTKIVATLGPASSEEAVIERLVDAGMDVVRLNFSHGSAQDHIARAELVRDISRRSGRPVGVLCDLQGPKIRIGKFENDRILLKAGDRFILDAACKLGNQERVGLDYKTLPSEVEPGAVLLLDDGRIVLNVEAVNGGEVHCTVAAGGVLSNNKGINRKGGGLSAPALTLKDQEDIRTAVALEADYIAVSFPRSGADIELARHLVREAGGHAAIVAKIERAEAIDALEEIIDAADVIMVARGDLGVEVGDAAVPGLQKRMIRTARMRNKLVITATQMLESMISSPIPTRAEVSDVANAVLDGTDAVMLSGETAVGHYPVESIQAMHRVCLEAEKEYDSHHLQAPINDEFEFIDEAIAMASVYAAEHLNVKAIAALTKSGSSVTWLSRSNTNVPIYALTTERDTRRKLTLYRGVYPYHVEFASQELSKILYDAEETLLRLGAVQRGDLMMLTFGEPIGKAGGTNTLQIVRVGEHRRERH

SEQ ID NO: 15240 - protein, 153 aa, Triticum aestivum
  misc_feature (2)..(2): Xaa can be any naturally occurring amino acid
  misc_feature (17)..(17): Xaa can be any naturally occurring amino acid
  misc_feature (28)..(28): Xaa can be any naturally occurring amino acid
  misc_feature (30)..(30): Xaa can be any naturally occurring amino acid
  misc_feature (69)..(69): Xaa can be any naturally occurring amino acid
  misc_feature (71)..(71): Xaa can be any naturally occurring amino acid
  misc_feature (79)..(79): Xaa can be any naturally occurring amino acid
  misc_feature (87)..(87): Xaa can be any naturally occurring amino acid
  misc_feature (90)..(90): Xaa can be any naturally occurring amino acid
  misc_feature (92)..(92): Xaa can be any naturally occurring amino acid
  misc_feature (101)..(101): Xaa can be any naturally occurring amino acid
  misc_feature (116)..(116): Xaa can be any naturally occurring amino acid
  misc_feature (120)..(120): Xaa can be any naturally occurring amino acid
  misc_feature (124)..(125): Xaa can be any naturally occurring amino acid
  misc_feature (130)..(130): Xaa can be any naturally occurring amino acid
  misc_feature (134)..(134): Xaa can be any naturally occurring amino acid
  misc_feature (140)..(140): Xaa can be any naturally occurring amino acid
  misc_feature (143)..(143): Xaa can be any naturally occurring amino acid
  misc_feature (148)..(149): Xaa can be any naturally occurring amino acid
  unsure (1)..(153): unsure at all Xaa locations
MXPTVMASSVNSVAPFXGLKSTAGLPVXRXSNGASLGSVSNGGRIRCMQVWPIEGIKKFETLSYLPPLXTXALLKQVDXLIRSKWVXCLXFXKVGFIFREXHNASPGYYDGRYWTXWKLXMFGXXRRQRXVIKXGGGGQXKGXPDAYXXIIGF

SEQ ID NO: 15241 - protein, 274 aa, Rhodopseudomonas palustris CGA009
MSVQSTIRRKTAPDIRARKGGDPIVMLTSYHAHTASLVDRYCDAILVGDSLGNVMHGFETTVPVTLEMMILQGHAVMRGSQHALVVVDMPFGSYEASKEQAFHSAARILKETHCGAVKLEGGVRMAETIAFLTERGIPVMGHIGLTPQSINTLGSFRAQGREEGSWEPIEADARAVADAGAFSVVVEAVAEPLGRKITEMISIPTIGIGASAACDGQVLVLEDMLGLSPKPPKFVKRYGDLGPGIEAAIKGYAEEVRSRAFPGPEHVYGMKSKA

SEQ ID NO: 15242 - protein, 461 aa, Triticum aestivum
MAFSSLSTPSSSSPSSSFTLPTKPSPGAGSLSFSRASTGRFRMAAVRAQAEAVDTSISPRVSALRPSKTMAITDMASALRQAGVPVIGLAAGEPDFDTPAVIAEAGINAIRDGSTRYTPNAGTMELRKAICNKLQEENGLTYSPDQVLVSNGAKQCITQAVLAVCSPGDEVLIPAPFWVSYPEMARLAGATPVILPTSISDNFLLKPESLASVITEKSRLLILCSPSNPTGSVYPKELLEEIAAIVKKYPRLLVLSDEIYEHIIYHPAKHTSFAALPGMYDRTLTVNGFSKAFAMTGWRLGYLAAPKHFVSACGKIQSQYTSGASSISQKAGLAALNLGYAGGEAVATMVKAFQERRDYLVSSFRELPGVKISEPQGAFYLFLDFSSYYGSEVEGFGTIKDSETLCMFLLEKAQVALVPGDAFGDDKGVRISYAAALSTLQSAMEKIKDAMALLKAPAAVQ

SEQ ID NO: 15243 - protein, 416 aa, Methanosarcina mazei Go1
MFFLELSFKGGCREVGRSGLLVNGEILLDYGIKAGEIPEYPKNGMEPKAVLVSHGHLDHCGAVPNLMYLNPEVFMTPPTADFTALLGRDTLKLAETTLSGVSPFDSDDLQKLNHRTQRKDYGETFKTHGYNVCFYNAGHIPGASGIHIESESGESLFYTGDLSLQETRLVPGAEEFPEADTLVLESTYFGEDHVPRKETEERFIESIHETLDIGGTALIPAFAIGRTQEILMLLDAYGIRAYVDGMGRDVYKILKKYPEYLRNPDLLDRAFERATQVKNHLRESVLGEPAVIVTTAGMLNGGPVLYYLSRLYNDPGSKILLTGYQVEGTNGRLALEHRMIETRGDILSLKPAIEQYDFSAHCGDRELKQLVKDFCDKGTERVFVMHGEKTEAFAEWISEEIGVEAYAPANGGSFIF

SEQ ID NO: 15244 - protein, 430 aa, Robiginitalea biformata HTCC2501
MAQYKKNSLSLTGAVSLGTGVMIGAGIFALLGQVAELSGQWFPIAFLVGAIISGFSAYSYIKMSNAYPSAGGIANYLKKIYGKSALTASGALLMAFSMVINESLVARTFGSYTLQLFDVGDDSIWVPILGVLLLVVAFLINISGNNVIGKSSLVMAILKIGGISIFAIGGLWAAGYSFGEVLPSGDLGEYPITSYLGALALSILAYKGFTTITNSGDEIVNPNKNVGRAIIISLGICTLVYLLVAFAVSSNLSIEEIIKAKDYSLAEASKPAFGKYGLWFTVGIAIVATISGVVASVFAVSRMTAMLTDMELIPHNHFGMSGGIQRHMLVYTVVLAITLTVLFDLTRIASLGAILYLIMDIGIHWGILKNLKKEIKANTYIIATAIFLDFIVLGAFLYIKALSDILVVVVAAVLMVLIFTGEKWFLKRKD

SEQ ID NO: 15245 - protein, 77 aa, Mesorhizobium loti MAFF303099
MRGDETVVIQATAIRELVDTTGAGDLYAAGFLHGYTQGRDLKTCGDLGSLAAGLVIQQIGPRPRQNLRREAEQVGLL

SEQ ID NO: 15246 - protein, 377 aa, Glycine max
MKCFFFKEKCKSAPELHKKKTPAVNRAANSTGSVSSPKSVKDLYREKEHSFRVFTLQELRDATNGFNRMLKLGEGGFGSVYKGSITQPDGQGGDPIPVAIKRLNTRGFQGHKEWLAEVQFLGIVNHPNLVKLLGYCSVDAERGIQRLLVYEFMPNRSLEDHLFNKNLPTLPWKTRLEIMLGAAQGLAYLHEGLEIQVIYRDFKSSNVLLDADFHPKLSDFGLAREGPQGDQTHVSTAVVGTQGYAAPEYIETGHLKVQSDMWSFGVVLYEILTGRRSLERNRPTAEQKLLDWVKQYPADTSRFVIIMDARLRNQYSLPAARKIAKLADSCLKKNPEDRPSMSQIVESLKQALQYSDTTSQDIAESSSSSRSKLVRKK

SEQ ID NO: 15247 - protein, 111 aa, Arabidopsis thaliana
  misc_feature (94)..(94): Xaa can be any naturally occurring amino acid
  unsure (1)..(111): unsure at all Xaa locations
SCATIGACTAQATMGAPFGGRKSYGGFPATRKANNDITSITSNGGRVNCMQVWPPIGKKKFETLSYLPDLTDSELAKEGDYLIRNKWIPCVEFXLEHGFGTLSTGTHSDTM

SEQ ID NO: 15248 - protein, 422 aa, Chlamydia muridarum Nigg
MPHLFSKACQYFPGGVNSPVRACRSVDITPPVVTRASGDFFTDSQGKTYIDFCGSWGSLIHGHSHPYICEAIQQGLQRGCSYGLTSEQEISFAEEIFSYLEISNDHKIRFMSTGSEATMTAVRLARGVTERPIIIKFSGCYHGHSDVFLQEIHFQQTILDTVDLTQPLTLSLPFNNLSLFLDVMNQIGHRVAGVIFEPICANMGVVLPLPGFIEGIIQTCRKTGSLSIMDEVVTGFRVSKGGAAALHPLKPDILVFGKILGGGLPASAVCAPAAIMDYLAPVGKVFQAGTLSGNPLAMSAGKASIALCREKNFYTQLSAIEDDFLSPIEQMIQQSGIPVTLVRYGNLFSFFFSENRPNNLKEVQLCNTDIFRTFYQQAFLKGIYLSPSPFEASFLSTAHSMENLNYAQQVLIESLEQACSLV

SEQ ID NO: 15249 - protein, 856 aa, Gloeobacter violaceus PCC 7421
MAKDKSDKKTAAAAAAPVQIEDDRTGLSVETLKRAFADNLFYIQGKNADIATLNDYYMALAYTVRDRLLQRWLSTIKAQLKPEVKVVYYLSAEFLMGPHLGNNLVSLGIYDQVRQAIQESGLNLEELIAQEEEPGLGNGGLGRLAACYLDSLAALEIPAVGYGLRYEFGIFDQEIRDGWQVEITDKWLRYGNPWEIARPEATVEVKLGGHTEAFVDGAGRYRVRWIPERTIVGVPYDTPVLGFKNNAANTLRLWKAEAPESFDFQAFNLGDYYGAVNAKMYSENISKVLYPNDEPLQGRELRLEQQFFFVSCSLQDIIRRHLYVGGKLEDLHNSAAIQLNDTHPSIGIAELMRLLVDEHNIDWDTAWQITQNTFAYTNHTLLPEALERWPLSLFGSLLPRHLEIIFEINRRFLQEVSAKFPGDTGRLARLSLIQEGPEKFVRMAHLASAGSHAINGVAALHSELLKRDVLRDFYELSPEKFSNKTNGVTPRRWIMLSNPELAFLISESIGDGWIKNLGELRELERFANDKEFQSRWRQIKLNNKTNLAEYIRKRTGLVVDPHSLFDIQVKRIHEYKRQHLNVLYIITLYNRLKQNPELEITPRTFIFGGKAAPGYFMAKLIIKLINSVADVVNNDPDVGGRLKVVFLPDYNVTFGQRVYPAAELSEQISTAGKEASGTGNMKFSMNGALTIGTLDGANVEIREEAGEENFFLFGLTTEEVYALKARGYNPRDYYNGNPALRQVIDQLASGVLSSGETHLFAPLVDHLLNRDEYLLLADYQSYVECQDRVGEAYRDQEHWTRMSILNSARMGKFSSDRAIREYCEDIWGAVAVDVVLEEYVQATAGLAVKPQPVAAT

SEQ ID NO: 15250 - protein, 270 aa, Helicobacter pylori J99
MSMQTAPIKKITLSHLQAKKNQEKIIAITAYDALFAQIFDPLVDVILVGDSLNMSFFNQNDTLSASVKMMLYHTKAVCAGAKTPFIITDMPFGSYKDEKTALKNAIRVYKETQASAIKLEGGKEKAKLVKTLTDEGVIVVGHIGLMPQFVRLDGGYKIKGKNEEQQKKLLEDALSLEEAGVGLLVLEGITTPIAQTITQKIKIPTIGIGSGKDCDGQILVWSDMLGFFDSFKPKFVREYLKGKELIQNAIQQYADDVKKGNFPNELESYH

SEQ ID NO: 15251 - protein, 247 aa, Gibberella zeae PH-1
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLKPAFVDIINATKQ

SEQ ID NO: 15252 - protein, 175 aa, Oryza sativa (japonica cultivar-group)
MAPTVMASSATSVAPFQGLKSTAGLPVSRRSTNSGFGNVSNGGRIKFMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFIRIIGFDNVRQVQLISFIAYKPPGCEESGGN

SEQ ID NO: 15253 - protein, 264 aa, Triticum aestivum
SYEGVMTTKVLPDIKTAEAEYADLQQRQQEYFKKASIICSESDMEALSHVAGSTPEQLSAKINRLKQRFDQESRRYAESIDDLRALHDKKERKILRKQQLYAGFRVKLNSCQKALDLRWKKFQRNAGLLKRQLTWLFNEHLGKKGISGFINVDYKSKVLSVELTMPQDASRDTVRDTRGLSGGERSFSTLCFTLALHGMTEAPFRAMDEFDVFMDAVSRKISLDTLVDFAVAQGSQWVFITPHDISMVKPGDRVKKQQMAAPRG

SEQ ID NO: 15254 - protein, 278 aa, Desulfitobacterium hafniense Y51
MENAANYTRRILKGGAKAHKSLGQNFLMDDRVIEAIAAASIKDPEIPVVEIGPGLGVLTRVLAQKAQKVWAVELDRGKVNLLQRELQGLPVDILNMDALKLDLKDIWGTGKGVLVGNLPYYITSPLLMHFLEQKDSLASMVVMVQKEVADRLVAKPGGKDYGILSIAAQVSAQGEKLFEVPPQAFWPAPKVTSAVVRFELRSYPGFRVKEKDFFRVVKAAFSQRRKTLGNSLAGGLGLPKQQIGEILAAAGVDEQRRAETLSIDEFQAVTEAVMKNLD

SEQ ID NO: 15255 - protein, 239 aa, Chlamydia muridarum Nigg
MSKQVAHSFSSEDFSFIKQKLAREAVALVEPGMRVGLGSGSTAREFILALGERVRNERLAITAVASSRISHLLAQALGIPFLDPALSQELDLVVDGADEVDANLRMIKGGGGALFREKILLQSGKRNIILVDERKLVSVLGTFPLPIEISPFGCSSVEKVLNQQGYIGDWRKTSHGERFITDNGNYIYDVSSPDSYPHPEEDLIRLLQIRGIIDVGFVIAKAEVWVGYADGTVVRKEIT

SEQ ID NO: 15256 - protein, 488 aa, Methylococcus capsulatus str. Bath
MTRGIRRTKIIATLGPASESPEMLERILKAGADVVRLNFSHGTAEEHRIRAERVREISRRMQRYVAILADLQGPKIRIARFKGDRQVVLEEGQPFDLDTAFPPDQGDETQVGCAYEALPTDVEAGDTLLLNDGLIELKVKSVEGTRVRCVVTVGGVLSNHKGINKLGGGLSAPALTEKDKADLKTAVEIGADYLAISFPRSKEDMLEARELLHRAGSHMGLVAKVERAEAIKDGVIEGIIDASDAIMVARGDLGVEIGDARLPHEQKRLIRLARSRNKVVITATQMMESMIENPLPTRAEVSDVANAVIDGTDAVMLSAETATGKFPDRTVAAMVRVCKEAEKYPRTRQSSHRMDEKFHRIDEAIAMSAMYIANHLPVRAIGALTESGSTPLWMSRISSGIPIFALTPHEAVCRRVTLFRGVYPIFFNERAISDHHVLNRAIAEEFLKRNLVKMDDLVIMTKGDLTGRTGGTNALKISRISDVIAAAP

SEQ ID NO: 15257 - protein, 315 aa, Oceanospirillum sp. MED92
MRAVILDLNGLEAYDLSPLRSQLDELVTYDLTPKECVGDRIQGFDIVITNKTPLSADLLSQADRLKYISVLATGTNVVDKQAASELSIPVSNCVAYGVDSVVQHVWSMILALHTNLVNYSNDVRQGEWQKAQQFCFFNHPISELKGKTLGIVGYGNLGQGVAKIAEAFGMQVLIANRPDDAELKAGRVLFDTVVENSDVISLHCPLTEGTRNLFIEETFRKMKGSAMLINAARGGIVNEEDLASALRNHEIAAAATDVLSVEPPANGNPLLGADIPNLLVTPHIAWGSEQARQRIIDQTAENIAAFLQGKIIRQV

SEQ ID NO: 15258 - protein, 492 aa, Agrobacterium tumefaciens str. C58
MKGIASAALKNLHRRDLIEDRAFVNGAWVERDQMFAIVDPAGGDHLADVASCTLNDVDFAIDAASKAFAGWRDMLPVDRGDILRNWSARMRENAHDLATIISAEQGKPLAESRGEIAYAANFLDWFASEGERSYGETIPTHLKGSNLSVRMQPIGVTVAITPWNFPSAMIARKAGAALAAGCTMIVKPAPETPLSALALARLAEESGVPPGVLQVLPGEAAPLARRLLENTEVRAFSFTGSTEVGRILLTQSAATVKKASLELGGHAPFIVFADADLTEAVKGCLGAKFATSGQDCLAANRIYVQRSLYPRFVERFAEATSRLTVGHGLETGVDIGPMTRPSVAEKCRQQVAQALSAGARLVCGGQDSPLGGNFVTPTVLADVTDDMLIAREETFGPVAAILPFDDEAEVIRRANATEMGLAAYLYTNDLGRAMRLTDQLEYGMVAVNTPKFTGAPIPFGGWKQSGLGREGSRHGLMEYLEPKYVCFGNLAA

SEQ ID NO: 15259 - protein, 92 aa, Zea mays
MAAAAAKASSWMVAMSVGAVEALKDQGGLCRWNYALRSVHRTAKANVRSSSFAAQRDKELAPAAEKEKGRQDKAAAEEGLRTVMYLSCWGPN

SEQ ID NO: 15260 - protein, 638 aa, Aspergillus oryzae
MPASIALIEDEDIGDSSTLERNTHGIRIPSSNPPDLPPDLDVFSRGNSAGPTGYLIDAYSVNRLRPASFSARFRQAGGVNSIDSFARSWQRAAGFPEIIPRRPSFVTVEPDEDCIVNDTAESRDRRSLGGDTDITRPLLAADTEEEGCDLDGRSPPKGIASIFGSSLDRSTGTSYGTISSRVSEATRRHAVQLHREQQARLDAPAIEDTESLLVKQVHHEDGTRESIVVGQSTVPQTIFNSVNVLIGIGLLSLPLAMKQAGWLLGLTFLSFAAVVTSYTARILARCLDVDRSLVTYADLAYISFGNHARLVTSLLFCLELIGACVALVVLFADSLQALIPGLSSLQWKLICGFMLIPLNFVPLRLLSVTSILGIISCTSIVMLICLDGLLKPNGLGSLHEPATTSLFPNNWRTVPLSFGLIMSPWGGHGVFPNIYRDMRHPSKYGKSLIYLTYYAQQYSLDCAMAIVGWVMFGEEVRDEITANILLTNEYPRGISICIIIFIAIIPITKVPLNCRPLVATVEVLCGLGPHVGLAPENPKSTQATIRQSLQAIIRLLVVAVIVLMAILCPSFDRIMALMGSALCFTICIILPLAFYLKIFGQEISRKEWFLDWLLLLISTVLAIVGTAWAFLPENMISV

SEQ ID NO: 15261 - protein, 216 aa, Zea mays
MSAYCGKYKDELIKNAAYIGTPGKGILAADESTGTIGKRLSSINVEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 15262 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGAGGLGRLAACFLDSMATVGQSATGYGLNYQYGLFRQSFVDGKQVEAPDDWHRSNYPWFRHNEALDVQVGIGGAVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLRILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAAR

SEQ ID NO: 15263 - protein, 223 aa, Striga asiatica
MDVAKMETDGSSDVVAQELCVLAVDDSLVDRKVIERLLKISRCKAISVESGTRALQYLGLDEEKNSSGFDDLKVNLIMTDYSMPGMTGFELLQKIKGSAKLKGIPVVILSSENIMTRIDRCLEEGAEEYLVKPVKLSDVERVRDCILRGEGKTGNSLNPKRKIGVEPPPPALDCETDPVGPTSSEPISHESPTSPCPGPELQPELHDQPLAKRQSLVAAADRL

SEQ ID NO: 15264 - protein, 446 aa, Staphylococcus aureus subsp. aureus MRSA252
MPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILESGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 15265 - protein, 216 aa, Triticum aestivum
ALELIGPAYRTMDSFVGVREKTCIIFVYGLLLMRQHNPQDARVRLASGLRIAHQQLGNIQLVSQYLTILGTLALQLHDTGQAREILKSSLTLAKTLYDIPTQIWILSVFTELYRELEEKENEMENSEYGSKKEIDLQRRLAEARSRAYHQELVEKVRIEVEPLHDLFQKHNDMSGLPANDDLDIPESVGLSTPQPSSVRRLVDSSSVRRSTRRRVS

SEQ ID NO: 15266 - protein, 363 aa, Pseudomonas aeruginosa UCBPP-PA14
MNSSPQANAAMRAAVWHGRHDIRVEDVPLPAEPPPGWVQIRVHWCGICGSDLHEYLAGPVFIPVEAPHPLTGLKDQCILGHEFSGEIVRLGNGVTGFALGQAVAADACQHCGTCYYCRHGLYNICENLAFTGLMNNGAFAEYVNVPANLLYALPAGFPSEAGALIEPLAVGMHAVKKAGSLLGQNVVVVGAGTIGLCTIMCARAAGAAQVIALEMSSARKAKALEVGASQVLDPSRCDALGEIRALTGGLGADVSFECIGNKHTAKLAIDAIRKAGKCVLVGIFEEPSEFNFFELVSTEKQLLGALAYNGEFADVIAFIADGRLDIAPLVTGRIGLEEIVERGFEELVNNKEHNVKIIVSPGG

SEQ ID NO: 15267 - protein, 452 aa, Silicibacter sp. TM1040
MTLRPPKPPVRPDRVSLWRYLKLFRADILSAQPQRLYRAWMAEFRTPFFRSFLVNQPALLDVILKERPDDFPKSNRVGEGLRPLLGNSVFLTNGETWKRQRRIIDPAFEGGRLKESFPAMRAAAEAGVARLRPHADGSELEIEAEASHIAADVIFRTLFSIPIEHEVAAEVFSRFRAYQQAQPILNLAAFVPVPRWMPRFYPKGTRQNARHIRRLIADLTKARMAEIAAGTAPDDLATKIMTTLDPETGKGFGAEEMVDQVAIFFLAGHETSASALGWALYLLALYPEWQEKLAAEVAEHGAEEFADLSKLRLTRDVFRETLRLYPPVPMMVREAVQTERFRDREVLRGSQMVLSPWHLHRHERLWERPDEFDPGRWQSENGKACARNAYMPFSAGSRVCTGAGFAMVEGVLILAQILRHYRITPVEGRSPEPVAHLTVRSRTGIWLRFSHR

SEQ ID NO: 15268 - protein, 350 aa, Clostridium acetobutylicum ATCC 824
MLCALIMAGGKGERFWPLSTDEKPKQFLQLLSDKTMIQMTVERLEDLIDIERIFVVTGERYVDLLKEQLPNLPEKNIIVEPVGKNTAPCIALSAFVINKHYKDANIVVLPSDQLIVDDSKLLDTIAAAEKFIDQNKASIVTLGMEPTRAETGYGYIKSGNLEKEISGFQIKKVESFVEKPDKKSAESYVEAGNFLWNGGMFIWKCSTILKLTEKYLNKTYNILNEIAEANDTNFNETLKKKYVDVEAISVDYGIMEKADNIYVIPCSFGWDDIGTWHAVERYRDKDEDNNVCVGDIKSIDSKNNILVGKKKPIVVVGLSEVFVVESDDIIFVGKKEDIERIKEIKKKVKE

SEQ ID NO: 15269 - protein, 93 aa, Medicago truncatula
MGFRIAKLIRMPSFSKTQESTKGLEVPKGYLAVYVGDRMRRFVIPVSYLNQPSFQELLNQAEEEFGYDHPMGGLTIPCSEDEFQNLTSRLSEL

SEQ ID NO: 15270 - protein, 99 aa, Triticum aestivum
  misc_feature (77)..(77): Xaa can be any naturally occurring amino acid
  unsure (1)..(99): unsure at all Xaa locations
FSRTFKRRRDCIRSYGDWPDVHAPAACGRRRLACRPLGLYVIRGEYVVLIGVLDREKVELPRHMTCVSEAEISSAEXAEKEARDLKGTMRKRMEFLDFD

SEQ ID NO: 15271 - protein, 91 aa, Medicago truncatula
MGFRFSGIIRRASFSANRAVSKAVDMPKGYIAVYVGEKRFVIPISYLNQPLFQDLLSQAEEEFGYDHPMGGLTIPCTEDVFQHITSRSNGL

SEQ ID NO: 15272 - protein, 314 aa, Arabidopsis thaliana
MADPRFMLLLSLSNLGLKSFSDFDCSFFFFLFVSRVAVVTGSNKGIGFEICRQLANNGITVVLTARDENKGLAAVQKLKTENGFSDQAISFHPLDVSNPDTIASLAAFVNNAGVGGANVNVDVLKAQIAEAGAPTDISKIMSDTYEIVEECVKTNYYGVKRMCEAMIPLLQSSDSPRIVSIASTMGKLENVSNEWAKGVLSDAENLTEEKIDEVINEYLKDYKEGALQVKGWPTVMSGYILSKAAVIALTRVLAKRHKSFIINSVCPGFVNTEINFNTGILSVEEGAASPVKLALVPNGDPSGLFFDRANVSNF

SEQ ID NO: 15273 - protein, 430 aa, Oenococcus oeni PSU-1
MTTLNSEKVFRDPILGFIHVDDSIILDLINSHEMQRLRRIKHLGVANSVFHGGEQSRFQHSLGVYEISRRMIQALDDNEKFANERHWDHENDLLVQAAALLHDVGHGAYSHTFEHLFDTVHEQFTQKIIVDPSTEVNAILKTVSNDFPERVAAVIGKSYPDKRVVQLISSQLDADRMDYLLRDAYYTGAEYGRYDIERILRLMRPIKDGFAFDIAGVHSIEDYVISRYQMYLQVYFHPVSRGMEVVLENLLIRAQDIFDKDPDNPIFFPIIRPIFALKNKIDIQDYISLDDSVFNTAFNIWQKVDDKILADLSKRFLDRKPLKSIVLNEKTKDLIPSLRKKIKDRGFDPKYYTGENDATDLPYESYSPKTGEEGIKFVYPDGQQVELSKLSPLVEAINGKESIDRRFFFPREMLSNPEINQLYLKYKKTY

SEQ ID NO: 15274 - protein, 186 aa, Arabidopsis thaliana
MAGGGTEAFPDLGEHCQDPDCKLLDFLPFTCDGCKLVFCLEHRSYKSHNCPKSDHGSRTVSICETCSIAIETTGFDERGIKSLLEKHERSGDCDPNKKKKPTCPVKRCKEILTFANNLTCKDCGVKFCLKHRFPTDHVCNKKTINTAGTRSRWNERFMEALSLRNQKGCGRGSSVSSKSPASVRSF

SEQ ID NO: 15275 - protein, 433 aa, Schizosaccharomyces pombe
MTSAFYGGDEVSAIVIDPGSKWTRIGFSGEDIPKCVLPSYCGEFSDGRRLFGEEYIYKSNPGMEIKNAIRNGWVENWDVTVDLWRYGLEQQLKTNPLEHPILITEPFDNPPENRVKTLETMFESLRCPATYLAKQETCAAFASGKGTACLVDIGAERSSVSAIYDGFVLQKGYQVQHFSGNAINDILAQTLRDKNFEVMPKYLVKSKNPVEIGQPANCELRPRDTTDSYHQFQVQRVYDEWKEECALISDVPFSSETTIAESEFEFPDGSRMMFGAERYQIPEHLFVPGSDEEMNEEPSKPIEQTENNEVSQQDSSVTNTSSRILGIPQLFQNCISECDVDIRASLLNNVIVCGGTSLMQGFSLRLQNELSKLYPGSRLKIHASGHVVERSYASWLGGSILSSLGTFHQLWISRQEYEEHGSDRLALIEKRCK

SEQ ID NO: 15276 - protein, 143 aa, Glycine max
  misc_feature (85)..(85): Xaa can be any naturally occurring amino acid
  misc_feature (93)..(93): Xaa can be any naturally occurring amino acid
  misc_feature (122)..(122): Xaa can be any naturally occurring amino acid
  unsure (1)..(143): unsure at all Xaa locations
MASSMISSPAVTTVNRAGAGMVAPFTGLKSMAGFPTRKTNNDITSIASNSGRVQCMHVWPPVDKKKFETLSYLPYLDNTQLAKEXEYLLKKEXIPYLEFECKHDFIYHKHNRSPGYYNKHYXTIVKLAIYNYTNTSQILRDLQ

SEQ ID NO: 15277 - protein, 341 aa, Spinacia oleracea
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSSNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIGSMVADVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 15278 - protein, 509 aa, Acidobacteria bacterium Ellin345
MTFSYNAFTEPAGEHTATHRRAKIVCTIGPACNTEAAMQELMRAGMDVARLNFSHGTHDEHLVVIQRLRKVAAEEQRSICILQDLQGPKIRTGLLKDHKPVMLETGNTVTITPRDIVGDASLLATTFQTLALDVQPGSRILLSDGKIELSVSRIEGADVECHIVNGGELKEHQGINIPGAILSIPALTNKDLEDLAFGLKNGVDAVAISFVRTANDLKQVRNAISEHQGNVFVIAKLEKPQAIEHLEEIFNETDGVMVARGDLGVEVPPEKVPVLQKHIIKRSQSRRIPVITATQMLESMIDNPRPTRAEASDVANAIFDGTDAVMLSGETASGKYPREAVAMMARIITEAESHCLAEGRRRRHEDHKNTISEAVCDAVSHAAEDLDMLAIAIYTESGNTARILSKHRPKPPIYAFSHLDTVINRLNLFWGVHPVQCEPLRSSKEMILYAEQLLLGAHQVAAGDIIGVVAGTRSTSGSTNFMRLHVIGSESEEERPPAENAPPMKKEIR

SEQ ID NO: 15279 - protein, 369 aa, Spinacia oleracea
MTTAVTAAVSFPSTKTTSLSARSSSVISPDKISYKKVPLYYRNVSATGKMGPIRAQIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYFYMCGLKGMEKGIDDIMVSLAAAEGIDWIEYKRQLKKAEQWNVEVY

SEQ ID NO: 15280 - protein, 163 aa, Astragalus membranaceus var. mongholicus
HDLIVPALRKSLQTLQLDYLDLYLIHWPLTSQPGKFSFPIPVEDLLPFDVKGVWESMEESLKLGLTKAIGVSNFSVKKLQSLLDVATILPAVNQVEMNLAWQQKKLREFCNANGIVLTAFSPLRKGASRGPNEVMENDLLKEIADAHGKSIAQISLRWLYEQG

SEQ ID NO: 15281 - protein, 251 aa, Chlorella pyrenoidosa
NSIFFVGGNWKCNGTVKSNEELVKVLNAAEVPGTDVVEVVVAPAAVHIPQVLSSLRKDFSVAAQNCWVKAGGAFTGELSAEMLADLGLNWVVLGHSERRHIIGETDEFIADKVAYALSKGLGVIYCIGEKLEEREAGNTLDVNARQMKALADKIQDWSKVVVAYEPVWAIGTGKVATPEQAQEVHDAVRKWLADNVSADAAANTRIIYGGSVTAKNCGDLATQPDIDGFLVGGASLKPEFVDIIKSAALSK

SEQ ID NO: 15282 - protein, 91 aa, Medicago truncatula
MGFRIAKLIRKPSFSSTQASSKGFEVPKGYLAVYVGDKMRRFVIPVSYLNQPSFQELLNQSEEEFGYDHPMGGLTIPCSEDEFQNLTSRMN

SEQ ID NO: 15283 - protein, 92 aa, Medicago truncatula
MGFRVPSIIRKSSFSASRVISKVVDVPKGYLAVYVGKQKRFVIPISYLNQPSFQDLLSQAEEEFGYDHSMGGLTIPCTEDVFQHITSRLNGI

SEQ ID NO: 15284 - protein, 286 aa, Chlorella pyrenoidosa
MTFGQALVHQRVQLPTVRRSSCHRASRCAVVMRGSGRFFIGGNWKCNGTLQSVTQLVDELNAGSVPDSVEIVVAPTFVHLDRVQRSLKSPFQIAAQDCWVSKGGAYTGEVSAEMLHDMGIPWVILGHSERRSLCREDDELVGMKCEYALSQGLKVIACIGETLEQRESGHMWDVLDAQLAAIARHTSLANWANMVIAYEPVWAIGTGVVATPEQAQEVHAYVRKWIAEHVSAEVADKLRILYGGSVNDANCATLANLEDVDGFLVGGASLKGPSFINICNAQNKHS

SEQ ID NO: 15285 - protein, 93 aa, Medicago truncatula
MGFRIAKLIRMPSFSKTQETAKGLEVPKGYLAVYVGDRMRRFVIPVSYLSQPSFQELLNQSEEEFGYDHPMGGLTIPCGEDAFLQLTSRLSDL

SEQ ID NO: 15286 - protein, 93 aa, Medicago truncatula
MGFRFPGIIRKASFSANRSASKSVDVPKGYLAVYVGEKQTRYLIPVSYLSQPSFQGLLSQVEEEFGYDHPMGGLTIPCTEDVFQHITSCFNGL

SEQ ID NO: 15287 - protein, 91 aa, Medicago truncatula
MGFRIAKLIRMPSFSSTQASSKGFEVPKGYLAVYVGDQMRRFVIPVSYLNQPSFQELLNQSEEEYGYDHPMGGLTIPCSEDEFRNLTSRMN

SEQ ID NO: 15288 - protein, 93 aa, Medicago truncatula
MGFRFAGIIRKASFSANRSASKAVDVPKGYLAVYVGEKQKRYVIPISYLNQPSFQDLLSQFEEEFGYDHPMGGLTIPCTEDVFQHMTSRLNGL

SEQ ID NO: 15289 - protein, 485 aa, Bacteroides fragilis NCTC 9343
MLLKQTKIVASISDRRCDVDFIKELFDAGMNVVRMNTAHASREGFEALIANVRAVSNRIAILMDTKGPEVRTTANADPILYQIGEKVKIVGDPDRETTRECIAVSYPNFVHDLNVGGTILIDDGDLELRVIDKTTEYLLCEVQNEATLGSRKSVNVPGVRINLPSLTEKDRNNILYAIEKDIDFIAHSFVRNRQDVLDIRGILDAHNSDIRIIAKIENQEGVDNIDEILEVADGVMVARGDLGIEVPQERIPGIQRMLIRKCILAKKPVIVATQMLHTMINNPRPTRAEVTDIANAIYYRTDALMLSGETAYGKYPVEAVKTMTKIAAQAEKDKLEENDIRIPLDENSNDVTAFLAKQAVKATTKLKIRAIITDSYQGRTARNLAAFRGKYPVLAICYKEKTMRHLALSYGVEAIYMPELANGQEYYFAALRRLLKEGRLHPTDMVGYLSSGKAGTQTSFLEINVVEDALKHAGDSVLPNSNRYL

SEQ ID NO: 15290 - protein, 587 aa, Geobacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGRKSAFGKAVVAKTAEEARQKMVDGGILVTVSTDADMMPAIEKAAAIITEEGGLTSHAAVVGLSLGIPVIVGVENATTLFKDGQEITVDGGFGAVYRGHASVL

SEQ ID NO: 15291 - protein, 466 aa, Arabidopsis thaliana
MLIKETNLGSFNLGGIFQRLLYCVPLKKSIYFVDRIGNYTDGSVSKTLNSTSSVFPQATEKENNFCLLRKGQLQDVYEHVLVNNALLICKVVLPERRISKKTLEARDPRYVNLEDKSLKVNGSSQLVNNGTRYRLEPDGNGYNYASAMKGAKVVDHNKEAKGASNVLGKDHDKYLRNPCSVSDKYVVIELAEETLVDTVRIANFEHYSSNPKEFSLSGSLSFPSDMWTPAGSFAAANVKQIQSFRLPEPKWTDQIGKETEAQKKKDDVVKTINIIGDKKYEVKEKHNVLKVMMQKVKLIEMNLSLLEDSVKKMNDKQPEVSLEMKKTLVLVEKSKADIREITEWKGKMKLPMNLIFFEQEKELRDLELWKTLVASRVESLARGNSALRLDVEKIVKEQANLESKELGVLLISLFFVVLATIRLVSTRLWAFLGMSITDKARSLWPDSGWVMILLSSSIMIFIHLLS

SEQ ID NO: 15292 - protein, 356 aa, Methanosarcina acetivorans C2A
MNNMKGFAMLEIGKVGWIDAERPSAGPYDAIVRPLAVAPCTSDVHTVWEGALGERKNMILGHEAVGVIDEIGSEVKDFKPDDKVIIPAVTPDWRSMEAQDEIPMHSNGMLGGWKFSNFKNGVFAEYFHVNDADMNLALLPKGMPLEQAVMLSDMATTGIQGAEMANIKTGSTVAVIGIGPVGLMAVAGASILGAGRLIAVGSRKVTVDLALEYGASEVVDYRKGGLVGQILEKTNGKGVDSVIIAGGNENTISDAVKIVKPGGTVSNVNYYGTGDTLPIPRIEWGSGMAHKDIRGGLTTGGRLRMERMAALCTYGRIKPEKMATHVFEGFDKIEEALMLMKDKPRDLIKPVVLLEE

SEQ ID NO: 15293 - protein, 447 aa, Burkholderia mallei ATCC 23344
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAYGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYAS

SEQ ID NO: 15294 - protein, 295 aa, Listeria innocua
MSKDIATPGRTTEILKKYGFLFKKSLGQNFLIDSNILTRITDTAEITKETNVIEIGPGIGALTEQLAKTANEVVAFEIDQRLLPILDDTLSNYDNVRVVHNDVLKADVAEVITEQFAKPELPLKIVANLPYYVTTPIILKLLHDNIPADSMTFMLQKEVADRISAVPSTKSYGSLTIAIQFYMEAELAFIVPKTVFMPQPNVDSAVIHLKRRKEPLAKVNDEEFFFEVTRASFAQRRKTLWNNLASKFPALKPRKEELIEGLNAIGIDLIRRGETLDIPEFAKLSNFLADFLAEK

SEQ ID NO: 15295 - protein, 350 aa, Clostridium acetobutylicum ATCC 824
MLCALIMAGGKGERFWPLSTDEKPKQFLKLLSDKTMIQMTVERLESLIDIEKIFVVTGERYVDILREQLPRLPKRNIIVEPVGRNTAPCIALSAFVINKYYKDASIVVLPSDHLIVNEDKLLDAIRSAEEFIEKNDNSIVTLGMEPTRAETGYGYIKSGEVKEEISGFKIKKVDEFVEKPNKEKAEEYVKAGNFLWNGGMFIWKCSTIFKLTEKYLNKTYNILRSISEANGDEFNVLLKREYVKVDNISVDYGIMEKADSIYVIPCDFGWDDIGTWHAVERYRDKDEDNNVCVGDIKSIDSKNNILVGKKKPIVVVGLSDVFVVESDDIIFVGKKDDIERIKEIKKKVIK

SEQ ID NO: 15296 - protein, 279 aa, Bacillus cereus E33L
MSIQNISFLGAGSIAEAIIGGLLHANVVKGEQITVSNRSNETRLQELHKKYGVKGTHNKKELLTDTNILFLAMKPKDVAEALTPFKEYIHHNLLIISLLAGVSTHSIRNLLEKNIPIIRAMPNTSAAILKSATAISPSKHATKEHIQTAIALFETIGLVSVVEEEDMHAVTALSGSGPAYIYYVVEAMEEAAKEIGLKEDVAKSLILQTMIGAAEMLKASEKHPSILRKEITSPGGTTEAGIEVLQEHKFQQALISCITQAAQRSHNLGKTLEQLTKEK

SEQ ID NO: 15297 - protein, 476 aa, Candida glabrata CBS 138
MSLSGNNFENPQNNGTSRLLKNVQRLALNNVTNTTAGPHVGFLGSQSQDNSALRSFKSSIANLKGDSVPTYKVNPLSRPALVNNERDLTKTKLGIQEEKETRNYEENKENHGPQKGHFTQYDERVEDKNQSESTVSSQTTTESTQITTSNGDDDQTEEENSEDADSKKKRPISTIVEQDIPKKFKSCNRFGTEEYEWEDLDAEDANDPFMVSEDVNDIFEYLHQLEIVTLPRKEDLYKHRNICQNRDILVNWLVKIHNKFGLLPETLYLAVNLMDRFLCKELVQLDKLQLVGTSCLFIASKYEEVYSPSIKHFASETDGACTEDEIKEGEKFILKTLEFNLNYPNPMNFLRRISKADDYDIQSRTLAKFLLEISLVDFRFIGVLPSLCAAAAMFLSRKMLGKGQWDGNLIHYSGGYTKNQLAPVCEMIMDYLVSPVVHDEFHRKYQSRRFMKASIISVQWALKVRKNGYDIMSLHE

SEQ ID NO: 15298 - protein, 390 aa, Rhodococcus sp. RHA1
MNTTTLALIELGAVFFALGLLGRLAAQFGMSPIPFYLLGGLCFGSGGFVNLGDISEFSHLASEIGVVLLLLLLGLEYTASELVTGLRRSWMAGVVDAVLNAAPGAVVALMLGWGTTGAVVMAGVTYISSSGIIAKVLSDLGRLGNRETPVVLSILVFEDLAMAVYLPILTALLAGVSFAGGLEAVGISLVVISVVLVIALRYGRYVSALLDSPDSETLLLKLLGAALLVAGISSAMQVSAAVGAFLLGIAISGTTAHNASRVLEPLRDLFAAMFFVVFGLNTDPRAIPPVLGWAALLAVVTALTKMITGAWAAKQQGVARLGRARAGVALIARGEFSIVIAGLALSAGAVESELVALATAYVLLMAVIGPVAARVVEPVAGAWIRVRTSA

SEQ ID NO: 15299 - protein, 93 aa, Vibrio parahaemolyticus RIMD 2210633
MANTAAALHILVKHKEQAEDIIKQLKKGAKFQTLAKKYSTCPSGKRGGDLGEFRRGQMVPQFDKVCFSGEVLTPHLVKTKFGWHVVKVLYRIP

SEQ ID NO: 15300 - protein, 171 aa, Brassica napus
KPLKLKHPIKQTFDTNKNKKPGMCLLFLTVSMAVMSTVSAQSICTHVLISMAPCLGYITGNSSSPSQQCCSQLAHVIRSSGECLCEVLKGGGPHLGINFNKTQALALPKACNVQTPPVSHCNGPSNTSEHGNGSKTVPGHRSSSRGSSIKVSFSLLAVLSAVSYIINYSRY

SEQ ID NO: 15301 - protein, 321 aa, Mucor mucedo
MSTDYLTLNRTGDKMPIRGFGCWKIDTKDCEETVYQAIKTGYRLFDGACDYGNEVEVGRGINKAINEGLVKREDLFIVTKLWNTFHSKKHVRALFDRQLKDTGLEYFDLYLIHFPVPLQYVDPATVYPPGWYVGDAKSLQFEQSPIHECWAELEKIVDAGLARNIGVANFNCQAILDLLTYARIKPAVLQIELHPYLPQERLVKWVKEQGIQITAYSSFGPTSYVDLTESGKTYTSLLEHASVKSVADKHNVSTGQVLLRWALDREFAVIPKSVNAGRMKANLEILDIKLDAEDNKTLDSLKTNQRFNDPMTYGFGLPLFD

SEQ ID NO: 15302 - protein, 408 aa, Campylobacter upsaliensis RM3195
MQIPSKLKPYYENIAFERDDAKMIINLGPQHPSAHGNLRLILELDGEQVTKARPCIGYMHRGMEKMAENMIYQEFIPTTDRMDYIAASANNYAYCAAVEKLCGLEIPRRAAVIRMILLELNRIASHLLWLATHALDIGAMSVFLYCFREREYVLDLIERYCGARLTHSSMRIGGVMLDLPDGFLDELLAFCAKFPNDVKDYEALLDDNRIWRLRTENVGLVTKEQAMNWGCSGVMLRGSGVCYDIRKEEPYLLYDEVDFGVPYASQGDSYARYKIYMQEFRESLKILTQCVKLYKNTPPEILANHPEYVSASKEQIMTQNYSLMQHFVLVTQGLKPPKGEVYVPTESPKGELGFFIHSDGTGRPYRLKARTPSFWHCAFFEEMLVGSYLADVVAIMGNVNIVLGEIDR

SEQ ID NO: 15303 - protein, 431 aa, Staphylococcus aureus subsp. aureus MRSA252
MTNAYVDLKLVEEKVFKDPIHRYIHVEDQLIWDLIKTKEFQRLRRIRQLGTLYLSFHTAEHSRFGHSLGVYEIVRRLIDESFIGHDAWDNKDRPLALCAALLHDLGHGPFSHSFEKIFNTDHEAYTQAIITGDTEVNAVLRKVSPEFPREVAEVINKTHHNKLVISMISSQIDADRMDYLQRDAYFTGVSYGAFDMERILRLMRPSKDEVLIKESGMHAVENFIMSRYQMYWQIYFHPVSRGGEVLLNNCLKRAKQLYNEGYEFKLHPHDFIPFFEETVTIEQYVELDEAVVTYYLEKWTKEDDAILSDLASRFINRDLFKYIPFDGSIITISELQELFEAGGINPDYYFVSEAFSDLPYDYDRPGSNRKPIHLLRQDGKIREISNQSLVIHSITGINRQDYKLYYPREMVAKIKDKTIREAIENLINELN

SEQ ID NO: 15304 - protein, 426 aa, uncultured gamma proteobacterium
MYEKNQNFSFDPATVDAMLVSHAHMDHSGNIPNLVKKGFKGPVYATPPTVDLCQLMLRDSAHLQKKDIDWVNRIRAKHHQPPMEPLYSMDDAEESLHYFQPVEYDKSFEVIPGVQVTFKEAGHILGSACILFEINEKGRRIEMGFTGDLGRAGMPILRDPVILRELDALIIESTYGNRSHDPISDAGEEMAKTIREVAAAGGKIIIPAFAIGRTQELIYMLHKLYDQNRIPEIPVFIDSPLAVHATDVFRKYAAYYDREAFRIFLAQHNDPFAFQMLKYVESTEESKRLNGLAFPHIIISASGMAEGGRILHHLANNIENPKTLILFVGFAAKETLARKIMDGNETVKIFGEEHRVKARVKILQNFSAHGDRRDIIEYVKMSSPAKLKNLFLVHGEPDQAIPLRDAFQSMGYQNVQYPVLNEKVMI

SEQ ID NO: 15305 - protein, 506 aa, Sesamum indicum
MEAEMLYSALALTFAIFMVYRILSNSQDKRSLTKLPPSPPGWLPVIGHAHLMKNLLHRTLYDFSQKLGPIFSIRFGSRLVVVVSSSSLVEECFTKYDIVLANRPQASVDRRSLGFSTTSVIGAPYGDHWRNLRKLCDLEVFAPTRLASFLSIRLDERDRMISALYKISSAGFAKVNLEAKIVELTFNNIMRMVAAKRYYGEEAEDDEEAKRFRDLTKEALELTSASNPGEIFPILRWLGCNGLEKKLAVHSRKTDEFMQGLLDEHRRGERQNTMVDHLLSLQESQPEYYTDEIITGLIVALIIAGTDASVVTTEWAMSLLLNHPKVLEKARKELDTLVGHERMVDEHDLPKLRYLHCIVLETLRLFPSVPTLVPHEPSEDCKIGGYNVPKGTMVLVNAWAIHRDPKVWDDPLSFKPDRFEIMEVETHKLLPFGMGRRACPGAGLAQKFVGLALGSLIQCFDWERTSPEKIDLNEGSGITLPKAKTLEAMCKPRHVMEKVLRQVSNV

SEQ ID NO: 15306 - protein, 310 aa, Oryza sativa (japonica cultivar-group)
MVEWTRAEKRTFLRQRVEARLAALLLENQEYTDALTLLTDLIKEVRRLDDKLLLVDIDLLESKLHFSLRNLPKAKASLTAARTAANAIYVPPAQQGTIDIQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDALLEQNLCRLIEPYARVEIAHIAEMIELPVDHVEKKLSQMILDKKFAGTLDQGAGCLIIFEDPKTEAIFPATLETISNVGKVVDSLYMRSAKIMA

SEQ ID NO: 15307 - protein, 226 aa, Glycine max
  misc_feature (55)..(55): Xaa can be any naturally occurring amino acid
  unsure (1)..(226): unsure at all Xaa locations
LRYDKLRIIITFTEGRALGAAAAVSLSSKVPLFYGKNGSGYGSASSSSSSSWISXTLALPAAAYMFQDQEVRAAELARPFIAIKPDGVQRGPISEIISRFERKGYKLVGIKVVIPSKEFAQKHYHDLKERPFFDGLCDFLSSGPVIAMVWEGQGVISYGRKLIGATDPQKSEPGTIRGDLAVVVGRNIIHGSDGPETAKDEIKLWFKPEELVSFTSNAEKWIYGAN

SEQ ID NO: 15308 - protein, 560 aa, Bdellovibrio bacteriovorus HD100
MNKLENLKQLLAGKFKIENFKFTHAVGDDVIEVPKEDAPALLLFLRESGQFDFLMDVCGADYPSREKRFDVVYNLFNSKDSSRLRVKAQVGEGESIGTAIPAYRGADWFEREAYDMFGIIFEGHPNLRKILTHHQFVGHPLRKDYDANNQQACTNSLPIHFNNEPGSPGDVLNDKYLPLNIGPSHTAMHGTLRVMAEMDGETIVRCNNEIGYLHRCFEKMAETHPYNQVIPYTDRLNYCSAPMNNIGYCKAVERLLGVEIPPKAQAMRVILAELSRIIDHTIAIGTGAMDLGALTSFFYMFGMREKVYGLFEKLCGARLTVSMTRIGGMAQDAPEGWFDEVLALVKEIRKGTDEMANMVIDNKIFIQRTKNVCPVSAADAIQWGYTGPMLRACGVNLDLRKAQPYYGYDALDFDVPVGTNGDIYDRYLVRFEEMRQSVRIIEQVCKNVPGGDYTIRDKGIVLPEKKDVYGNIEGLMNHFMLIIKGLRPPVGEVYDATEAANGELGFYLVSDGSANPYRLKVRPPCFAIYQSFPTVVKGAMLADAIATVASMNLIAGELDR

SEQ ID NO: 15309 - protein, 416 aa, Methanosarcina acetivorans C2A
MFVLELSFKGGCREVGRSGLLVNEEILLDYGIKAGEIPEYPGNGMEPKAVLVSHGHLDHCGAVPNLMYMNPEVFMTPPTAEFTNLLGRDTLKLAETTLSGVAPFDPNDLQRVNQLTRRKDYGEAFKTQGYSVCFYNAGHIPGASGIYLESKSGESLLYTGDFSMKETRLVPGAEKFPEADTLVLESTYFGEEHVPRKETEKRFIDSVLETLERGGTALIPAFAIGRTQEILMLLDAHGITAYVDGMGRDVYKLLRKYPEYLRNPELLDRAFDRAISVKDKQRESVLKEPSVIVTTAGMLNGGPVLYYLSQLYRDPNSKVLLTGYQVEGTNGRLALNHGVIETRGDVLALKPKIEQYDFSAHSGDSELKKLVKDFCKKGTERVFVMHGDKTEAFAQWISEEIGVEAYAPANGESFSF

SEQ ID NO: 15310 - protein, 813 aa, Chlamydia muridarum Nigg
MHFDRMKINVESMKQAILERVYCGVVQTPQSASTRDIFTAVAKTVSEWMAKGWLKTQSSYYDNDVKRVYYISMEFLLGRSLKSNLLNLGLLDLVNEALSDLGYDFDQLVEMEHDAGLGNGGLGRLAACFLDSMATLGIPAYGYGLRYDYGIFDQQIENGYQVESPDEWLRYGNPWEICRGEYLYPVHFYGKVKHSMDSRGRDVAELVDSQEVLAMAYDVPVPGFNNDTVNSLRLWQAQSRHGFEFSYFNHGNYIRAIEDIALASNITRVLYPNDSISEGQELRLKQEYFLVSATIQDILRRYTKTHLSLDKLSEKVSVQLNDTHPALGIAEMMHILVDREELDWDVAWDTTTKIFNYTNHTILPEALERWSLDLFSKVLPRHLEIIYEINARWLKKVSQKYPGDDDKRRALSIIEEGSSKFINMANLAVIGTSKVNGVSSFHSQLIKNTLFKDFVEFFPDKFINVTNGITPRRWLALSNKRLSALLNRSIGTDYLTNLTHLNKVISLAEDSGFREEWHKIKIQNKEDLSARIYKELGVSVNPQSIFDCHIKRIHEYKRQLMNILRVIYFYNEIRNGSTEIVPTTVIFGGKAAPGYAMAKLIIKLINNVAHIVNNDPKAKDLLKVVFWPNYRVSLAEAIIPATDLSEQISTAGMEASGTGNMKFALNGALTIGTMDGANIEMAEHIGKEHMFIFGLLEEEISALRNEYYPQGICNANPKIQEILDMVLQARLPEEDKDLFKPIVNRLLNEGDPFFVLADLESYLDAHNRVARLFTQPEEWTKKSIYNVGGIGFFSSDRSITDYASNIWNVSQSS

SEQ ID NO: 15311 - protein, 99 aa, Brassica napus
  misc_feature (24)..(24): Xaa can be any naturally occurring amino acid
  misc_feature (94)..(94): Xaa can be any naturally occurring amino acid
  unsure (1)..(99): unsure at all Xaa locations
MALVSLLDISIAFFCFLIFQIFLXISKKPHPSFLTNWPFLGMLPGLILEIPRVYDFITEVLEHGNLNYLFKGPFLGGLDMLFTVDPANIHHIMXSNFSN

SEQ ID NO: 15312 - protein, 391 aa, Nephroselmis olivacea
MIEAKTDPMIVSMGPHHPSMHGVLRLIVTLDGENVLDCEPVVGYLHRGMEKIAENRTIVQYLPYVTRWDYLATMFTEAITVNAPERLANIEVPRRASYLRVIMLELSRIASHLLWLGPFMADLGAQTPFFYILREREMIYDLFEAATGMRMMHNYFRVGGVAADVPYGWIDKCLDFCEYFLPKVDEYEALITRNPIFLKRVKGVGTISPQQAINWGLSGPMLRASGVSWDLRKVDRYECYEDFHWSVESEETGDCLARYLVRIREMRTSTKIVQQALKSIPGGPTENLEARQLSQGRTSPWNEFDYQFLGKKASPTFKMPRQEHYVRVEAPKGELGVFLIGDDHVFPWRWKIRPPGFINVQILPNLVQGMKLADIMTILGSIDIIMGEVDR

SEQ ID NO: 15313 - protein, 141 aa, Methylobacillus flagellatus KT
MAVERTLSIIKPDAVAKNVIGKIYTRFEDAGLKIIASKMVQLSQADAEGFYAVHKERPFFNDLVKFMISGPVVVQVLEGENAVLKHRELMGATDPKKAEPGTIRADFADSIDANAVHGSDSLENAAVEIAYFFAQSNIYSR

SEQ ID NO: 15314 - protein, 427 aa, Burkholderia thailandensis E264
MSNNQTLFERAQRTIPGGVNSPVRAFRSVGGTPRFVARAQGAYFWDADGKRYIDYIGSWGPMIVGHVHPDVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADVAKHTTVLEYNNVAALEEAFAAFGDEIAAVIVEPVAGNMNLVRGTPEFLNALRALCTKHGAVLIFDEVMCGFRVALGGAQQHYGIKPDLTCLGKVIGGGMPAAAFGGRGDIMSHLAPLGGVYQAGTLSGNPVAVAAGLATLRLIQAPGFHDALADKTRRLADGLAAEARAAGVPFSADAIGGMFGLYFTEQVPASFADVTKSDIERFNRFFHLMLDAGVYFAPSAYEAGFVSSAHDDATLDATLDAARRAFAALRA

SEQ ID NO: 15315 - protein, 394 aa, Methanosarcina mazei Go1
MFSINSECVISKKSEDIPPFYVMEVLESAQALEAQGRHIIHLEVGEPDFPTAPHICEAACAAIGRGLTKYTHSQGLLALREAIVESYYQKFGVDLDPGQVIVTSGTSPALLMVFMALLEKRDEVIMSNPHYSCYPNFVKHLGGTPVFVYTNETNGFALEPETVRQRLSPNTKAILINSPSNPGGHVMSPENLQGLAAIADERGIPIVSDEIYQGLIYSGEEHSILEYTKNAFVLNGFSKLYAMTGWRLGYIICPPGCVRALQKIHQNFFICANSFVQEAGIAALKGPQEHVTEMVQTYNVRRQYMLKRLIGMGLDVRKEPMGAFYVLADARKYCSDSLELSRRILNEAGVAVTPGIDFGNGAEGYLRFSYANSLENITEGMDRLEAFLEKELEG

SEQ ID NO: 15316 - protein, 250 aa, Burkholderia thailandensis E264
MYKLVLIRHGESTWNKENRFTGWVDVDLTEQGNSEARQAGLLLKEAGYTFDIAYTSVLKRAIRTLWHVQDQMDLMYVPVVHSWRLNERHYGALSGLNKAETAAKYGDEQVLVWRRSYDTPPPALEPTDERAPYGDPRYAKVPREQLPLTECLKDTVARVLPLWNESIAPAVKAGKQVLIAAHGNSIRALVKYLDGISDADIVGLNIPNGVPLVYELDANLTPIRHYYLGDPEAIAKAQAAVAQQGKASAA

SEQ ID NO: 15317 - protein, 537 aa, Exophiala dermatitidis
MDGPLHKAVVNKKPVPEIDFTLHIMEDGTQVSTQERVCKDVQAPAMQRPTDDQFWSPIDRSKPNLPFLKQHFYREGRLTEEQALWIIHEGTKILRSEPNLLEMDAPITVCGDVHGQYFDLMKLFEVGGDPAETRYLFLGDYVDRGYFSIECVLYLWSLKIWYPNTLWLLRGNHECRHLTDYFTFKLECKHKYSERIYDACMESFCALPLAAVMNKQFLCIHGGLSPELHTLEDIKSIDRFREPPTHGLMCDILWADPLEEFGQEKTGEYFVHNHVRGCSYFFSYPAACNFLEKNNLLSIIRAHEAQDAGYRMYRKTRTTGFPSVMTIFSAPNYLDVYNNKAAVLKYENNVMNIRQFNCTPHPYWLPNFMDVFTWSLPFVGEKITDMLIAILNTCSKEELEEDTRTSSAEPETPPFAPDAETTEAKRRAIKNKILAIGRLSRVFQVLREESQRVTELKTQAGGRLPAGTLMLGAEGIKQAIHNFEDARKVDLQNERLPPSPEEIEKRSAEDRKAALERAATEAENDTTLQGVARRISL

SEQ ID NO: 15318 - protein, 160 aa, Methanosarcina mazei Go1
MPVSSNTEGVHMEQTYVMVKPDGVQRGLVGEVISRIEKRGLKIVALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIANYSRVDEVCLYE

SEQ ID NO: 15319 - protein, 339 aa, delta proteobacterium MLMS-1
MSRPIGITVSRHIMDSQRLHPEATGELTGLLYELIVAAKTISAEVNMAGLADILGMSGKTNIQGEHVQKLDEFANNTIKRRMARCGYLAAMTSEEEADIIPVVEGYEGKYTLAFDPLDGSSNIDVNVSIGTIFSVHRRLTPEDGPGEESDLLQAGRQQVAAGYVIFGSSTMLVLTTGDGVHGFTLDPSVGEFYLSHPNIRVPEKSKYFSVNEGNHCYWQEPVRRFLEHLKEEDKASGRPYSGRYIGSMVADFHRNLIAGGVFLYPRDSKDPTKPYGKLRLLYEAAPMALLIEQAGGRAITDDGREILDITPEDLHQRVPLVIGSRHDVALFEEFMNGRR

SEQ ID NO: 15320 - protein, 52 aa, Arabidopsis thaliana
MKSSSELLVIMIFLFLALLIISHAQSLPGTPYGGPGPYPRSYPVCYPPYCRP

SEQ ID NO: 15321 - protein, 260 aa, delta proteobacterium MLMS-1
PPAQLPGLRPQADPGRGGRLGAPFASGLVLIASELKAGRGRFARPWHAPAGGLWLTVVLVNTLLPQHARFYPLAAGVAVAETLRSFGLPAQIKWVNDILVDGRKIAGMLLETDYGRRRREEYVLLGIGLNVNNHDFPPELDGLAVSMGQVAGRRFDLDQVAACLLAKLRWQIGLLHWVEARQLAMEGDSGEPPADHPLLASWRELSDCLKRRVLFGFNVQQKTQYEAVVEDIDPAGGLVMRLAADGRMVTEYAGEIIYLS

SEQ ID NO: 15322 - protein, 315 aa, Thiomicrospira crunogena XCL-2
MQIQWYPGHMHKAQKEIREILPQVDMIIEVLDARIPFSSENPMIANLRGDKPTLKIFNKSDLADPAQTEAWQAYFEQSKNIKTLALNAQQADRKIQVLGIIKKMIPRKAESVKVIHALIMGIPNVGKSTLINTLASRPIAKTGNEPAVTKILQRIKLEDGITLFDSPGMLWPNIENEHSGYRLAITGGIKETAFELPDIASYAAEYLMQAYPERLLERYDLDALPIHDPAPDVAFLEQIGRTRGCLVSGGQVNLDKISRIFITEIRDGLLGRLTFETPDLMEEESRLVEIQRIKKAEKKQARLDARKQKKNKRNR

SEQ ID NO: 15323 - protein, 139 aa, Brassica napus
LLCLLHLQVGQIICRFEQKGFTLKGLKLITVDRPFAEKHYQDLSAKPFFSGLVDYIISGPVVAMIWEGKNVVLTGRKIIGATNPAASEPGTIRGDFAIDIGRNIIHGSDSVESANKECALWFPDGPVNWQSSLHSWIYE

SEQ ID NO: 15324 - protein, 698 aa, Oryza sativa
MATAVAATAMRRGQHLPLSLSLCYNLAAVALLVAVFLHAPPRAGAQPLPWQLCNATAGNYTEGSTYQANVRALASALPGNASSSPALFAEGAAGTAPDVVYAIALCRGDTNASSCAACVATAFDTAQQLCAFNKRATLFNDPCILRYSDLDILANVTDNSGRFVAWNYNNVSAAKAAAYDAASGRLVNATADYAAADPVRRFGTGEVGSDDATYPRIFSLAQCTPDMSEADCRSCLGDIIRKATPKYFVGKPGGRVFGVRCNFRFEAYEFFSGRPLLQLSGPPPPPANMTPPVTSEGRTSHRTGRILAITLPIAGAALAFIALTCFCFRRKRTPANKASSLPFSTNPDDIQSIDSLLLDLSTLRAATDNFADRNKLGEGGFGAVYKGVLSEGQEIAVKRLSQSSRQGIEELKTELVLVAKLRHKNLVSLVGVCLEGDEKLLVYEYMPNKSLDTILFDYEKSKDLDWGKRLKIVSGVARGLQYLHEDSQLRVVHRDLKASNVLLDFDHNPKISDFGLAKLFEWDQTQDVTSHIAGTYGYMAPEYAMRGQYSVKSDAFSFGVMILEIVTGRRNSSFSNSEQSIDLLSLVWEHWTTGTIEELLDPAMRGRSADDLLKLINIGLLCVQDNPADRPTMSAVSVMLSSETFSIQAPSRPTFCIQETDSAADTDLYSSALRSTGDSKTRAVASPNEVSLTELEPR

SEQ ID NO: 15325 - protein, 223 aa, Oceanospirillum sp. MED92
MTQDEMKKAVAEAAVEYIKPKLTEDSIVGVGTGSTANFFIDALAEIKHMFEGAVASSEATAERLKGHGIEVFDMNSVSEMEVYVDGADEFDSGLNLVKGGGGALTREKIVAAVAKEFVCIVDSSKKVDVLGEFPLPVEVIPMARSQVARELVKLDGMPEWRQGFVTDNGNLILDVHDLEIMRPKELEKQLNNIVGVVTNGLFANRGADVVLMGTESGVETIKL

SEQ ID NO: 15326 - protein, 514 aa, Legionella pneumophila str. Lens
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWQRVEPVYNLLTQGKSERQFPDAETAIHFYYKNKISDEFVPPTLIGKEHSIQDGDAVLFFNFRADRARQLTSTFLDPSFKGFERKTLPKLSYFVSMTQYDKNLFTTTAFPPVPLNNTLGEVLSSHGLSQLRIAETEKYAHVTFFFNGGCESVFTNEERIMVPSPQVATYDLQPEMSAHELTKTLIAAINSQDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHA

SEQ ID NO: 15327 - protein, 1233 aa, Methanosarcina acetivorans C2A
MEEPEFQAYVGPRPFEQEDKFIFFGRDREARDLLSLVIAHNLVLVYAQSGAGKTSLINAGLIPLLKENRFEVFPVARVKGTPLRNIKTDEISNIYVLNTLTSWAEDEYDVERLTKMKLVDFLNEQERLQDEDGIPLPRAVIFDQFEEIFSLYQDRWKDREGFFEQISAALETDPLLRVVFVIREDFIAQLDPYVELLPERLRTRFHIERLRREAALLAIKEPLRDTGRSFAEGVAEKLVDDLLKIRVETTPGETTEVTGEFIEAVQLQVVCQNLWRELPPDVKQITFHHLKTYGNVEQELYRFYEEAIRTAAATAHIDEESLRRLFGEVLITTMGTRGMVYRAQESTGGIPNTAIDVLESMHLIRAEWRAGARWYELTHDGFIKPILSSNRVFNDELAEKERAEKERIEKERIEKEWAEKEWAEKERLEKERAEKERLEKELRAEKELAESKQLFYKRLAAISFLAILLALVAVFEWHQAKENAEEARASDLNLNSALLQGDPRNLDKSVLLAIESLKIHITSTADHLIRQGLLSMPHRVVILKHYSDVNNVVFSPDGKYVATASNDNTSRLWDVSTGKQIFVLNHTDPVRNVVFSPDGKYVATASADKTAGVWNTTTGEGISVLNHTGRVNNVVFSPDGKYIATASDDNTSRLWDTATGKQIFVLNQTDPVRNVVFSPDGKYIATASADNTSRLWDTTTGKQIFDMKHDGPVNIVVFSPDGKYVATASADKKARLWNATTGKKIFDMKHDSGINTVVFSPDGKYIVTASDDKTAGVWNTTTGKKIFDMKHDGSVNTVVFSPDGKYIATASADNTSRLWDTATGEKIFFLNHYGWVNTVVFSPDGKYVATASADKTAHLWDVSTGKQISYLRHDSGVNNVVFGPDGKYVVTASADKTADVWNTTTGEKIFVLNHTGRVNNAVFSPDGKYIATASADNTSRLWDTTTGKQIFVLNQTDPVRNVVFSPDRKYIATASDDNTSRLWDTATGKQILVLNHDGPVNTVVFSSDGKYIATASDDNTSRLWDTATGEEIFVLNHTDRVNNVVFSPDGKYIATAGDDNTSRLWGTATGEKIFDMKHDGPVNNVVFSPDGKYVATAGYDNTACLWDTATGEKIFVLNHAGRVNTVVFSPDGKYIATASADKARLWNATTGKQISYLRHDSGVNNVVFSPDGKYIATASVDKTARLWTAKLWISDTEDLIDEANNRLTRNLKPEEWKEYMGDKPYHKRFPNLP

SEQ ID NO: 15328 - protein, 277 aa, Chlorobium tepidum TLS
MNQPSGNKLPHVTTRRMLDMKERGEKIAMLTAYDYTMARILDRSGVDAILVGDSASNVFAGHSTTLPMTVDEMIYHAKAVVRGVQAETRRAMVIVDMPFMSYQLSPEDAVRNAGKIMKEHECDAVKMEGGKVIAEAVKRITDIGIPVMGHLGLMPQSIYKYGSYKVRAMEEEEARQLIEDAKIIEEAGAFAIVLEKIPSKLAGEVSRLLTIPTIGIGAGPECDGQVLVINDMLGLSTDFRPRFVRRYADLSSVIEQAVKSYVEDVRSNSFPSEDESY

SEQ ID NO: 15329 - protein, 249 aa, Mycobacterium tuberculosis CDC1551
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRG

SEQ ID NO: 15330 - protein, 266 aa, Oceanospirillum sp. MED92
MELSSLYVTVIEPSKVQRHIIIGHLNSFGIENIEEFEEAKPALEHMLVTPPDVVLSSMHLPDMTGTDLVTQMRGLEALEKITFLLVSSETHYRYLEPIRQAGAIAILPKPFSREEMAMALKSTLDYVSDFESDSDSDEYDALRVLVVDDSTMSRNYIKQMLDSLSIHSIDTAADGSDALQMIDDGARYDLIITDYNMPNVDGKELIEHIRSHSEQPTVPILMVTSEQNESRLAAVQSAGVSAICSKPLSYDTVKQLIEQLVTDYDM

SEQ ID NO: 15331 - protein, 321 aa, Vibrio parahaemolyticus RIMD 2210633
MRKEHSVKLHILKTLSDGGFHSGEMLGQQLGISRAAIAKHIKGLNDWGVDIYRIQGRGYQLAHPLQLLDETRLKNAISTPVELISVIDSTNQYLLEKVSESDKGRVCIAEYQAQGRGRRGRQWISPFGTNLYLSMYWRLDAGMAAAMGLSLVVGIAAVEALESIGIQGVKLKWPNDIYYQDKKLAGILVEMSGQAGGAAHLVIGMGLNIGMPDVQPGIDQPWTTLNQISNEVSIDRTQLAIRLIDHWKAALEEYELTGLGGFVERWNRLDNFIGRPVKLLMGPREIHGVVQGIDQQGGVVLKTENGLETYIGGEISLRKGD

SEQ ID NO: 15332 - protein, 658 aa, Neisseria meningitidis MC58
MNEFSLAPIVIVLLVSVITVILCRKFNIPSMLGYLLVGFLAGPGMLSLIPKSHATDYLGEIGIVFLMFSIGLEFSLPKLRAMRRLVFGLGGLQVGITMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPEWEQAATAAVLLSMIIAPFLLGGSDALVGRLVKSSWDMKSLDLHSMLVETMSKSDHVLIVGFGRGGQTVGRVLAQEDIPYFALDLDIARVQVARSAGEPVSFGDAKRREVLEAAGLGRAKMVVVTLNNMHETQHVLDNVLSMYPNMPVYVRATNDDYVKTFTDIGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKEEIISFENWSLQGI

SEQ ID NO: 15333 - protein, 394 aa, Exiguobacterium sibiricum 255-15
MNGFDLVEEAVEDLKHGRPIIVCDDENRENEGDLILLAEHATPEQINFMITYGKGLVCVPVSPQLAARLELNPMTDVNTDPHGTAFTISIDHEDAMTGISAAERALTIQRMLTDGPKQFKRPGHIFPLIAKEGGVRERRGHTEAGVDLARLAGSAEATVICEIILEDGTMARVDDLLTYKEVHGLKMITIDALVAYLERPVRREADVLLPAVHGAFRMLGYTTPDQKEHVTVLSGEPEDGMLVRLHSECLTGDVFGSKRCDCGPQLDAALERIGQEGGAVLYLRQEGRGIGLMAKLKAYELQEQGLDTVEANHALGYATDLRNYSVAAAMLHDLGVTKIRLMTNNPEKQQALENEGITVLERVPLEIAAVPENKQYLQTKQTKLGHLLDIQGGN

SEQ ID NO: 15334 - protein, 90 aa, Triticum aestivum
  misc_feature (9)..(9): Xaa can be any naturally occurring amino acid
  unsure (1)..(90): unsure at all Xaa locations
MAGPAKASXMVAMSVGAVEALKDQAGLCRWNYALRSIHRSTKAKANVPGGASQVKKQLPASAAAVAERRRARKAEEGLRTVVYLSCWGLN

SEQ ID NO: 15335 - protein, 465 aa, Rhodococcus sp. RHA1
MTQMSERHTAKVIGVTVAAAVGGFLFGFDSSVINGAVDSIQGHFELGSFFTGFAVAIALLGCAVGAWFAGRLADRWGRKKVMLLGSVLFVVSSLGAGLAFSVPDLMLWRVLGGLGIGIASVIAPTYISEIAPARYRGALASLQQLAITLGIFAALLSDAVLQNAAGGASNELWLNLEAWRWMFIVGVVPAVVYGILALLIPESPRYLVGKHLDQEAADILANITGELDPHERVSEIRLTLRHESTASFDDIRGPKFGLQPIVWVGIFMAIFQQFVGINAIFYYSTTLWKSVGFTENESFTTSVITAIINVGMTFVAILFVDRIGRRILLMVGSLGMFASLLMAAIAFSQASGSGDDVVLPSPWGAVALIGANLFVIFFASTWGPVMWVMLGEMFPNNMRAYALGISTAANWIANFTVTLAFPPLTRSVGLWFLYGLFAFFALLSFFFVRSKVRETKGMELEEMHT

SEQ ID NO: 15336 - protein, 275 aa, Oryza sativa (japonica cultivar-group)
MEGMGQQKRRPLVVMASAQAAARGGANPLAELTDRVKTLEAGLRAWLAKQPTHVEAAVATAVGAVQGGALGGLMGTLAPDGGSPFPVPQPPPGADPNALASFKQAQALAGGPLVQARNFAVMTGANAGISCVMRRIRGVEDVQGSAHFDSMAAAFGSGALFSIVSGMGSPNPVANAITTGVAFAVFQGGFFMIGQKFSQPPSEDIYYSRGRNMLKQLGLQNYEKNFKKGLLTDQTLPLLNDSALRDVKIPPGPRLLILDHIQRFGTAVQISETLS

SEQ ID NO: 15337 - protein, 249 aa, Dechloromonas aromatica RCB
MRKKLVAGNWKMHGSLQQNAALLELIKAGVSSLPCEVAVCPPYPYLGQVQSILSGSALAWGAQSVSEHQSGAFTGEVAASMLLEFGCRYVLVGHSERRALYGETDTVVSAKFEAVQRAGLVPVLCVGETLAERESGMTSVVVARQLSAVLGRVGVAAMASAVVAYEPVWAIGTGVTASPAQAQEVHAAIRAKVAELDLGVANGLRILYGGSVKPQNAMELFGQDDIDGGLIGGAALVADDFLAICRAAN

SEQ ID NO: 15338 - protein, 332 aa, Saccharophagus degradans 2-40
MTESWGRLLTILANGECHSGEALGVELGVSRAAIWKQIQAMAQVGIHVESVRGAGYCLPGGMSLLSEGEILKALEGMPAGAQGQLQCVVYSQLDSTNERVLQRIRAGESGHGYACLAELQSAGRGRRGRQWQSPYGRNVYLSLGWRFERGVAAMEGLSLAIGVAVCRALDKNFSLKAELKWPNDVLLAGRKLGGILLEVAGDLSGECYVVAGVGLNVSMPSAAAQAIDQPWIDVASCIESIGLIDRNQLAAALLFELSCVLSDYEQRGFAAYKNEWKMRCPHIGASVQLSSHSNTLVGEMVGVDDTGALLLLVDGELKPYSGGELSLRLASS

SEQ ID NO: 15339 - protein, 166 aa, Brassica napus
MASHAISLQSISTTTLNDLSCSHQSHRSSLLSFYKPFQNLGISSNVQDFSSRSTSTPKNLSLSQALSKNSGDTEHSRPSKVQELNVYEINELDRHSPKILKNVMSLKFRLGDLVPFTNKLYTADLKKRVGITAGLCVVIQHVPEKKGDRFEATYSFYFGDYGHLSV

SEQ ID NO: 15340 - protein, 559 aa, Penicillium chrysogenum
MGHPDEINALEAQPGYVDNLGDFKESEQDEPVQLHRELKARHISMIAIGGAIGTGLVVGTGSALTAGPGSLFIAYCFMGFVVWTVMCGLGEMAAWLPLSSGFTGYAGRFCDPALGFTLGWCYYLKYIILPPTQLTAAALVITYWPRTSAENVNPGVWIAIFMVAIIVINYFGVKIFGELEFWLSSFKVIVILGLILCSLLFALGGGPDHDRRGFRYWNKPGAFATKYTDGALGKFLAFWSTMVQATFAFLGTELIGVTVGEAQNPRKTIPKAIKLTFWRIIVFYILSVLFLGMLVPYDSKELAFATEAESSAAASPFVVAMGQVAALPHIINGCILVFVFSAANSDLYIATRTLYGLAREKKAPKIFARTNRAGVPIYSLALSASFCLLAFMSVSSTSKEVFGYFTDMVSIFGLLTWVSLLITHIFFIRARRAQGVDQATLAYKAPLGIIGSCIALFFCVLVLFTRSFGVFIHDPETYGNFDYKTFITSYIGIPLYVAAFAGWKIWNKTEIIKPHNADIWTGKAEIDREEAEYVAMVAIQDQNLSGWNKVYRKSLAWLF

SEQ ID NO: 15341 - protein, 271 aa, Candidatus Kuenenia stuttgartiensis
MLKEKFGFIGGGKMAEALCKGIIRAGLSAGSNIIVSDVLAERRRLLKEEIGVQTTQDNHDIAAFADVIILAVKPQIIGEALENIKNDITPRHLIISIAAGIPLHFIESKLRENVRVIRVMPNTPCLIASSATAFAPGKHTTEGDKKLAHAIFNAVGKVFQLEEKYLDAVTGVSGSGPAYVYMFIEALSDGGVKMGLPREIATALAAQTALGAAKMVLETGQHPAQLKDAVTSPAGTTIEGVSKLEDGGLRAAVINAVEAAALKSKKLGELL

SEQ ID NO: 15342 - protein, 467 aa, Burkholderia mallei ATCC 23344
MEGSQTGLGTGLKQRHVTMLSIAGVIGAGLFVGSGHAIVEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPAHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 15343 - protein, 397 aa, Bacillus cereus E33L
MFHRIEEALEDLKQGKVVIVCDDENRENEGDFIALAEYITPETINFMITHGRGLVCVPITEGYAERLQLEPMVSHNTDSHHTAFTVSIDHVSTTTGISAHERATTIQQLLNPASKGADFNRPGHIFPLIAKEGGVLRRAGHTEAAVDLAQLCGAEPAGVICEIINEDGAMARVPDLLQCAKQFDIKMITIEDLIAYRRHHETLVTREVEITLPTDFGTFQAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLTVTERVPLQMPAKEENKTYLQTKVNKLGHLLNL

SEQ ID NO: 15344 - protein, 308 aa, Escherichia coli
INGFGRIGRIVFRAAQKRSDIEIVAINDLLDADYMAIMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 15345 - protein, 91 aa, Brassica napus
MALVNNHPNEPKYVSKQNSSSQDLSSPENDGLDQPDAAYAGGHSASSSSTMNSDHQQNHQGLVFYPSGESVEDHNSLLDFNGSSFLNFDHN

SEQ ID NO: 15346 - protein, 1037 aa, Arabidopsis thaliana
  misc_feature (617)..(617): Xaa can be any naturally occurring amino acid
  misc_feature (645)..(645): Xaa can be any naturally occurring amino acid
  unsure (1)..(1037): unsure at all Xaa locations
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWSSFTDIHPFAPVDPLLQVLAHYRXVDNVYGDRNLVCTLQPANEEQAAAAVSXLNEATMKRFALAPKPTMGRFGLIPDPETYLYWLLLLFPASSSLSLSLPVQCTYVVLSSSLIYLIKYISLLMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 15347 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGAMKGVLGYTEDDVVSTDFNGEVCTSVFDAKAGIALNDNFVKLVSWYDN

SEQ ID NO: 15348 - protein, 295 aa, Mycobacterium tuberculosis CDC1551
MLFGMARIAIIGGGSIGEALLSGLLRAGRQVKDLVVAERMPDRANYLAQTYSVLVTSAADAVENATFVVVAVKPADVEPVIADLANATAAAENDSAEQVFVTVVAGITIAYFESKLPAGTPVVRAMPNAAALVGAGVTALAKGRFVTPQQLEEVSALFDAVGGVLTVPESQLDAVTAVSGSGPAYFFLLVEALVDAGVGVGLSRQVATDLAAQTMAGSAAMLLERMEQDQGGANGELMGLRVDLTASRLRAAVTSPGGTTAAALRELERGGFRMAVDAAVQAAKSRSEQLRITPE

SEQ ID NO: 15349 - protein, 487 aa, Arabidopsis thaliana
  misc_feature (146)..(146): Xaa can be any naturally occurring amino acid
  unsure (1)..(487): unsure at all Xaa locations
MGKKSGSSSSWLTAVKRAFRSPTKKEHNNNAHGNEVDEDEDKKKEKRRWLFRKSTNHDSPVKTSGVGKDAPAQKSTETTTIINPTVLSSVTEQRYDASTPPATVSAASETHPPSTTKELPNLTRRTYTAREDYAAVVIQTGFRGYXGKKSIKSIERASEVTSTSERSQCEEASKDDFKVYASSKGSSIAEDWDDRPHTIEEVKAMLQQRRDNALRRESNNSISQAFSHQVRRTRGSYSTGDEYEEERPKWLDRWMASKPWDKRASTDQRVPPVYKTVEIDTSQPYLTRGNSRTGASPSRSQRPSSPSRTSHHYQQHNFSSATPSPAKSRPIQIRSASPRIQRDDRSAYNYTSNTPSLRSNYSFTARSGYSVCTTTTTATNAALPNYMAITESAKARIRSQSAPRQRPSTPEKERISSARKRLSFPVPPLPQQMDGQSLRSPSFKSIGGSQLGALEQQSNYSSCCTESLGGGGEISPASTSDYRRWLR

SEQ ID NO: 15350 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEDEMKGVLGYTEDDVVSTDFNGEVCTSVFDAKAGIALNDNFVKLVSWYDN

SEQ ID NO: 15351 - protein, 417 aa, Dechloromonas aromatica RCB
MADIRNFTLNFGPQHPAAHGVLRLVLELDGEVVQRADPHIGLLHRATEKLAETRTWVQSVPYMDRLDYVSMMCNEHAYCLATEKLLGIEVPERGKYIRVMFDEVTRILNHLLWIGCHALDVGAMTMALYTFREREDLMDVYEAVSGARMHAAYYRPGGVYRDLPDRMPQYQESTWTNAKKAAEKNENRSGSVLDFLEDFTNRFPTYHSEYHTLLTDNRIWKQRLVNVGVVTPERALQMGFTGAMLRGSGIAWDLRKKQPYAAYDKINFDVPVGVNGDSYDRYLVRMEEMIQSNNIIKQCIAWLRKNPGPVITDNNKVAPPPRENMKTNMEELIHHFKLFTEGIHVPAGEAYAAVEHPKGEFGIYFVSDGANKPYRMKIRAPGFVHLAGLDEMSRGHMIADVVTIIGSQDIVFGEIDR

SEQ ID NO: 15352 - protein, 265 aa, Triticum aestivum
ALPRKAGTRLLVSVPGGTPPRKNPPSPTRRRPAPPYRTAANAIYVPPAQQGTIDLQSGILHAEEKDYKTAYSYFFEAFEAFNALDDPRAIFSLKYMLLCKIMVNQADDVAGIISSKASLKYVGPDVDAMKAVADAYSKRSLKYFETALRDFKAQLEEDPIVHRHLSSLYDTLLEQNLCRLIEPYSRVEIGHVAQMIELAVDDVEKKLSQMILDKKFAGTLDQGAGCLIIFEDQKTEAIFPATLETISNVGKVVDSLYMRSAKIMA

SEQ ID NO: 15353 - protein, 305 aa, Symbiobacterium thermophilum IAM 14863
MRHLFTFGDLVLDVVATASSALEADTDTPGDVRSAPGGSAANFAVWTRRLGSPVCFATRVGDDLLGRALVDDMRREGVEVHAAVDPVYPTAVLVLFSDGVQRHMMVPRGANHFFGPGDLPEERIRTAGWLHATGYAFFWDSTREALQRALAVAREAGVPVSFDPSSAGFIRRHGLDLPEGIRVLMPNRDEARALTGCADVKDAARELARRADLVAVKLGPEGALLARAGQLTYVPPVAPSAPAVDGTGAGDAWGAALIDGLRRGLDPYRAALRANRLGAEVVTRVGARPALSPEIMRQLEVERDA

SEQ ID NO: 15354 - protein, 321 aa, Robiginitalea biformata HTCC2501
MSMARYPIRGSGTGHSAVNLRPEIPHPMSRDRGKRRSPAKKGGGMGRKGDTQRTTGVRAKKHLGQHFLTDASVAMRIAGTLSPDGPPRILEIGPGTGVLTAFLLRRPVDLLAVELDGESVKYLREVFPLELASETTSYKSFEVLHGDFLKLDLPGLFGGKPFAVTGNFPYNISTQIVFRVLENRERIPEFSGMFQREVAERICAGPGSKTYGILSVLVQAYYLAEYRFTVPPEVFDPPPKVESGVLHLRYRTDTRADWDYQHLTRLVKTAFNQRRKTLRNSLKSLPVPDYLKEDAIFDRRPEQLEVREFIALSKRIWDDTV

SEQ ID NO: 15355 - protein, 692 aa, Oryza sativa
SSCFCWPATAGALSNWSDNVGSSNYLERAIVLDEMMKSTVFSAVAVSIGYTLLGWDFTTVLEANIHMKKEFGLNNGPSIDGIILAVSVFGSIAITVFSGSLLDWLGRRAALIYSSLLLISGGLLMVWSPNIYILLLARLIVGSGSGLVFTCVPIYISETSPPNMRGSLGTMPQFMFFVGIVFSYCLIFWMTLIPSPNWRIMIGAIFAPSLVYFALLVFYLPESPRWLVSDGKISEARISLQWLRGKDDVSDRSAGEIALIADGMNMITETAVGGHAVGAVRSQSFLGTSTNQMSRHSTFYWHLSDPLVGLLGSIHESMSELGAGRNSYFPVFNSFNIVEQEQTSEQRGNDSLRQSREAYSAEEGNNGGNLQASLLSQVASAETNDINTSFTSEGSSSYLRRHGTSTSGLAQDLISSLHDHDIEEDDEEIHIAALSSQPALGAGLHPFRQQMVRLSETADIKPKWRVLLQPGVRHALCYGMLIQALQQSAGISGLLRYTPQILEQVGVISLFSDIGLDSHSASILISALNASLMLPCITAAMILMDVCGRRVLLLVSIPFLTLSVGAISLSNIVKMGSLPHEILFQLSLTICFCSYVIGLGPIPNILCSEMFPTRARATCASFCSLAFWFGRLLSIYCFPVMLSTIGLSGACAIYAFVCCLVLVFVYLRVPETKGLPLELIAEIFKFSRQECL

SEQ ID NO: 15356 - protein, 346 aa, Zea mays
MASGGGGGLGAAGAGGRMPTWRERENNKRRERRRRAIAAKIFAGLRAHGGYKLPKHCDNNEVLKALCNEAGWVVEPDGTTYRQGSKPMERMDPIGCSVSPSPCSSYQPSPRASYNASPTSSSFPSGASSPFLPPNEMPNGIDGNPILPWLKTFSNGTPSKKHPLLPPLLIHGGSISAPVTPPLSSPSARTPRMKTDWDEAAVQPPWHGASSPTIVNSTPPSPGRPIAPDPAWLAGIQISSTSPNSPTFSLVSTNPFGVFKESIPVGGGGDSSMRMCTPGQSGACSPAIPGMPRHSDVHMMDAVSDEFAFGSSTNGAQQAAGLVRAWEGERIHEDSGSDDLELTLKL

SEQ ID NO: 15357 - protein, 237 aa, Zea mays
MSGSASRKLFQAARSIVLSASQRSSFSVLAAEGRTAALANFGRKILPSACSYHRQGSHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 15358 - protein, 478 aa, Oceanospirillum sp. MED92
MLKRTKIVATLGPSTDQPGVLEDILRNGVNTVRLNFSHGSADDHKRRAEEVRQASRKLGLSIAVLGDLQGPKIRIARFKEDRIQLAVGDRFALDADLGNNDGDQSQVGIDYKALPADSSPGDILLLDDGRVQLKVVEVQGNRIDTEVIIGGPLSNNKGINRQGGGLSAAALTEKDRRDIKVAAEIDMDYIAVSFPRCAADLLEARELLNAAGSRAEIVAKVERAETVASTEALDEIILACDGIMVARGDLGVEIGDAELIGVQKHLIQRSRELNRFVITATQMMETMIENPMPTRAEVFDVANAILDGTDAVMLSAETAAGKHPVEVVKSMTSICQGAEKHQLSRPAPTNISQKLERFDETIARSAMYTANNLAGVKAIICLTESGSTPLWMSRIRSGLPIYALTRNERTMRRTALYRGVEPIFFDSTRIDKDKLNEEVLAGLKARNLLQTGDLVILTRGASLGEDGGTNSMQVLAVQ

SEQ ID NO: 15359 - protein, 947 aa, Aspergillus nidulans FGSC A4
MAQAEAQRAPGDGPRSSVSVSRASTIPAIVTSDPSGSTTNDYSLADEPSPITPVRSGLTRNSNSFPIGSAASDVASGSSGNLNQQDATTARKPLRPGPVPHGSGSGSGSGLVGRNSTSSPTVWESADSSAIDPLSQHIIKRTNTQKSIPLKLLGRASYEAEAGGSDRYSPVEQGPNRGDQAPQRPLKEKKKGVSFLSRILPGKKKDLFSDEDDNVSEMGNAGNNAAAAAQPIGFFPRFPPPPKYARVRAHYKKEKTFNRVFQAQELEGVDTSAQPDQDEHPDIGDSQNGKSTGKAIWALVFSKDGKYLAAAGQDRKVRVWQVIASPEDREVNESEGEDDELPRLKAPVFKEKPVQVYDSHSGSILDLSWSKNNFLLSSSMDKTVRLWHVSRPECLCCFKHSDFVTSIQFHPRDDRFFLAGSLDMKLRLWSIPDKSVAFNVTVPDMITSVSFTPDGRHSMAGCLNGMLNIYETDGLKPAGNIHVRSARGRNAKGSKITGIDSMVLPQNDPEGTVKLLVTSNDSRIRLYDFRDRSLEAKFRGNENACSQIRASFSDDGKHVICGSEDRRAYIWPMGPVEKDADKRAFEVLDTQSAMVTAAIMAPKSTKQILGLSEDPIYDLCNPPPVTLESNTKKENSRQSRLSTASKLAQESPGFQARSAHPDGNIIIAADYSGKIKVFRQDCAYHKRRYDSWDTHSTISRRLLRRSNSARQSIASSIGKESSHKTPSERIISWRNSVIGHDSTNNRDQQPPRTRSPSPQKAMREASRNSSPGRGSSGARGESRSAYTASPPPSAYKSSFSSPRSSFAEKRRPTGAGFGSKPEDSRAVPAPLSAAALIKGRDGNDNPRWLQGDQSYAFYNKITQDALAVHRNSPGLLDPNPRPSPERKLTRASILSSEYASSDASDADNDVLKCDSCWGTNFKATKGRNGKQRLICVRCSRPISSTAG

SEQ ID NO: 15360 - protein, 402 aa, Legionella pneumophila subsp. pneumophila str. Philadelphia 1
MKHSLATIEEAVATLKAGKMIILMDDEDRENEGDLVIAAEHATPEAINFMSRLGCGLICLPMAEELIDKLQLPMMARHNKSPYGTAFTVSIEAANGVSTGISARDRARTIQVAIDPKSGPSDIISPGHVFPLRARKRGVLERPGQTEGSVDLVKLAGLTPAAVICEIINEDGTMSRRDELALFSKKHQIPLVTIKDLIQYRVRHENLIHPVATTQIPLEENGVFTMTVFENQIDSCEHFVLVKPPLYGNQVPLVRIHSECITGDVFGSRKCDCGKQLELSLSQIGAEGGILIYLRQEGRGIGLANKLKAYALQEQGFDTVDANLELGLPADDRDYAVAYQILKYLGVEALRLLTNNPLKIASLERYGMKITQRIPLEIEPSRENHSYLKTKKIKLGHLLAID

SEQ ID NO: 15361 - protein, 233 aa, Spinacia oleracea
MEAMSGLSSPCNCISSLPHSSSTTTRHQNLLFRRNNHHQQKLAAFHSQSHLFSTKCPLISHSLPRKKSFKPHIFLPHLVASMEQVEETYIMIKPDGVQRGLVGEIISRFEKKGFKLIGLKMYPCPKELAEEHYKDLKAKSFYQKLIDYITSGPVVCMAWEGVGVVASSRKLIGATDPLQAEPGTIRGDLAVQTGRNVVHGSDSPDNGKREIGLWFKEGEICQWTPAQAPWLRE

SEQ ID NO: 15362 - protein, 274 aa, Nostoc sp. PCC 7120
MAGEFNQQKLETALQTERKYGYLPFSLHIFSTVASTNKTLWGLIDQGAVTGSVVIATQQTTGRGQWGRQWVSPTGGLYVSVALTPKVDANASYQITLATAWGIACQLRESGVNVGIKWPNDLVLEGRKLGGILTETKVSQGQISQAVVGVGINWANAVPETGINLESWQADQTHKPISCLETLTSKVLLGIESGMACLFQEGISILLSRYSELLVNMGDRVHVNDLSGIVVGVTPQGDLRVSLETDCVTDIKAPELYLEPGTISLGYRRSLGTY

SEQ ID NO: 15363 - protein, 148 aa, Spinacia oleracea
MEQTFIMIKPDGVQRGLVGEIISRFEKKGFSLKALKFVNVDRPFAEKHYADLSAKPFFNGLVEYIVSGPVVAMVWEGKGVVATGRKLIGATNPLASEPGTIRGDFAIDIGRNVIHGSDAVDSATKEIALWFPDGVVHWQSSLHSWIYE

SEQ ID NO: 15364 - protein, 423 aa, Debaryomyces hansenii CBS767
MTESSTLLEQARAASSNENFKEAESKYQEIILSKESSGQPTSKVLQDQEAAILELGKIYQNQKQPDKLNELLAYSRAVLGNFAKSKTAKIVKTLIEYFDNISDALELQIQATKDSIEWSVENKLSFLRQSLQLKLSALLYQKGSYQDALRIITDLLREYKKLDDKSSLVEVQLLESKLFHALRNIPKAKAALTSARTSANSIYCPTLLQAELDCQSGILNLEDKDYKTAFSYFYEAFEGFNSQDDDKAIVILKYMLLTKIMLNLIDDVNTILGSKNVLKYQSKDIDAMKSIATAYSNRSLKDFETSLSTYSQELRSDPIIKSNFNVLYDNLLEQNLLKIIESYSCVELSHISQTIGLNLQQVEGKLSQMILDKVFYGVLDQGNGWLIIYDEPRKDATYEASFGLVNNLSNIVDLLYEKASSLN

SEQ ID NO: 15365 - protein, 312 aa, Bacillus cereus E33L
MCINLLCKLYICFDFLVKSCSNKVVAYKKCNNERETTVHIPTTTLHNGVKMPMIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTQINTLNRNLHVGTNPDKYDTL

SEQ ID NO: 15366 - protein, 417 aa, Ralstonia eutropha JMP134
MGAPEMIKQHLIDPEICIRCNTCEDTCPIDAITHDERNYVVKADVCNACNACLSPCPTGAIDNWRTMLKGQAYPIEEQLLWDELPAEIPLPAAELDAAGTDEALRADTATAAAEGGVTVQAVETSRHTSARAPWSAAHPYVNLHGVRAPMAATVAGNYRLTAEDASSDIHHIVLDFGTHFFPVLEGQAIGIVPPGTDAAGKPHYIRMYSVASPRDGERPGYNNLALTVKRVEEDHDGNPVRGVASNFLCDLAKGDTVQVVGPFGTTFLMPNHREASIMMICTGTGSAPMRAMTERMRRNMEHFGGRRMLFFGARNARELPYFGPLLKLPKDFLDIHFAFSRDAEVPRRYVQDAIREASAGVTALLSDPHGHVYICGLKGMEEGVLAAFGDVCAASGMSWPELEATMKAEGRLHIETY

SEQ ID NO: 15367 - protein, 564 aa, Legionella pneumophila str. Lens
MHHSLPLITTIAMGFALALILGLIATRLKIPPLVGYLLAGVAIGPYTPGLMADISIAHELAEIGVMLLMFGVGLHFSLSDLMRVRKIAIPGAIVQILAATILGGCIAILWDWNYGSALIFGLSLSVASTVVLLRALEERRALESINGHIAVGWLLVEDLAMVVVLVLLPPLAHWLGDSTAVGTHNQSLFFIFGLTLVKVSAFIAFMLLVGRRYFPKLLWLVARTGSRELFTLCVITAAISIAYVASKLFGVSFALGAFFAGMIMRESSFSHRAAEESLPLRDAFAVLFFVSVGMLFNPAVLFEQPLQILMVVGIIVIGKSIAAFVLVLAFRYPLQSALIVSASLAQIGEFSFILAELGVRLGMLPAEGQSFILAGALISIAINPLIFKLINPVHAWIKSYPRLLHLFERAHDSLAELPMSTKEEYLAGQVVLVGYGRVGKRVAHLLSEKNIPFVVVEENRELITSLRAAGLPAVYGDASEPSVLIQSHITHASMLLIVIADTVHLRKMIQYAYQLNPKIEIVVRTHDEEEAALLQREITGKVFFAEGEIAKNMGEYALSRYGKS

SEQ ID NO: 15368 - protein, 530 aa, Corynebacterium efficiens YS-314
MSQNGRPVVLIADKLAQSTVDALGDAVEVRWVDGPNRPELLEAVKEADALLVRSATKVDAEVIAAAPNLKIVGRAGVGLDNVDIPAATEAGVMVANAPTSNIHSACEHAVSLLLSTARQIPAADATLRDGEWKRSSFNGVEIFGKTVGIVGFGHIGQLFAQRLAAFETTIIAYDPYANPARAAQLGVELVELEELMGRSDFVTIHLPKTKETAGMFDAELLAKAKKGQIIINAARGGLVDEQALADAIESGHIRGAGFDVYETEPCTDSPLFKLPQVVVTPHLGASTEEAQDRAGTDVADSVLKALAGEFVADAVNVSGGKVGEEVALWMELARKLGLLAGKLVDGAPVSLEVTARGELSSEDVSALGLSAVRGLFSGIIEEPVTFVNAPRIAEERGVSVDVKTNSESVTHRSVIEVKVVTGEGNTASVVGALTGLERVEKITRINGRGLDMRAEGRNLFLEYTDAPGALGTVGTKLGAAGINIEAAALTQAAKGDGAVLILRVEREVPEELVEEITAELNADSFQVNLG

SEQ ID NO: 15369 - protein, 211 aa, Buchnera aphidicola str. Bp (Baizongia pistaciae)
MTQNLLDQFGTPKTRVKNAISALRYGHGIIVLDNEDRENEGDLIFSGETMTTEQMALTIRYGSGIVCLCITESKRKQLKLPMMVQNNTSKFGTNFTVTIEAAEGISTGVSAKDRLTTIRAAINDNAKPSDLNRPGHIFPLQAHKNGILGRIGHTEAAIEFVTLAGFKPAGIICELTNRNGTMSKVPDIIKFSKLKKMTIVTIRDLIQYISR

SEQ ID NO: 15370 - protein, 325 aa, Methanosarcina mazei Go1
MGDKRSRIIKALKDAQKTPVSGEELGLKLGISRTMVWKYIKSLQADGYEIESSPKRGYVLKSVPQLLYPDEIQMGLKTTLLGKKIHYFEEVSSTNSVAKEIAASEEEGALVIAEIQKGGRGRMGREWVSPHGGIWMSVILKPGIPLRHASRLTLVAGLAVANVIRDMGLDARIKWPNDVRINGKKVCGILTEAKAEVDRVDYVVLGIGINVNMDLKDIPESFRAGSTTLKVELGKHIRRVSFLQDFLFELEQQYISFKTQPFSHILNDWLALSDTIGREVKVTTPSRIIEGRAVGVTPDGALIIRKADNTKEEIIAGRCIYARPK

SEQ ID NO: 15371 - protein, 184 aa, Triticum aestivum
  misc_feature (95)..(95): Xaa can be any naturally occurring amino acid
  misc_feature (115)..(115): Xaa can be any naturally occurring amino acid
  misc_feature (141)..(141): Xaa can be any naturally occurring amino acid
  unsure (1)..(184): unsure at all Xaa locations
VEPEILVDGPHDIDRCAYVTEIVLAACYKALNDQHVLLEGTLLKPNMVTPGSDSKKVAPEVIAEYTVRTLQRTVPAAVPAIVFLSGGQAEKKATXNLNAMNNSRPRTLGTVLSFXRASSKTPQGWSGKTENKRKARRVLVXCKAIRTSGLQGKHLAKAPPKAHRTQYDYLRLRWLRYIQCIVVL

SEQ ID NO: 15372 - protein, 411 aa, Streptococcus pneumoniae TIGR4
MDFSRKDNQSMEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKGGVLERNGHTEATVDLLKLAGLKECGLCCEIMNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAKMLKDLGLQSLHLLTNNPDKVEQLEKYGITISSRISIEIEANPYDSFYLETKKNRMGHILNMEEK

SEQ ID NO: 15373 - protein, 427 aa, Ralstonia eutropha JMP134
MFAAADAAVFASADIAVKPIQKSNKLNNVCYDIRGPVLEKAKQMEEEGHKIIKLNIGNLAVFGFDAPEEIQQDMMRNLPNSAGYSDSKGIFAARKAIMHYTQQKNIQGVGLEDIYVGNGASELIVMAVNALLNSGDEVLVPAPDYPLWTAAVSLSGGTPVHYICDESNEWMPDPADIRARITPHTKAIVIINPNNPTGALYSDELLLEIVAIAREHGLIIFADEIYDKVLYDGNVHTSIASLSTDVLTVTFNGLSKNYRSCGYRAGWMVVSGDKRPALDYIEGLNMLSSMRLCANVPGQWAIQTALGGYQSINDLVAEGGRLRRQRDLAYELITAIPGVSCVKPKAALYLFPKLDLSMYPVQDDQEFIYELLQESKVLLVQGSGFNWDKPDHFRIVFLPHEEDLREAINRIARFLEAYRKRHGKVAA

SEQ ID NO: 15374 - protein, 376 aa, Pisum sativum
MADAEDIQPLVCDNGTGMVKAGFAGDDARAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLESGDGVSHTVPIYEGYALPHAILRLDLAGRDLTESLMKILTERGYMFTTSAEREIVRDIKEKLAYVALDYEQELETAKSSSSIEKNYELPDGQVITIGAERFRCPEVLFQPSMIGMEAAGIHETTYNSIMKCDVDIRKDLYGNIVLSGGTTMFPGIADRMSKEITALAPSSMKIKVVAPPERRYSVWIGGSILASLSTFQQMWISKAEYDERGPSIVHRKCF

SEQ ID NO: 15375 - protein, 842 aa, Arabidopsis thaliana
MVVSVTIRRRFVLLLLACTCLLSRRLCFGEDRITFSSPIKDSESETLLCKSGIFRFGFFTPVNSTTRLRYVGIWYEKIPIQTVVWVANKDSPINDTSGVISIYQDGNLAVTDGRNRLVWSTNVSVPVAPNATWVQLMDSGNLMLQDNRNNGEILWESFKHPYDSFMPRMTLGTDGRTGGNLKLTSWTSHDDPSTGNYTAGIAPFTFPELLIWKNNVPTWRSGPWNGQVFIGLPNMDSLLFLDGFNLNSDNQGTISMSYANDSFMYHFNLDPEGIIYQKDWSTSMRTWRIGVKFPYTDCDAYGRCGRFGSCHAGENPPCKCVKGFVPKNNTEWNGGNWSNGCMRKAPLQCERQRNVSNGGGGGKADGFLKLQKMKVPISAERSEASEQVCPKVCLDNCSCTAYAYDRGIGCMLWSGDLVDMQSFLGSGIDLFIRVAHSELKTHSNLAVMIAAPVIGVMLIAAVCVLLACRKYKKRPAPAKDRSAELMFKRMEALTSDNESASNQIKLKELPLFEFQVLATSTDSFSLRNKLGQGGFGPVYKGKLPEGQEIAVKRLSRKSGQGLEELMNEVVVISKLQHRNLVKLLGCCIEGEERMLVYEYMPKKSLDAYLFDPMKQKILDWKTRFNIMEGICRGLLYLHRDSRLKIIHRDLKASNILLDENLNPKISDFGLARIFRANEDEANTRRVVGTYGYMSPEYAMEGFFSEKSDVFSLGVIFLEIISGRRNSSSHKEENNLNLLAYAWKLWNDGEAASLADPAVFDKCFEKEIEKCVHIGLLCVQEVANDRPNVSNVIWMLTTENMSLADPKQPAFIVRRGASEAESSDQSSQKVSINDVSLTAVTGR

SEQ ID NO: 15376 - protein, 376 aa, Pisum sativum
MADAEDIQPLVCDNGTGMVKAGFAGDDARAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTESLMKILTERGYMFTTSAEREIVRDIKEKLAYVALDYEQELETAKSSSSIEKNYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWISKAEYDERGPSIVHRKCF

SEQ ID NO: 15377 - protein, 380 aa, Pisum sativum
MSNTVGQIIKCRAAVAWEAGKPLVIEEVEVAPPQAGEVRLKILFTSLCHTDVYFWEAKGQTPLFPRIFGHEAGGIVESVGEGVTHLKPGDHALPVFTGECGECPHCKSEESNMCDLLRINTDRGVMLNDNKSRFSIKGQPVHHFVGTSTFSEYTVVHAGCVAKINPDAPLDKVCILSCGICTGLGATINVAKPKPGSSVAIFGLGAVGLAAAEGARISGASRIIGVDLVSSRFELAKKFGVNEFVNPKEHDKPVQQVIAEMTNGGVDRAVECTGSIQAMISAFECVHDGWGVAVLVGVPSKDDAFKTHPMNFLNERTLKGTFYGNYKPRTDLPNVVEKYMKGELELEKFITHTVPFSEINKAFDYMLKGESIRCIIKMEE

SEQ ID NO: 15378 - protein, 335 aa, Robiginitalea biformata HTCC2501
MQRKNKTLGEFIIENQQEFQYSTGELSKLINAIRLAAKVVNHEVNKAGLVDILGAAGETNIQGESQQKLDVLANEKFKQTLQNREIVCGIASEEEDDFITINSQDEQHQNKYVVLIDPLDGSSNIDVNVSVGTIFSIYRRVTPIGSPVSLEDFLQPGVNQVAAGYIIYGTSTMLVYTTGHGVNGFTLNPAIGTFYLSHPNMQFPETGRIYSVNEGNYTHFPQGVKDYIKYCQKEEDDRPYTSRYIGSLVSDFHRNMIKGGIYIYPKSSTAFNGKLRLLYECNPMAYLAEQAGGRASDGYRRILEITPTELHQRVPFFCGSRKMVEKAESFMAQYA

SEQ ID NO: 15379 - protein, 141 aa, Oceanobacter sp. RED65
MAVERTLSIVKPDAVGKNVIGEIYSRFEKAGLQIVAAKMIKMDEEMAGGFYAEHKERPFFKDLVGFMTSGPVMVQVLEGEGAVLKNRELMGATNPQEADAGTIRADFAESIDANAVHGSDSTESAAREVSYFFNEEEICPR

SEQ ID NO: 15380 - protein, 309 aa, Hypocrea jecorina
MVATSFKLNNGLEIPAVGLGTWQSKAGEVKAAVSYALQIGYKLIDGAYCYGNEDEVGEGLKEAFAAGVKREDIFVVTKIWATYNTRVVLGLDKSLRSLGLDYVDLLLVHWPVLLNPEGNHDKFPTLPDGKRDVIWDYNHVDGWKQMEAVLATGKTKSIGVSNYSKKYLEQLLPHATVIPAVNQIENHPSLPQQEIVDFCKEKGIHIMAYSPLGSTGSPLMSADPVVKIAEKKGISPTTVLLSYHVNRGSTVLAKSVTPARIKANLEIVDLDDEDMKLLNDYSNDLASKGELKRYVYPPFGIDFGFPDKS

SEQ ID NO: 15381 - protein, 457 aa, Bacteroides fragilis NCTC 9343
MNRENKPLFLYTFITVFGGLIVGLNMAGISGAVPFLQEQFMLDDMALGLVVSILTVGCLCGALLGGGFSDRYGRQKVMFSSAVFFIVSSLGCALSGNLVSLLVFRLICGLGIGVISAVAPIYISEISPARLRGTLVSYNQLAIVIGILIAYIVDYILLDYERNWRLMLGFPFFFSVAYLLLLGILPESPRWLSARGKAGRARQVASKLNLEAGEMTVSDTNTQEGRDRIKVTELFKGNLAKVVFIGSILAALQQITGINVIINYAPSIFEMTGVAGDIALVQSILVGVVNLLFTLIAVWLVDKVGRKILLLCGSLGMGISLLYLVYTFVVPAANGIGALIAVLCYIGFFAASLAPLMWVVTSEIYPSRIRGTAMSLSTGISWLCTFLTVQFFPWILNNLGGSVAFGIFAIFSIAAFAFILFCVPETKGKSLEAIEKELGVDKEAEENVKEEHAFSKI

SEQ ID NO: 15382 - protein, 983 aa, Nostoc sp. PCC 7120
MVSYASIPQSSDEAHSTVGASLQLDERKQDLNNFIQRHIGPSSADIQQMLDVLGFSSLDDLIEKTVPSAIRLHEQLQLPEAQTEYAALAKLKQIASKNQVFRSYIGMGYYDTITPSVIGRNILENPGWYTAYTPYQPEIAQGRLEALLNFQTMIIDLTGLEIANASLLDEATAAAEAMSMSYGVSKNKANAYFVSHDCHPQIIDVLQTRAKPLGIEIIIGDHQTFDFDKPIFGAVLQYPASDGTIYDYRAFIETSHAQGALVTVAADPLSLTLLTPPGEFGADIAVGSTQRFGIPLGFGGPHAAYFATKEEYKRQVPGRIVGVSKDVHGKTALRLALQTREQHIRREKATSNICTAQVLLAVMASMYAVYHGPEGLKQIAERIHHLTLVLGVWLQRLGYTITSQSFFDTLQIKLGEKPLQEILEAAEAYRINLRIVDTSTVGISLDETTTLEDVKDICRIFAGTDELPFVLNVQEFDWIIQQSSLKDEPFSRQSSYLTHPVFNRYHSETELLRYLHRLETKDLSLTTSMIPLGSCTMKLNATSEMIPVTWEEFGRIHPFAPLTQTRGYQILFQQLEAWLGEITGFAGVSLQPNAGSQGEYTGLLVIRQYHQSRGETHRNVCLIPNSAHGTNPASAVMCGMKVVAVACDAGGNIDIDDLKAKAEKHSHELAALMVTYPSTHGVFEAGIQEICAVIHSHGGQVYMDGANMNAQVGICRPGDIGADVCHLNLHKTFCIPHGGGGPGMGPIGVASHLVPFLPGHPVLESGKNPQNIGAVAAAPWGSASILVISWMYIVMMGADGLTQATKVAILNANYIAKKLAAYYPVLYKGQNGLVAHECILDLRALKKSANIEIDDIAKRLIDYGFHAPTVSWPVAGTIMVEPTESESQAELDRFCEALIAIRQEIADIEAGKVDIQDNSLKNAPHTVESLIVGEWPHPYSREQAAYPAPWTREHKFWPSVGRIDAAFGDRNFVCSCLPMDAYN

SEQ ID NO: 15383 - protein, 400 aa, Aspergillus nidulans FGSC A4
MAPRTMKALNYVGPFNVKVQEVEMPCLEHPDDIIVKITSAAICGSDLHMYEGRTAAEAGITFGHENLGIVEELGDGVTLLKKGDRVVMPFNVADGRCRNCEDGKTAFCTGVNPGFAGGAYGYVAMGPYRGGQAQYLRVPYADFNALKLPPGTEHEADFILLADIFPTGWHGIEISGFQPGDSVAVFGAGPVGLMAAYSAQIRGASRVYVVDRVPERLRAAEKIGAVPIDFTAGDAVDQIIAANGGEMVDRSVDAVGYQAVSGTKDNATEVPNIVLENMIRVTRACGGLGIPGLYVPSDPGAGDTATAKGMISLSFGKLFEKGLTLGTGQCNVKAYNRQLRDLIIAGKARPSFVVSHEISLDEAEIAYDKFDKRIEGYTKVIIHPNGGFQDKRPPVVNSPL

SEQ ID NO: 15384 - protein, 850 aa, Arabidopsis thaliana
METSSIEINELPLATKTQTPPASVEPIPMETSSIDELPSSDSNATDNIEAVGEKRKRADEDEKTNLESSDTKITTPSPWWKTSLCSYFRREASCSHGNECKYAHGEAELRMKPDNTWDPTSERGKKAKAMKMSEHEEKEEDEVLFTEQMMESIDGDEGGGGSVSVVDLSLSKCLVHLPNKWQSDELKKFLGEQGVLYKSAKKRRGMIVGFVTFENAEQLQSGVERMLYRNVFNVLQILDGKTVNSSNLKIADVLPRTFDKNDARKSVKSARDAVTPLAYLSYADQLEQKKTSIGQMLKKLVRSFVFLFELVRGMRVKLVQMGIHFHNGSLHRETEGIIESPITNGYRNKCEFSVGLSLQGKPTVGFSLGSFCAGVTAVEEPVDCPNVSKIASQYASIFQKFIENSKFQVWNRFQHSGFWRQLTVREGRKPGVFSNDEDAITRIAEVMLMVQVCVLNGKVATEFEELAKAFAEGARASSPTLPLTVLVVQNHSGISNVAPPDAPLQVLAIPISDNGTDQEQTTNVLTEARIHDHINNLRFSISPTAFFQVNTVTAEKLYSIAGDWADLGPDTLLFDVCCGTGTIGLTLAHRVGMVIGIEMNASAVADAERNATINGISNCKFICSKACILTVTYFVVGSIVLICLHGSSVGFVVQAEDVMSSLLKQYLDVTQMEEAKPLSNANDDLNKQIPSTEEMTNSEHVADQNLPPSNTQVEELQDNEQKDSSSLEPEKTTKPQFKNVVAIVDPPRSGLHPAVIKALRTHPRLKRLVYISCNPETLVANAIELCTPSFDEPDRGNKNYRGRKKIGIAALARHRAKSMPTSEAFRPVKAMAVDLFPHTDHCEMVMLLER

SEQ ID NO: 15385 - protein, 470 aa, Yersinia pestis CO92
MLMLLPVIMAGGAGSRLWPLSRALYPKQFLALTSDLTMLQETLLRLDGLPHLAPLVICNEEHRFIIAEQLRQKNLVHSGIVLEPVGRNTAPAIALAALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 15386 - protein, 639 aa, Glycine max
MPALVNYSGDDELYPGGSFCPNPVELGRLYTTIGSNLDVYYPPTKRPRSIFEAIEREQYYQEPGIEVLPDECLFEIFRRLPSGKERSSCACVSKRWLMLMSTICKDEIERATSVDETVSSDENQDIEDDGYLTRCLDGKKATDVRLAAIAVGTSSRGGLGKLLIRGSNSERGVTNLGLSAVAHGCPSLRSLSLWNVSTIGDEGVSQIAKGCHMLEKLDLCHCSSISNKGLIAIAEGCPNLTTLTIESCPNIGNEGLQATARLCPKLQSISLKDCPLVGDHGVSSLLASASNLSRVKLQTLKITDFSLAVICHYGKAITNLVLSGLKNVTERGFWVMGAAQGLQKLLSLTVTACRGVTDTSIEAIGKGCINLKHLCLRRCCFVSDNGLVAFAKAAISLESLQLEECNRFTQSGIIVALADIKTKLKSLALVKCMGVKDIDMEVSMLSPCESLQSLAIQKCPGFGSASLATIGKLCPQLQHLNLTGLYGITDAGLLPLLENCEAGLVNVNLTGCWNLTDNIVSALARLHGGTLEVLNLDGCWKITDASLVAIANNFLVLNDLDVSKCAITDAGVAVLSRASLPSLQVLSLSGCSDVSNKSAPFLTKLGQTLLGLNLQNCNSIGSSTMELLVEKLWRCDILA

SEQ ID NO: 15387 - protein, 480 aa, Candidatus Pelagibacter ubique HTCC1002
MYEKFGQFIDGSWSPSSNKETYEVINPATEEVLGHASKATPEDVDRALKSAEKGLAVWKKITPWERSYILRRIADKLREKKDVLAKWMTLENGKPLAEGVGETNGAADIFEWNAEETKRIFGQTIESRFEDTRVHVYYQPVGVVAALSPWNFPLILAARKISTALAAGCSVIIKPDTITPGVVMELVDICRECGVPPGAVNLLSGDPPAIASQLIQSDIIKKISITGSLRVGKLILKQAADKVQRATMELSGHSPFIVFDDADVKKAADMAIAAKFRNNGQVCISPNRFYIHENKKEEFINLFIEKTKKLKIGNGMDPDTQLGPLTTQKRLNETEELVEKTKQEGAKVLLGGKRPAGFNKGFYYEPTIFDDVKDDFTIMKQEPFGPLVPMLSFKSFDEVIERANDNDLGLCSYVCTNSMETAHLASEKLETGSVAVNTGVVAIAEAPFGGIKQSGYGREGGSMAIKDYLNVKYTHMGIKG

SEQ ID NO: 15388 - protein, 215 aa, Streptococcus pyogenes M49 591
  misc_feature (198)..(198): Xaa can be any naturally occurring amino acid
  misc_feature (206)..(206): Xaa can be any naturally occurring amino acid
  unsure (1)..(215): unsure at all Xaa locations
APDTIDDEALVMLSDILPTSYEIDVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFXHAGANNAXEVIIDNDIS

SEQ ID NO: 15389 - protein, 435 aa, Agrobacterium tumefaciens str. C58
MTLDLSKFAAEKGIKYFMISYTDLFGGQRAKLVPAEAIADMQKGGAGFAGFATWFDLTPAHPDLFAVPDASSVIQLPWKKDVAWVAADCVMEDQPVEQAPRVMLKKLIAEAAGEGLRVKTGVEPEFFLISPDGAKISDEYDTAEKPCYDQQAVMRRYDVIAEICDYMLELGWKPYQNDHEDANGQFEMNWEYDDALQTADKHSFFKFMVKSVAEKHGLRATFMPKPFKGLTGNGCHAHISVWDMDGKVNAFADKEMPFGLSAKGKTFLGGIMKHASALAAVTNPTVNSYKRINAPRTISGATWAPNTVTWTGNNRTHMVRVPGPGRFELRLPDGAVNPYLLQAIIIAAGLSGVRSKADPGPHYDIDMYREGHTVTDAPKLPLNLLDALREYEKDAELQQALGMEFSKAYLKLKQGEWNSYCAQFTAWEHQTTLDV

SEQ ID NO: 15390 - protein, 456 aa, Enterococcus faecalis
MTQQLVKKGQQISLKIKRLGINGEGIGYYKKLIIFVPGALPKEEVTATITNVTPKFAEGTLQSVKKAAKDRVVPPCPVYETCGGCQLQHLAYKAQLDFKKDLLKQALNKFKPANYQNYELRKTIGMDNPWNYRNKAQFQLRQIDGQVEAGLYQADSHQLVPIDNCLVQQPATTKVMNTLVDLLNDFQLPIYDERKNSGIFRTLMVRVGIQTGEVQVVFITQSQKFPQKEKMVRAINEQLPEVVSIMQNVQNKKTSLVMGDDTLHLWGKESIEEHINDVVFDLSPRAFFQLNPEQTEVLYNEGIKALDLQPNETVVDAYCGVGTIGLSLAKQAHQVRGMDTIPAAIDDARFNAKRLGVTNTHYAVGTAEDLLPKWFKEGFKPDAIVVDPPRTGLDRKLLTALLKQPPKKMVYISCNVSTLARDLVQLAKVYQVDYLQSVDMFPQTARCEVVVKLTRK

SEQ ID NO: 15391 - protein, 418 aa, Neisseria meningitidis MC58
MANKLRNYTINFGPQHPAAHGVLRMILELDGEQIVRADPHIGLLHRGTEKLAETKTYLQALPYMDRLDYVSMMVNEQAYCLAVEKLVGIDVPIRAQYIRVMFAEVTRILNHLMGIGSHAFDIGAMTAILYAFRDREELMDLYEAVSGARMHAAYFRPGGVYRDLPDFMPKYEGSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCSEWLRVNPGPVITTNHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 15392 - protein, 587 aa, Cryptococcus neoformans var. neoformans
MLSADQRQRAPFAHKSSCANLTATQPSALRSPFPPQSHWPTPPSAEGHQLQLTSDRSKWAQYPSPRKISNETCQAGFSDHPYAFGGIGATYSLDTPTSRRHSLPSLFNPNTHRRAFTFPSMSLPNPATVRFISLCFLWYACSAISNNTGKVILNHFKYPVTLTIVQFFFVAFYCAISSQKMLGWTGRLRQPTKNILKGTLPLAAFQVGGHIFGSMAISRVPVSTVHTIKALSPLFTVMAYALLFGVSYSPATYLSLLPLTLGVMLACSFDISFSNIFGLVCALGSTIVFVSQNIFFKKIMPTTSTNEVNSSSKLDKINLLYFSSSMAFILMIPLWIYSDARRLIDLWINPAASESGTSVLFYFFLNGTVHFAQSIIAFALLASTSPVTYSIASLVKRIAVICLAIIWFKQPVHTVQALGIVLTGAGLWMYNNAKRDVDRGEIKMRHVEALREGVLPSTKMDQCILEGSGIELSYKSAHNSPKPTYPNNYIDLPSSTTTAVNKTTFQVPPILDHTSHIEAPYPSPPASISSSPPADITYLGISKGRQHWLSGEGERFRPPVLNSIRSSVMEEARETGVNEGMAAVVTT

SEQ ID NO: 15393 - protein, 394 aa, Bacillus licheniformis ATCC 14580
MNLAKRVSALTPSATLAITAKAKELKAAGHDVIGLGAGEPDFNTPEHIIEAAVRSMNEGHTKYTPSGGLAALKDSIRDKFKRDQGIEYSQSEVIVCTGAKHALYTLFQVLLDEGDEVIIPTPYWVSYPEQVKLAGGKPVFVEGLEENSFKISPEQLEKAVTEKTKAVIINSPSNPTGMMYTEEELKALGEVCLRRNVLIVSDEIYEKLIYGGKKHVSIAQLSPELKNQTVIINGVSKSHSMTGWRIGYAAGSEPIIKAMTNLASHSTSNPTSVAQYGAIAAYNGPNEPVEEMRKAFEERLNKVYELLVDIPGLTCLKPEGAFYLFPNAKKAAESCGFSSVDEFAEALLEEEKVAIVPGSGFGAPDNIRLSYATSLSLLEEAVERIRRFVVNRSR

SEQ ID NO: 15394 - protein, 402 aa, Bradyrhizobium japonicum USDA 110
MTIFVPAARVSRIKISPTTAASARVRELKAAGRDIVDMAIGEPDFDTPDHVKTAAHEAIDRGETKYTAVNGTVALRKAIIADYKRRLGLDYADNEICVGGGAKQILFLALMASVEEGAEVIVPAPYWVSYPDMVIANDGKPVIVRCSENQGFKLTAEALEAAITPKTRWLILNAPSNPTGAAYSRADLKAIGDVLLRHPDVLVLSDDIYDQIWYRDEPATTLAAAVPELKDRVLLANGVSKTYAMTGWRIGYAAGPAPLVAAINKLQSQMSSCPSSISQAAAAHALTSDQSFVRDSVKLYKERRDYACARLNAIPGLSCLVPDGAFYLYPGCAGVIGKTTPGGKVIESDLDFVLYLLDDVGVAAVQGAAYGLSPYFRLSIATSMEAIKAACDRIEKACRALR

SEQ ID NO: 15395 - protein, 221 aa, Petunia axillaris subsp. axillaris
MFESRLMSVLFIFLFALSPVYGTFEYMQLVLTWPISFCHTKHCERIPTNFTIHGLWPDNKNALLNNCVPDATYNKITNPELLKQMDYRWPELTSKEIDGKKKQGLWGHEFLKHGTCCTGYDTEEAYFKLAMGLKDRFDLLKILSARGIIPGTTHTLDNIQKAIKAVTRALPNLYCSSDPKRPRMELLEIGICFDPKATSVIVCRRYKTCHTDGTTLIDFPG

SEQ ID NO: 15396 - protein, 959 aa, Synechococcus sp. WH 8102
MTSPFLQRHVGPSDSEQQQMLSALGYADMAAFLADVVPEDILDEFPPQGLLPPGCGEAEALVHLREIAAANNSRRSLIGLGYYGTSTPALIQRHVFENPAWYTAYTPYQAEIAQGRLEALLNFQTLISELTGLPIANASLLDEATAAAEAMSLSYGICRRTEANRFLVDANVLPQTWAVLQTRAEPLGIDLERVTPEQASFDASVFGVLLQLPGADGQIWDPTAVIARAHEAGALVTVAIDPLAQALIAPVASFGADIAVGSAQRFGVPMGFGGPHAAFFATKDTYKRQIPGRLVGQSRDSAGNPALRLALQTREQHIRRDKATSNICTAQVLLAVMASFYAVHHGPEGLMSIARRIVGQRRQLERALQSLGFVVPDGERFDTVTVTSALAPAVHQAVGEAGFNLRVLPDGANPAESTGFGIALDECTTADELSRLVAALATAAGQTSPSLPLAPVEELCGVPERVDPWLSQSVFHDHLSETELMRYIQRLVSRDLSLVHGMIPLGSCTMKLNAAAELLPVSWPAFAGLHPFAPMAQAAGYQRLAEQLEAWLAALTGFAAVSLQPNAGSQGEYAGLLVIRAWHRSRGDDHRDVCLIPTSAHGTNPASAVMAGLKVVAVACDADGNIDQQDLAARAAEHADRLAALMVTYPSTHGVFETGIRGICELVHRHGGQVYLDGANLNAQVGLCRPGAFGADVCHLNLHKTFCIPHGGGGPGVGPIGVADHLAPFLPGHPMQASPDQAIGPVSAAALGSASILPISWMYLRMMGAEALRQATAVALLSANYLALRLDPHYPVLFRGATGRVAHECILDLRPLKRDAGIDVDDIAKRLMDYGFHAPTVSWPVAGTVMVEPTESESLAELDRFADAMIAIRNEIRDIESGAMDASNNPLKQAPHTMAAVIAEDWDRPYSRQQAAFPLPDQQQNKVWPAVARIDNAYGDRNLICTCPSVEEIAVAVAA

SEQ ID NO: 15397 - protein, 386 aa, Glycine max
  misc_feature (157)..(157): Xaa can be any naturally occurring amino acid
  unsure (1)..(386): unsure at all Xaa locations
SARVGINNYGMPCFFGCTLLRDETVRSFSWALKAFLGFMNGKAPQTILTDQNICLKEALSTEMPTTKHAFCIWMIVAKFPSWFNAVLGERYNDWKAEFYRLYNLESVEDFELGWREMACSFGLHSNRHMVNLYSSRSLWALPFLRSHFLAGMTTTGXSKSINAFIQRFLSAQTRLAHFVEQVAVAVDFKDQTGEQQTMQQNLQNVCLKTGAPMESHAATILTPFAFSKLQEQLVLAAHYASFSIEDGFLVRHHTKAEGGRKVYWAPQEGIISCSCHQFEFTGILCRHSLRVLSTGNCFQIPDRYLPIRWRRINMPSSKLLQSAPNDHAERVKLLQNMVSSLMTESAKSKERLDIATEQVTLLLSRIREQPISLQVGRDISSINRNL

SEQ ID NO: 15398 - protein, 401 aa, Saccharomyces cerevisiae
MIMKKFLFPSDELVKIDNISFFNQCVLLFLESKGSHSISKPLGFTHIKSQESYISKMPPKKGKQAQAAGKKKDNVDKTFGMKNKNRSTKVQKYIKQVQSQSDPKKEEMRLKKLEEKKRREAEEAERRALFNPVADQRVRAGVDPKSMVCALFKLGNCNKGAKCKFSHDLNVGRRMEKKDLYQDTRSEKENDTMDNWDEEKLRKVILSKHGNPKTTTDKVCKYFIEAVENGKYGWFWICPNGGDKCMYRHSLPEGFVLKTNEQKRLERESLEKQPKITLEEFIETERGKLDKSKLTPITIANFAQWKKDHVIAKINAEKKLSSKRKPTGREIILKMSAENKSFETDNADMPDDVTQGSAWDLTEFTDALKKADHQDDGGIKDYGDGSNPTFDIKKANSATLA

SEQ ID NO: 15399 - protein, 707 aa, Triticum aestivum
GDSFWHPSDTMLSGMRISVNAEVRAQVRGPPERMLFTSWASDTDPSPGRFALGLDPANPSQAFIWRDGNVPFWRSGQWTGLNFVGIPYRPLYVYGYKQGNDPILGMYFTYTATNTSLQRFVVAPDGRDVCYMVKKSTQEWETVWVQPSNECERYGACGSNAICTVVQDGKANVFPSKGFKPKLADEWNAGNRSQGCVRNPPLDCQVNKTGDGFLSIPNVKWPDFSYWVSGVTDEYGCMNTCQQNCSCGAYVYMTQLTGCLHWGSELMDVYQFQAGGYALNLKLPASELGSHIAVWKIAAIASAVVLFVLLACLFLWWKRGRNIKDAVHRSWRRSRRSSTRSQQSAGMLDISHSIPFDDETEDGKSHELKVLSLDRIKAATGSFSESNKLGEGGFGPVYMGTLPGGEEVAVKRLCKNSGQGHEEFKNEVILIAKLQHRNLVRLLACCIQGEEKILVYEYMPNKSLDAFIFNPEKRGLLDWRTRFDIIEGIARGLLYLHRDSRLRIVHRDLKASNILLDTDMNPKISDFGMARIFGGDENQFNTNRVVRTFGYMSPEYAVEGIFSVKSDVYSFGVLILEIITRPPTRPGKRAVSFHGQQESLNIAGYAWQQWNEDKGEEMIDPLIKPSCSIRQVLRCIHIALLCVQDHAQERPDVPAVILMLSSDSSSLPMPRAPTLMLRGRALESSKSSENERSHSIGTVSMTQLHGR

SEQ ID NO: 15400 - protein, 482 aa, Idiomarina loihiensis L2TR
MNNEQVLQPDNVELIKNSRVGTSTKSSIAVDDPATGHVIGHVPDLTPRQILRAIESAETAFYKWRDVPLRERCEKLFRWYQLMHEKEEELAGILTSEQGKPLSESRGEIRYAASYIQWYAQPSLQDQGSVLPYSSIDESMIVITEPVGVCAAITPWNFPAAMITRKVAPALAAGCTMLVKPALETPLTAIAIAELAIQAGIPEGVLSIVTGDGEAIGKIFSESAVVRKLSFTGSTRVGRLLMASSASTIKRLSLELGGNAPFIVCETADVERAVQGAIQSKFRNAGQTCVCANAFYIHTKVYDEFTEKFIACVNQLMLGNGKNESVDIGPLINENALEKVEQIVADAVKKGAVIACGGERWVNSERWYYPTVLLNADSSMRCVNEEIFGPVAPIVRYNDETALLEELRQQQTGLAAYFYSQNLGQVNRLSRALEVGMIGVNSGVISDAAVPFGGVKSSGIGREGGRHGIEEYLETKYIKLSY

SEQ ID NO: 15401 - protein, 400 aa, Bradyrhizobium japonicum USDA 110
MPELANRLKTVKVSASAAMTDKARELRDAGVKIVGLSSGEPDFPTPPHAIEAAHRAALAGDTKYPAQPGTVALRTAVQRKFKRENNLDYALDEILIANGGKQIIFNALFATCNPGDEVVIPAPGWITYADIVLLAEATPVAVPCPENNQFKLRPTDLDAAITPRTKWLILNFPNNPTGAACTRDEMCAIADVMLKYPDVWILTDDIYEHLTYDGFEFCTIAEVEPRLKNRVVTVNGASKAYAMTGWRVGYCGGPKDLIAAMNNVHGQATGGICTLSQAAAVAVLDGPQEFLKERADIYRDRRDLVVKLLNQIPGITCHKPEGAFYVFPNIAGCIGKTTKGGRRLDTDADFISALLEEQHVAAVPGGAYGMSPYFRISYATDTESLKEGCRRIANFCESLR

SEQ ID NO: 15402 - protein, 408 aa, Streptomyces coelicolor A3(2)
MSAAIPPTERRVSARVGAISESATLAVDAKAKALKAAGRPVIGFGAGEPDFPTPDYIVEAAVEACKNPKFHRYTPAGGLPELKAAIAAKTLRDSGYEVDPSQILVTNGGKQAIYEAFAAILDPGDEVIVPAPYWTTYPESIRLAGGVPVEVVADETTGYRVTVEQLEAARTEKTKVVLFVSPSNPTGAVYGEAETEAIGRWAVEHGLWVLTDEIYEHLVYGDAVSVSLPALLPELRDKCIVVNGVAKTYAMTGWRVGWVIGPKDVVKAATNLQSHATSNVANVSQAAALAAVSGNLDAVAKMREAFDRRRQTIVRMLNEIDGVLCPEPEGAFYAYPSVKALLGKEIRGKRPQDSVELAALILEEAEVAVVPGEAFGTPGYLRLSYALGDEDLVEGVSRIQKLLAEARD

SEQ ID NO: 15403 - protein, 462 aa, Escherichia coli
MTANSPLQRIGQEKGIAMGSQELQRKLGFWAVLAIAVGTTVGSGIFVSVGEVAKAAGTAWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 15404 - protein, 628 aa, Oryza sativa
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKQMSCDDRTSVMQGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQAAPELSRKDQQMKHVGHELPYLNPTNKPRIGGDANQNLKASEAQCCQSWARV

SEQ ID NO: 15405 - protein, 1029 aa, Aspergillus nidulans FGSC A4
MTGSECQPRHSASSGTGRDIHTLSWDGDHDPANPFNWSISRKWAVTYLAALISFLTMMNGTIITVAHFEIAELFNIDETAFPHTYWPVTTWAVGGAFSALFLLPLAEDFGTRPVFLVTYFAFVCFLIPQAVAQNFATLVATRFFAGACVAILANTAAGVIGNVWDTEWSRSIPVSLYIFGYMAGSSMGPVIGAAVLQSLSWRWIGYMQLIWFGALFPIYYFFFYESRGDIILAQRDRKMGKNGKDILPGHPAHSKLNLQNLAVSSTRPVILFCTEPVLFVSTLWSAFTVGTIFLFTQSVEQVFIGTYDWTISKTGYVQAAVVIGEGIGFFFSFLSRELYFASASRNTEVPNSLIPEARLYMAVLGGLFGISGGMFTYAWTSYPFIPWIAPAISLAMVGAGSVLVVTGVSDYVVDAYSQYAGSAIGAVATGENIFSAFLPLATMSMYNNLGFQWASTLLAFVSLVLALVPTLMFVWGRELDNYALPTIATYAYSPANHYCTTQQAFQCHCSNFPSLHSCPTTTRHRPTNHLLKMPSLANTLKDPTLFIESSYIDGKWVTSSSSRTFNVYDPATEEFIGTCPESNIDDINSAIRAAATAFPKWRALSGRQRGRILRRWFDLIVENKEDIGKIITAENGKAKGDAEGEALFSAGFFEWFSEEAARIYGDVVPHSNPSSRVQVLKEPVGVCGLITPWNFPMAMGARKVAAALAAGCTVVLKSDGLTPYSSNVLALLAERAGVPGGVFNVVTALENTPALGLALCESDNVKKISFTGSTRVGKLLMKQSSHTLKKLSLELGGNAPFIVFDDADLETAVTSAVACKFKVTGQTCVCANRFYVQEGIYEAFSKRFVEEVKKCQVGHGLDPGVTHGPLTNGIAKTQEHIQDALNKGATVLLGGSRLPSLGKNFHELTILGDVDDSMKVASEETFGPLAALSKFKAEDEVVRRANGVEVGLASYLITSDLGKAHRVSEKLEFGMVAINTGVISDSAAPFGGVKHSGMGREGSKYGIDDYLNIKTIVTGGIHTAYSAHL

SEQ ID NO: 15406 - protein, 672 aa, Xanthomonas oryzae pv. oryzae KACC10331
MASSARVRLPAAPPASACVTTFKDPAPGPARRFLMSTSPINSTILRAAFAAPLDPQRAAIVMARYDQHAPRLLDALQTLYGQRAHYAPWLTQWLGELGDLARQRPQALQTLDSTRHAGWFGEQHMLGYSAYADRFAGTLQGVAERVPYLQELGVRYLHLLPFLRARAGDNDGGFAVSDYGQVEPSLGSNDDLIALTTRLREADISLCADFVLNHTADDHAWAQAARAGDTRYLDYYHHFADRSLPDQYESALGQVFPHTAPGNFTWVDDTAQWMWTTFYPYQWDLNWSNPAVFGDMALAMLRLANLGVEAFRLDSTAYLWKRTGTDCMNQPEAHTLLVALRAVTDIVAPSVVMKAEAIVPMTQLPPYFGSGAGQGHECHLAYHSTLMAAGWSALALQRGDILHNVIAHSPPLPRNCAWLSYVRCHDDIGWNVLQHEAAGNAAQPPFSLRDVARFYANAVPGSYARGESFQSSGDGVHGTNGMAAALAGIQAAQEAGDAAGLAVAVNRLMLLYAIALAMPGVPLIYMGDELAMLNDTSYRDDPHRQHEGRWLHRPAMDWRLAAQRHDAESLSGTVYRRLRGLIQQRAALGALAADHALGSIALDDPRLFALSRGESFLAVHNFSDQPLEVELAAIGDGWELLAIGDDVDAAAPSDNVSLVLPAYGVRWLQRGA

SEQ ID NO: 15407 - protein, 181 aa, Glycine max
MKDEDGLPTTAATKKESMDSSLFGKGRYKFWALAAILLLAFWSMFTGTVSLRWSGTLNSLSSDIDTPIHDDLDVLEMEEREKVVRHMWDVYTNSRRVRLPRFWQEAFEAAYEDLTSDVTEVRDAAVTEIAKMSVRSIHFDPPPLQSTSAFFFFLAHNSWSLLRERKACSIFQHIHLVFHFI

SEQ ID NO: 15408 - protein, 462 aa, Mycobacterium tuberculosis CDC1551
MGSTEQATSRVRGAARTSAQLFEAACSVIPGGVNSPVRAFTAVGGTPRFITEAHGCWLIDADGNRYVDLVCSWGPMILGHAHPAVVEAVAKAAARGLSFGAPTPAETQLAGEIIGRVAPVERIRLVNSGTEATMSAVRLARGFTGRAKIVKFSGCYHGHVDALLADAGSGVATLGLCDDPQRPASPRSQSSRGLPSSPGVTGAAAADTIVLPYNDIDAVQQTFARFGEQIAAVITEASPGNMGVVPPGPGFNAALRAITAEHGALLILDEVMTGFRVSRSGWYGIDPVPADLFAFGKVMSGGMPAAAFGGRAEVMQRLAPLGPVYQAGTLSGNPVAVAAGLATLRAADDAVYTALDANADRLAGLLSEALTDAVVPHQISRAGNMLSVFFGETPVTDFASARASQTWRYPAFFHAMLDAGVYPPCSAFEAWFVSAALDDAAFGRIANALPAAARAAAQERPA

SEQ ID NO: 15409 - protein, 333 aa, Triticum aestivum
  misc_feature (57)..(57): Xaa can be any naturally occurring amino acid
  misc_feature (207)..(207): Xaa can be any naturally occurring amino acid
  misc_feature (219)..(219): Xaa can be any naturally occurring amino acid
  misc_feature (226)..(226): Xaa can be any naturally occurring amino acid
  misc_feature (237)..(237): Xaa can be any naturally occurring amino acid
  unsure (1)..(333): unsure at all Xaa locations
NGLNLYLYGLVLNEQERTVEARRVFIESLNYFPYNWSCWLELCKIIESEDLTPITKXLNDHWLKNFYFGHLCLQKYKNDICIDLYYGVHCFFKHSNFIMNQIAHSFYNNQEFDSSSDWYQKLLSVDPYRYENMDTYSNILYIRENQGELANLALKSFYNNKYYPETCCVVGNYYSLMGEHLKAIVYFRKALKLDRTCLAAWTLMGHXYLEMKNIPGAIXAYRSAVXIDPKDFRAWYXGLGQTYELQNMNNYALYYYSRAVLSRPKDSRMWNAMGCCYEKMGKQNEAQRCYVRAENSKDREGIAIHQMGKLYHSMGPEYEKKAVDAFELNLRRK

SEQ ID NO: 15410 - protein, 605 aa, Zea mays
MYHQTISASVLRQYITKPRLHLRAKRDTDGDAMMHMLVAPDRGGGELQPYVAPPAEQELELLRDNADDGLEGHVRCLRCGISGNATPHMRRGPDGPRTLCNACGIAYRKGKMRRMIEAEPPIDEAALAKLVPEVGMEFVSEEKAYEFYNKYAGHVGFSVRKSTSHKSSENITKVRTFVCSREGYNRDKKSLEAKKPRLDTRIGCPARLIIKVTPECKYRVTDFKADHNHQLAPPSTMHMLRSQRILTELQPGEAELSDDSVVTPTTKATGDLVVRQVSFLRSLSLLPADYKNYLRSKRMKAMQPGDGGAILKYLQTMQMDNPSFFYTMQIDEDDKLTNFFWADQKSRDDFNYFGDVLCLDTTYKINGYGRPLALFLGVNHHKQTIIFGAAMLYDESFDSYKWLFDSFKIAMHGKQPAVALIDQSIPLSSAMAAAWPSTTQRICAWHVYQNSLKHLNHVFQGSKTFAKDFGKCVFGYEDEDEFVFSWRSMLEKYDLRHNEWLSKVFAEKEQWALAYDRHIFCADIISALQAESFSSILKKFLSPQLELLSFFKHYERAVDEHRYAELQADFQASQSYPRIPPAKMSWQTAHTYTPVVFEIFRKEFE

SEQ ID NO: 15411 - protein, 386 aa, Chlorobium tepidum TLS
MGLSLGERCGLVMQSDIRAMSIECARMGGINLSQGVCDTPVPPVVLQGAADAVMQGANIYTHHTGIRELREAIVAKQRRFTGVAFDAEREVVVSAGATGAMYCAFQALLNRGDEVIVFEPFYGYHVSTLRAVEAVPLFVPLDPSDGWSFRVEALEAAVTPKTKALLINTPANPSGKVFSCDELALLAEFAIRHDLFVFTDEMYEHFVFGGLSHVSMASMPGMRERTITISGLSKTFSVTGWRIGYALCDPRWAASIGYFNDLFYVCAASPLQVGVTAGLRLLGDDYYHGLAAEYEVRRDLFCAALAEAGLEPHVPQGAYYVLAGTERLPGATAREKAMHILRETGVASVPGSAFYHDGGGENLVRFCFAKESHVLEAACEKLLKLR

SEQ ID NO: 15412 - protein, 332 aa, Zea mays
  misc_feature (46)..(46): Xaa can be any naturally occurring amino acid
  unsure (1)..(332): unsure at all Xaa locations
MSGHGDTATSAKMAKLKELLQKSENHICADCGASDPKWASANIGAXNRSANIGVFICVKCSGVHRSLGTHISKVLSVTLDKWSDSEVDSMIEVGGNSQANAIYEAFIPEGYQKPHSDSTQEEREKFIRSKYELQEFLKPSLRIVSHQPSDSGKHAGNASHSDGSKSQVGMIEFIGILNVKVIGGTNLAIRDMSSSDPYVVLTLGQQKAQTSVINGNLNPVWNEELKLSVPQQYGPLKLLQVFDHDMVSKDDLMGEAEIDLQTMINAAAAFGDPELLGDIQIGRWLKSEDNALVRDSAVVVSGGKVKQGMALKLQHTESGELELEMEWMPLNV

SEQ ID NO: 15413 - protein, 306 aa, Candida glabrata CBS 138
MMDAKDVVVHVRNLEKSKGNDESVLEILRILEKEVVPTEKLLRETKVGVEVNKFKKSENAEISKLVKRMIGAWKDAINKHKKAKLRQQQPPQQGVSASSGGAADGSNNDGAKSGDEPRKTDKFVSSKIRNTKNDGVDPNVHNNKLRDQVIRALYDALAKDSEHPPKSILQTSIAIEEEMHKLNDSSIKEKEYKDKYRVIYSNIISRNNPDLKVKIANGDLSPEQLVNSDPKDLAPEHLKKKMEEIKKQNLFNAQGATIERSVTDRFTCGKCKEKKVSYYQLQTRSADEPLTTFCTCEACGNRWKFS

SEQ ID NO: 15414 - protein, 421 aa, Methanocaldococcus jannaschii DSM 2661
MVLLKFHGGCQQIGMSCVEVETQKGRVLLDCGMSPDTGEIPKVDDKAVDAVIVSHAHLDHCGAIPFYKFKKIYCTHPTADLMFITWRDTLNLTKAYKEEDIQHAMENIECLNYYEERQITENIKFKFYNAGHILGSASIYLEVDGKKILYTGDINEGVSRTLLPADTDIDEIDVLIIESTYGSPLDIKPARKTLERQLIEEISETIENGGKVIIPVFAIGRAQEILLIINNYIRSGKLRDVPIYTDGSLIHATAVYMSYINWLNPKIKNMVENRINPFGEIKKADESLVFNKEPCIIVSTSGMVQGGPVLKYLKLLKDPKNKLILTGYQAEGTLGRELEEGAKEIQPFKNKIPIRGKVVKIEFSAHGDYNSLVRYIKKIPKPEKAIVMHGERYQSLSFAMTIWKTLKIPTFVPVRGTILPI

SEQ ID NO: 15415 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 15416 - protein, 334 aa, Geobacillus stearothermophilus
AVKVGINGFGRIGRNVFRAALKNPDIEVVAVNGLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 15417 - protein, 277 aa, Bacillus licheniformis ATCC 14580
MKTKTDFLKMKQEGEPIVMLTAYDYPAAKLAEQAGVDMILVGDSLGMVVLGLDSTVSVTVADMIHHTKAVKRGAKDTFVVTDMPFMSYHCSLESALKNAAAIVQESGADALKLEGGDGVFETITALTRGGIPVVSHLGLTPQSVGVLGGYKVQGKDEESAGKLIEDSRRCEEAGAMALVLECVPAALAERISKELTIPVIGIGAGAGTDGQVLVYHDVVGHGVSRTPKFVKQYAQIDQPLEQALRGYVEDVRSRVFPEDAHSFRIDQQVLEGLYGGK

SEQ ID NO: 15418 - protein, 327 aa, Bacillus licheniformis ATCC 14580
MQSNLRKKLIQLFTEADGEFISGQKISEELGCSRTAVWKHIEDLRKSGYELEAVRKLGYKMIKKPDKITEDEIRLGLKTKKMGQTIHFQDVVSSTQKIAHELANNGAPEGTIIVADKQTEGRGRMARAWHSPEGNGIWMSIILRPEIPVQKTPQLTLLAAVAIVQAIEEQTGIAAEIKWPNDILINGKKVVGILTELQAEADQVHSVIVGTGINVNQLAADFPEELQETATSLRLASGEKIDRAALVQTIMSTFEKRYEDYLAYGFEPIKLLWESYALTLNRELTARTLNGTFHGKALGIDEEGVLILETSDGIKKIYSADIDINPS

SEQ ID NO: 15419 - protein, 468 aa, Candidatus Pelagibacter ubique HTCC1002
MTAANVLKFIKEKEVEFVDLRFTDPRGKLQHLTMDQTIVDEEMLNEGVFFDGSSIAGWKAINESDMILIPDTSRMIMDPFTSHNTLILFCDILDAVKRSPYERDPRGTAKKAEAYLKKSGIGDKAFFGPEPEFFVFDDVRINNDPNNTGFKIDSKEGPYNSGTEYANGNMGHRPPVKGGYFPVPPVDSEQDMRGEYLKSLKEVGIKVEKHHHEVAPSQHELGMYFGTLVDQADNVQLYKYVVQMVTHSFGKTATFMPKPIAGDNGSGMHIHQSIWKDDKPVFSGDAYAGLSETALHYIGGILKHAKAINAFSNATTNSYKRLIPGFEAPVLLAYSARNRSASCRIPISLSKNGARCEIRFPDASGNPYLTFAAMLMAGLDGIKNKIHPGESFDKDLYELPPEEVKNIPTVCGSLREAMESLDKDREFLTEGGVFTDDQIDAYIALKFEEIHRFEHAPHPVEFEMYYSS

SEQ ID NO: 15420 - protein, 220 aa, Petunia axillaris subsp. axillaris
MFKSQLTSAHFILLFAISPIYGDFDYMQLVLTWPATFCYPKGFCQRIPPKNFTIHGLWPDKERQRLQFCAKDYKYVNFEGDIKSSLDHHWIQLRFNKEVGLKYQPLWHDQYKKHGTCCSNLYDQTAYFLLAMRLKNKFDLLGTLRTNGITPGRRYTFQRIHGAIKTVTQMDPDLKCVEHIKGVLELNEIGICFTPNAESPYHCPQSHSCEKRGYTGILFR

SEQ ID NO: 15421 - protein, 490 aa, Staphylococcus aureus subsp. aureus Mu50
MTSKSSPLIFERSREGRYAYSLPKSDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSEHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 15422 - protein, 448 aa, Staphylococcus aureus subsp. aureus Mu50
MSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLEKIQSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 15423 - protein, 828 aa, Arabidopsis thaliana
MGKIGIVFFASLLFLLIIFPSCAFAAITRASPLSIGQTLSSPNGTYELGFFSPNNSRNQYVGIWFKNITPRVVVWVANRDKPVTNNAANLTINSNGSLILVEREQNVVWSIGETFSSNELRAELLENGNLVLIDGVSERNLWESFEHLGDTMLLESSVMYDVPNNKKRVLSSWKNPTDPSPGEFVAELTTQVPPQGFIMRGSRPYWRGGPWARVRFTGIPEMDGSHVSKFDISQDVAAGTGSLTYSLERRNSNLSYTTLTSAGSLKIIWNNGSGWVTDLEAPVSSCDVYNTCGPFGLCIRSNPPKCECLKGFVPKSDEEWNKRNWTGGCMRRTNLSCDVNSSATAQANNGDIFDIVANVKPPDFYEYLSLINEEDCQQRCLGNCSCTAFSYIEQIGCLVWNRELVDVMQFVAGGETLSIRLASSELAGSNRVKIIVASIVSISVFMILVFASYWYWRYKAKQNDSNPIPLETSQDAWREQLKPQDVNFFDMQTILTITNNFSMENKLGQGGFGPVYKGNLQDGKEIAIKRLSSTSGQGLEEFMNEIILISKLQHRNLVRLLGCCIEGEEKLLIYEFMANKSLNTFIFGQSLILTNLFLIWLDSTKKLELDWPKRFEIIQGIACGLLYLHRDSCLRVVHRDMKVSNILLDEEMNPKISDFGLARMFQGTQHQANTRRVVGTLGYMSPEYAWTGMFSEKSDIYAFGVLLLEIITGKRISSFTIGEEGKTLLEFAWDSWCESGGSDLLDQDISSSGSESEVARCVQIGLLCIQQQAGDRPNIAQVMSMLTTTMDLPKPKQPVFAMQVQESDSESKTMYSVNNITQTAIVGR

SEQ ID NO: 15424 - protein, 387 aa, Bacillus cereus ATCC 10987
MEQFINPRVKDIQISGIRQFSNMIQNYDNLISLTIGQPDFPTPSLVKEAAKRAITENYTSYTHNAGLLELRKAACNFVKDNYDLHYLPENETIVTIGASEAIDVAFRTILEPGTEVILPAPIYPGYEPIIRLCGATPVFIDVRETGFRLTADALKNAITEKTRCVVLPYPSNPTGVTLSKEELQDIVNVLKDKNIFVLSDEIYSELVYEQTHTSIAHFPEMREKTIVINGLSKSHSMTGWRIGLLFAPNYLAGHILKVHQYNVTCSTSIAQYAAIEALTAAKDAPKMMRHQYKKRRDYVYNRLTQMGLTVEKPTGAFYLFPYVGHLTSSSFDFALDLVKEAGLAVVPGTAFSEYGEGYLRLSYAYSIETLKEGCDRLEAFLQKKAKS

SEQ ID NO: 15425 - protein, 355 aa, Kluyveromyces lactis
MAGIKHRRDSAESINTDIITLSRFILDQQHLSAKNATGEFSMLLNSLQFAFKFISQTIRRAELVNLIGLAGASNSTGDQQKKLDVLGDEIFINAMKASGNVKVLVSEEQEDLIVFRNSPGKYAVCCDPIDGSSNLDAGVSVGTIVSLFKIHENQNGNSGEEDSEGTINDVARCGREMVAACYTMYGASTHLVLTTGAGVNGFTLDNNLGEFILTYPELRLPEQKSIYSINEGNTCYWEPTIADFIAKLKENSEENNGKPYSARYIGSMVADVHRTLLYGGLFSYPGDKKNPNGKLRLLYEAFPMAFLVEQAGGKAVNDRGERILDLVPQHIHDKSSIWLGSSGDVDKYLKHIGKL

SEQ ID NO: 15426 - protein, 235 aa, Pyrococcus furiosus DSM 3638
MLGLNTSIIGKVVIYYREVTSTNEVAKLGNFEEGTVIVADTQTMGHGRIGRRWESPPGGLWMSVVLHPRISTEDLPKLSFLGALAVVRTLSEFSIQGKIKWPNDVLVDYKKIAGILVEKRGDNVVLGVGLNVNNEAPENATSMAEILGTSVPLIEVFRALVTNLDELYKMFLSSPASLLEMAKKEMILGVPVRIIGDGEIEGIAEDIDELGRLILRLSDGSLKKIVYGDVSLRFL

SEQ ID NO: 15427 - protein, 339 aa, Triticum aestivum
GAPESGTTSQSLGSRGEGTGAAPAAGGQGGGMDAALLDDIIRRLLEVRTARPGKQVQLSESEIRQLCTASRDIFLTQPNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTDCFNCLPVAALIDDKILCMHGGLSPDLGHLDEIKNLPRPADVPDTGLLCDLLWSDPGKDVQGWGMNDRGVSYTFGHDKVTEFLLKHDLDLICRAHQVVEDGYEFFADRQLVTIFSAPNYCGEFDNAGAMMSVDETLMCSFQILKPAERKIKFMASNKM

SEQ ID NO: 15428 - protein, 532 aa, Nocardia farcinica IFM 10152
MSQAGRPVVLIADKLAQSTVDALGDGVEVRWVDGPDRPALLAAVPEADALLVRSATTVDAEVLEAGKNLKIVARAGVGLDNVDVPAATERGVMVVNAPTSNIHTAAEHAVTLLLAAARQIPAADATLREHTWQRSKFNGVEIYGKTVGVVGLGRIGQLFAARLAAFETKIIAYDPYVSPARAAQLGIELVTLDELLGRADLISVHLPKTPETKGLLSKEKLALTKKGVIIVNAARGGLIDEQALADAITSGHVRAAGIDVFETEPCTDSPLFELPQVVVTPHLGASTTEAQDRAGTDVAKSVLLALAGEFVPGAVNVTGGAVSDEVAPWLEIVRKQGALVGALSDELPVSVEVQVRGELAAEDVAVLELSALRGIFSALVEDQVTFVNAPALAKERGISVEVTTASESPSHRSVVDLRAVFGDGRTLNVAGTLTEPQQVQKIVNINGRNYDMRAEGLNLAVLNYDDRPGALGKIGTRLGEADIDILAAQLSQDIDKEGATVILRVNKPVPADVQTAIAEAVGAAKIALVDLF

SEQ ID NO: 15429 - protein, 396 aa, Bacillus cereus ATCC 14579
MKQFELSRSAESLKPSGIRKFFDLAANMKGVISLGVGEPDFVTPWNVRQACIRSLEQGYTSYTANAGLLELRQEIAKYLKKQFAVSYDPSDEIIVTVGASQALDVAMRAIINPDDEVLIVEPSFVSYAPLVTLAGGVPVPVETKLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVQFSELMLKIHQYSMMCAPTMSQFAALEALRAGNDEVIRMRDSYKKRRNFMTTSFNEMGLTCHVPGGAFYVFPSISSTGLSSAEFAEQLLLEEKVAVVPGSVFGESGEGFIRCSYATSLEQLMEAMKRMERFVENKKRTKRNTFCP

SEQ ID NO: 15430 - protein, 253 aa, Caulobacter crescentus CB15
MTLSSTTPRPLIAGNWKMNGLSVALDEARAVAAALEAKPPAARVAIFPPATLLHRLSQAVEGAHLLTGGQDCHGKSSGAHTGDVSAEMVADAGGSLVICGHSERRTDHGETSAQVAGKAEAAAAAGLEPIVCVGETLETREAGQAVSFVVSQVRDSLPTSLAGKAFSVAYEPLWAIGTGRTASVDNIVEMHAAIRAELVSRFCEQGRTVLILYGGSVKPENAREILAAPEVGGALVGGASLKAKDFLAIIQAL

SEQ ID NO: 15431 - protein, 368 aa, Chlorobium tepidum TLS
MVLSMGPQHPSTHGVLRLECITDGEVVVEAEPYLGYLHRCFEKHCEKIDYPAIVPYTDRMDYLAGMNNELAYCITVEKLLDIEIPRRVEFIRVIVAELNRIASHLVAIGTYAIDLGAFTPFLFCFRDREHIMSLLEWISGARMLYNYIWIGGLAYDVPADFKTRVAEFVTYFRPKAKELYQLLTENEIFVKRTYDIGIMPADVAINYGWSGPMLRGSGVKWDLRRNDPYSVYPELDFDVPVPDGKFSVVGDCLSRHLVRALEMEESLKIIEQCLDKMPEEPNFNSRALIPKKIRPKAGEVYGRAENPRGELGYYIVSDGKSTSPVRCKARSSCFVNLSAMKDLSKGQLIPDLVAIIGSIDIVLGEVDR

SEQ ID NO: 15432 - protein, 443 aa, Clostridium saccharobutylicum
MAKYTKEDIINLVKENGVKFIRLQFTDIFGTLKNVAITDKQLEKALDNECMFDGSSIDGFVRIEESDMNLRPNLDSFVIFPWRPQQGKVARLICDVYKPDGTPFEGDPRHVLKRANADAKELGYTMNVGPECEFFLFETDENGRATTNTQDKAGYFDLAPTDLGENARRDMTLALEEMGFEIEASHHEVAEGQNEIDFKYGDALTTADNIMTFKLVVKSIAQRHGLHASFMPKPIFGINGSGMHVNMSLFKDGKNAFVDENDKNGLSKVAYQFIAGLLKNIKGMAAVTNPLVNSYKRLVPGYEAPVYLAWSCKNRTALIRVPAARGAGTRVELRCPDPSSNPYLVLACLLQAGLDGIKNNLQPPAEVEANIFAMTEQERKENGIDNLPNNLYEAVNYMKENELAKKALGDHVYGNYVAGKAAEWDDYRTKVHDWELENYLNKY

SEQ ID NO: 15433 - protein, 317 aa, Arabidopsis thaliana
MQLQTQSFALNLLPSPNFAKPIERREFISLKRDPSRPISLRCSVSTTLDTPATASTHKPFPAEVSRSIMELSSVGTLSTLTHDGWPLGVGVRFAVDKDGTPVLCLNRSVSPDKRSALHVQLEQCGLRTPQCTIQGSIGRPGDDTVLKRLSATWREKFGEEVKEDSLYVVAVDRVLQMEDFMEDGIWVASSDYKNASPDPLRDIAEDIVNQINANNMEDIFRFCNVYVDLDFVVSETKMIWMDRLGFDLRVWSPRGVYDVRIPFPMEVTDEKGAKSSFNGMSQLAWEVEKSYCPADFNKVKLLKQVVGSSHSHKGGGQ

SEQ ID NO: 15434 - protein, 256 aa, Legionella pneumophila str. Paris
MRHSPRKRFGQNFLQDKYIINEILRAINPLADDNMLEIGPGLGALTQPLLQKLNRLTAIEIDTDLQNYLTRLPVSQGKLNLIPADALTVDFCQFGPHLRVVGNLPYNISTPLLIYLLKFITCIDDMHFMLQKEVVERIAATHGTKAYGRLSVMLQYHCEVEYLFDVPPEAFEPKPKVDSAIVRLTPYRVSPFESVNTEKLENIVAKAFAMRRKTLTNNLKGIISLSQLNDLGIDGGKRPEQISVAEYVQLAKFISN

SEQ ID NO: 15435 - protein, 308 aa, Helianthus annuus
MAILSRYSSSNTLFCIEEQVHEDEDELTHQDSSAIHPLDLQDLCWEHEELVSLFTKEEEQQKQTPWPSSCTLSFRKEAVDWILKVKGCHGFTPLTAILAINYLDRFLSSLHFQKANTPWMIHLVAVTCLSLAAKIQETHVPLLLDLQLEESKFLFEAKNIQKTELLVMSTLKWRMNLVTPISFLDHIVRRLGLSNHLHWDFFKKCEAMILYLVADSRFVCYKPSVLATATMLCVVEEIDPTNSIGYKSQLLDLLKTTKDHINECYKLVMDLSYDNHNKGKRDENERTIYPVSPAGFIGFMCHESSNDS

SEQ ID NO: 15436 - protein, 403 aa, Streptomyces coelicolor A3(2)
MQVIQSTKLANVCYEIRGPVLEEAMRLEAAGHRILKLNTGNPAAFGFECPPEILEDILRNVSTAHGYGDAKGLLAARRAVVMHNQTLGIETDVEHVFIGNGVSELIVMAMQGLLDDGDEVLVPAPDYPLWTAAVSLSGGTAVHYRCDEQSDWMPDLADVERKITDRTKALVIINPNNPTGAVYDDAMLRGLTDIARRHNLLVCSDEIYDKILYDDATHTPTAAIAPDLLTLTFNGMSKAYRVAGYRVGWMSISGPRAHAESYIEGLTILANMRLCANMPGQHGVVAALSGRQTINELVLPGGRLREQRDAAHEALTSIPGVTCVKPKGALYLFPRLDPKVFKIKDDRRMVLDLLRQEKIMVVQGTGFNWPEPDHFRVVTLPTAADLREAVDRIGNFLDGYSQP

SEQ ID NO: 15437 - protein, 433 aa, Lactococcus lactis subsp. lactis Il1403
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 15438 - protein, 495 aa, Zea mays
MVGNNTVASLFYYSLLIICAAAWHADASQADRLREFIRSRRNSPSEAADKGTFEVANIGHSVASSLLSTSSYSDSEQSALKAADKITALPGQPDGGVDFDQYAGYVTVDEKNGRALFYYLVEAPQDASAKPLLLWLNGGPGCSSLGYGAMQELGPFRVNSDNKTLSRNKAAWNNVANVIFLESPAGVGFSYSNTSSDYGLSGDRRTAADAYLFLANWLERFPEYKSRPFYISGESYAGHYVPELAATILTQNSYNSRTAINLRGILVGNPLLDSYMNLKGAVAYYWSHGLMSDEVFDNITRHCKYDSSDGVACSGALEAVDPGQIDPYNVYAPICVDAANGAYYPTGYLPGYDPCSDYYTYSYLNDPAVQNAFHARTTSWNLNWTDAPISMVPTVAGLIEKKLPVWIFSGDFDSVCPLPATRFSIHDLNLHVTTPWRPWTVNMEVGGYVQQYQGGFTFASVRGAGHMVPSSQADRALVLLDSFLKGVLPPYVQEQ

SEQ ID NO: 15439 - protein, 519 aa, Candida apicola
MIIGLSDAFALGGIALSFLVAYQFIYFYFIYSPRAKKLGCAPPVIVFSFPLGLPALYKFATAMLHDNLLEYISIRIADMKVRTGFQTLAGQRWLVTLEPENIKTVLATSFKDYSLGFRYDIMYGLLGNGIFTLSGDGWKHSRALLRPQFSREQVSHLESMRTHINLMINNHFKGGQVVDAQALYHNLTIDTATEFLFGESTNTLDPDLAQQGLPGPKGLVTGEQFAEAFTSALEILSVRVIVGAAWFLIWTPKFWRSCKVCHNFIDYFVYKALATPMEKDQEADRYVFIRELTKETSDPRVIRDQALNILLAGRDTTAGLLSFITYYLGAYPEVYAELREAVLSEFGSTDVETPTFEQLKQCKVLQNVIREVLRLHPNVPLNFRQAIVDTKLPTGGGPNGDQPVFVPKGQNVFYSTYSMQRRTDIWGPDATTFRPDRWNEPREALASGWDYIPFNGGPRICLGQQFALTEASYTIVRICQEFSRIEVLHPDVITSKNSMKQRMRLTQTASGGVITRFIR

SEQ ID NO: 15440 - protein, 104 aa, Triticum aestivum
  misc_feature (40)..(40): Xaa can be any naturally occurring amino acid
  misc_feature (54)..(54): Xaa can be any naturally occurring amino acid
  misc_feature (68)..(68): Xaa can be any naturally occurring amino acid
  misc_feature (78)..(78): Xaa can be any naturally occurring amino acid
  misc_feature (87)..(87): Xaa can be any naturally occurring amino acid
  misc_feature (90)..(90): Xaa can be any naturally occurring amino acid
  misc_feature (101)..(101): Xaa can be any naturally occurring amino acid
  unsure (1)..(104): unsure at all Xaa locations
MAEQTFIMIKPDGVQRGLIGEVISRFEKKGFYLKGLKLQXNVEKSFAEQHYADXLSSKPFFRWAPLEXILSRPVLPMXWERQDVLSXWTXIIWANKPLAPXPDR

SEQ ID NO: 15441 - protein, 275 aa, Zea mays
  misc_feature (136)..(136): Xaa can be any naturally occurring amino acid
  misc_feature (207)..(207): Xaa can be any naturally occurring amino acid
  misc_feature (220)..(220): Xaa can be any naturally occurring amino acid
  misc_feature (230)..(230): Xaa can be any naturally occurring amino acid
  unsure (1)..(275): unsure at all Xaa locations
MQGGSSGIVYGGLKYQARCIADVRADASSTTFLAGTLSLKEENEVHLIRLSPAESELVCDGVFYHPNEIWDLKSCPFDHRVFSTVYTSGEGFGASVWKIPELNGQSNSPQLEQLFELSGHTGKIRRVIWWPLGKHXISDSSLHLWDLRSMEKSSAIEHAHIRDVDYNPKKQHIIATTEDDFGICLWDLRMLKLPLKDLPGHSQCVWXQHNPEYDELLLPXGSPNRQEEPXLNSYTDYEDSIYGIAWSSHDPSLFASLSYDGRVVLESVKPYLQRK

SEQ ID NO: 15442 - protein, 445 aa, Bordetella bronchiseptica RB50
MTRAAESGMAQARGLSVLDAVAVLVGVVIGIGIFGFPPLVAQHAQSESVYLALWLGGAAVMLMGALCYAELGSAYPGAGGEYLYLRHAWGPRVALLFAWARCTVIQTGAIAVVAFIYGEYAQELAPLGTHGVALHAAIAVIALTLLNIMGTQPSKRIQLVFTVLTLAALAAVVATGLSAPPAPPAPVEPLAGSTLGLLGMGLVFVLLTYGGWNEAAYLSGELREARRNMAKVLLIGTAVVAGAYLLTNLALLQIFGLQGLRETRAVAATLMTLAAGPYAAIVLSLLVCVTALSTINGTILTGARVYSALGQDVPRLRPLAGWSMRGQTPTSALLAQGAITLVLLGYGAYAHDGVQTLVAYTAPVFWLFMLLVAASVWRLRRLDPHRPRPFRVPLYPLPPLLLGLTCAGLVWSSARYAGVGALLGLAVLAAGLPALRLLRAAPRSA

SEQ ID NO: 15443 - protein, 466 aa, Schizosaccharomyces pombe 972h-
MDIKGGRRGNVEDSLNKLSLSPPDNNSSFLSNHFQVRKSYSQAPARTLKPFASEDIKILLLENVNQSALSNLKDEGYQVEFLKTSMSEDDLVEKIKGVHAIGIRSKTRLTRRVLEAADSLIVIGCFCIGTNQVDLDFAAERGIAVFNSPYANSRSVAELVIGYIISLARQVGDRSLELHRGEWNKVSSGCWEIRGKTLGIIGYGHIGSQLSVLAEAMGLHVVYYDILPIMPLGSAKQLSSLPELLHRADFVSLHVPASPETKNMISSKEFAAMKEGSYLINASRGTVVDIPALVDASKSGKIAGAAIDVYPSEPAGNGKDKFVDSLNSWTSELTHCKNIILTPHIGGSTEEAQYNIGIEVSEALTRYINEGNSIGAVNFPEVSLRSLTEADRNAARVLFVHRNVPGVLRQVNELFIDHNIKSQFSDSRGDIAYLVADISDCTPGSLEALHQKLESLPCKINTRLLY

SEQ ID NO: 15444 - protein, 273 aa, Zymomonas mobilis subsp. mobilis ZM4
MVPVKNVVLNDGHSMPAIGQGVYQLNPAQAESMVALGYDLGYRAVDTAAWYENEEGVGEGLRSRHARSFITTKLMPQDMGRVNCFVALDKSIRNLGVTSLNLYLIHWPGQDRKRYEETWQTLIQIRAIGKASSIGVSNFTIDHLDHIIADSGVVPAVNQIELHPYFQQKELRAYHAERGIVTTSWSPLGRGAALNDPVIREIALKHGKTPAQVVLNWHLSLGLTVIPKASSKARLQENLEADSFALDEEDMQRIESLDKPDGRQGIDPAVFDF

SEQ ID NO: 15445 - protein, 247 aa, Candidatus Kuenenia stuttgartiensis
MIKFLEPEWHDKLSSTNTVLLRWLKNEKDIPTGFVLAALEQTAGHGRSNHHWLSQPGEDLTFSFLLSTRHDLSGLASLSMAISLGIASALDTFGFTTQTKWPNDLLVRGRKIGGILSEESGVKRPNGHAAIVVGVGVNVNMQEPQVSSMKKPATSLRIETGKKHLIRDVLNIILEMLPQWIDRWEAGGFPAIRNEWLARCCFVGERITLGEGMEQRSGILTGFGEKGQIILRGDDGLLCDVWAGEVE

SEQ ID NO: 15446 - protein, 222 aa, Saccharomyces cerevisiae
MTELDYQGTAEAASTSYSRNQTDLKPFPSAGSASSSIKTTEPVKDHRRRRSSSIISHVEPETFEDENDQQLLPNMNATWVDQRGAWIIHVVIIILLKLFYNLFPGVTTEWSWTLTNMTYVIGSYVMFHLIKGTPFDFNGGAYDNLTMWEQIDDETLYTPSRKFLISVPIALFLVSTHYAHYDLKLFSWNCFLTTFGAVVPKLPVTHRLRISIPGITGRAQIS

SEQ ID NO: 15447 - protein, 540 aa, Shewanella sp. ANA-3
MSELTWWRGAVIYQIYPRSLLDTNGDGVGDLRGIITKLDYIASLNVDAIWISPFFKSPMADFGYDISDYREVDPLFGTMQDFDELIEKAHQRGIKVIIDQVLSHTSDQHAWFCESRESRTNPKADWYVWAEPKEDGTAPNNWLAIFGGCAWEWEPRRQQYYLHNFLRSQPDINFHNPDVRQAVLDNVEFWLKKGVDGFRLDAITFCYHDEQLRDNPPKPKDKRQGRGFSEDNPYAYQYHYYNNDRPQTILFIEELRQLINRYPGAVTLGEVSAEDSLAVMAAYTKGEDRLHMAYSFELLTDDYSAAYIRQTVEALEASIGDGWPCWAIGNHDAQRVASRWGRGKQTSDMVKMLNAMVNSLRGSVCSYQGEELGLTEAPIEYHELQDPFGKTFWPMFKGRDGCRTPMPWEQNADFSGFSQVTPWLPIAQAHRALAVDVQEADSQSMLHGYRQFLAWRKGYPALVEGEIEFLDAPEPLLVFVRTSGEQKLLVCFNLQDTEQALSLDALSIQQEITGHGLKTAQRIADTLTFSAYACFYALLN

SEQ ID NO: 15448 - protein, 567 aa, Arabidopsis thaliana
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKNISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 15449 - protein, 269 aa, Bradyrhizobium sp. BTAi1
MPFALGARAAARGYGLVVFDQAGSTNIEALAAARQGARAPCWFVTTEQTAGRGRRQRPWVAPRGNLASSVLEVLNVAPVVAATLGFAACLAIENALRQVSREAVLRSGGSSALDFAVKWPNDVLAGGRKIVGMLLEAEQVAGGLAVVAGIGTNVVAAPTDTPTPAVSLRDLGVEVSAEDLFSALSESWVEYFGIWNEGRGFADIRRLWLERAAGLGQPVAIRSGHAIIEGIFDTIDEQGCMLVRTAEGRLEPITAGDVHFGSVASKGAV

SEQ ID NO: 15450 - protein, 333 aa, Oceanospirillum sp. MED92
MLLLSQFLKQQDTEDTLVDLIGTLMLACKEVAIQLREGELAGVLGSTDNTNVQGETQKKMDVIANDLLKKFLLDNPLVAGLASEEEDHPVGGNPEGKYLVIFDPLDGSSNIDINVSVGTIFSILELPEGMDPSQDEAYLQCGRKQVAAGYVLYGQSSVLALTTGHGVNFFTLAHTGDFILTREQVQIPADTKEFAINMSNHRFWEEEMRNYVGDLLQGSEGPRGKNYNMRWIASMVAEVHRVLTRGGIFTYPWDGRDPSKPGKLRLMYEGNPMSMLIEQAGGISSTCYKNIMDLEPQRIHQRSAVALGSKNEVEALLTYHAESGDGQAAKLNI

SEQ ID NO: 15451 - protein, 556 aa, Debaryomyces hansenii CBS767
MAEIDNKDEDSKEQSAHLFVLVHGLWGSPNHMLTIERSLRELLQECSDEKIVTLKPSSFRFWKTYDGLKLNAERVIRDIFYEIEALKQKSNYKVVKISLVGYSLGGLISRYLIGVLNEIGFFEMVEPVFFTTFATPHVGIQFFNDNIFDHAANKVGQYLFGKSGREMFMTDHDKILMQMADSEGVYYKGLNKFRKHILLSNVKNDRTVAFNTSFITEYSPFDNWSNIKIKYLKGLQQSRIGKIYVKPKFVDLNRSIQMTRSEDEVFAGNIQEQTSIFRSNRIFRFLIIFLVSFFLLPFWIPLVLCSSLFASIYSMIKIRIIPAPKIKLHWQRVLDSVYGSSPVDVEDAKIGLQNRNERKSMSKQNYFKGDTSELTENTMEGLMYAEERFTGKSTEGAIQEEDRDEPNNTQNNASNDEDNSGDTNEEMDDYDDSESDHEDYERTSILSKNTKKKVVEIDTKSNDQSIRQHYSTLTQWKNSRFPLFTKSCRLPINEEKQFVIDSLNKINWIKIPVYIDAWNSHDGIVARRGPRTNPKGASTVCLWASILRNNMKETDT

SEQ ID NO: 15452 - protein, 551 aa, Parvularcula bermudensis HTCC2503
MALNLLIPFTLIGLFGMAIALFRMRNQPKGLYVLFFAEMWERFSYYGMRALLVFYLTKHFLFTDDAAYGIYGAYTTLVYIMPVIGGVLADRYLGQRRAVTIGAILLVLGHLGMAIEGEPVQPGGTADGTILNIFYLSLALIVMGVGFLKANISTIVGELYAKTDPRRDGAFTLFYVGINLGAFLGAIWAGYLGEVHGWKYGFGLAGVGMLLGLIVFVLGKPLLKGAGEARDETLLNAKRFMGLSTKWMIYLGTLIVTLLVWLVVRDQAVVGVILALTGAIVVGYVLYRAVFTLEPHARDRIFAALILISTQVLFWALFEQAGSSLNIYADEQVDRTLFGAEIPASVFQSLNAFYIIFLGPIFAATWVFLANRNLEPTAPQKFGLGVIQLGLGFLVLVWGAGGADALTPVLFLFLIYLLHTTGELCLSPVGLSAMTRLSVPSMVGLIMGTWFLASGAGNFVAALIAQATGSGRIEGADALDPVAQKALVIDVYQTVGWVAVAVGGGLLVVAPLINRLMHLSTLTDDELPGLHAHQAEIPVDETPQGGTTRPV

SEQ ID NO: 15453 - protein, 363 aa, Burkholderia thailandensis E264
MTNRNDDTQQMTAIVCHAPEDYRVERVAKPRANARELVIRIGACGICASDCKCHSGAKMFWGGPSPWVKAPVIPGHEFFGHVEELGEGAAEHFGVALGDRVIAEQIVPCGNCRYCKSGQYWMCEVHNIFGFQREVADGGMAEYMRIPSTAIVHRIPLGISLEDAAIIEPLACAIHTVNRGDIQLDDVVVIAGAGPLGLMMTQVAKLKTPKRLVVIDPVGERLALAREYGADVTIDPTREDALAIVHELTGGYGCDVYIETTGVPAGVTQGMSLIRKLGRFVEFSVFGKDTALDWSIIGDRKELDVRGAHLGPYCYPVAIDLLARGLVTSKGIVTHGFSLEEWDEAIRVANSLGSIKVLMKPRG

SEQ ID NO: 15454 - protein, 248 aa, Bacteroides thetaiotaomicron VPI-5482
MSFPVPLIHISETNSTNSYLQTLCAKQQGVAAFTTVVADFQTSGRGQRGNSWESEPKKNLLFSFVLFPDFLEARRQFLISQIVSLAIKEELDSYADDFSIKWPNDIYWKDKKICGMLIENDLMGRNISQSISGIGINVNQEVFHSTAPNPVSLRQITGKQYDIFEILKNIMLRIQSGYELLRNGDTEPIAHRYEKALFRKEGMHRYKDADGEFFARIICVEPEGKLILEDDAQKKRGYMFKEVEYLLI

SEQ ID NO: 15455 - protein, 305 aa, Synechococcus sp. WH 8102
MVWTVDDIPSQEERVALVTGANSGLGLATARAMSARGATVIMACRCRRKAETARTQLLEAGLTGLDLLDLDLADLNSVRRAAAEVSDRYGHLDLLFNNAGVMAPPRQLTVQGHELQLGVNHLGHMALTLQLLPLMQGRNDARVVTVTSGAQYFGRIRWDDPSWAQGYDRYGAYSQSKLANVMFALELEARQQEQGGGIRSLAAHPGLARTDLQPTAIASGGNRLEAVAYRLMDPLFQSAAMGALPQLHAATAATAQGGEHYGPDQLGGMRGHPTRCRIAPAALDREQRQRLWQLSEELAGGLLMP

SEQ ID NO: 15456 - protein, 486 aa, Candidatus Kuenenia stuttgartiensis
MNTPEPLIFEKSVPNRRCFSLPACDVPESPITQLIPQKMQRSRNPNFPEVSEIDIVRHFTKLSQMNYCVDTHFYPLGSCTMKYNPKINEDAANLEGFTRLHPYQPQEQCQGILKILYDLEQMLADISGMPCFTLQPAAGAHGELTGMLIIQAYMKKQREIRNTIIVPDSAHGTNPASAALCGYRIASVQSDANGLIDVKKLKQMLSNDTAALMVTNPNTLGLFEKDILEISKISHDAGALVYCDGANMNALLGIARPGDMGVDILHLNLHKTFSTPHGGGGPGAGPIGVSRALEVFLPIPRTVKNEDDSYALTYDFPDSIGRVRAFYGHVGIMIRAYTYLLSLGKEGIIKTGENAVLNANYLRNILSEYYEIPYGKTCMHEFVISAKKQKAQGVSALDIAKKLLDYGFHAPTIYFPLIVEEALMVEPTETESRETLDAFAGAMIEIAGAIAQAPETVRNAPQKTRIGRPDEVIAARNPKLRWKGTG

SEQ ID NO: 15457 - protein, 1108 aa, Pseudomonas syringae pv. syringae B728a
MAKKPGDATFIKDPLWYKDAVIYQVHVKSFFDSNNDGIGDFAGLIEKLDYIAALGVNTIWLLPFYPSPRRDDGYDISEYRDVHSDYGTMADAKRFIAQAHKRGLRVISELVINHTSDQHPWFQKARNAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVDRDRRRVELLNSMLLSMPGTPTLYYGDEIGMGDNIYLGDRDGVRTPMQWSIDRNGGFSRADPASLVLPPIMDPMYGFQSVNVEIQERDPHSLLNWNRRMLAVRKQQKAFGRGTLKMLSPSNRRILAYTREYTAPDGHSEVVLCVANVSSAAQAAELELSAYAGTVPVEMLGGSAFPPIGQLSYLLTLPPYGFYWFLLASENQMPSWHVEPAQSMPDFPTLVLKKRLEELLEEPLRSTMENTSLAVYLPKRRWFAGKDKAIEKVSIAYAVRFGEEANPVLLSEIEVTAGGQTDRYQLPFGLLAEDDISSALPQQLALARVRRNRDVGLITDAFTLETFIRAVIQGMQSDTVIPCADGELRFEQSSQLAPLGLNAESEVRYLSAEQSNSSVVVGSSLVLKLIRKVSAGTHPELEMGAFLTRAGFKNISPLLGSLVRVGKDGQPNLLMIAQGYLSNQGDAWEWTQNNLERAVRDELAHGVSGQEQHYNALLELADFSRSLGQRLGEMHQILASPTDNADFAVEVTSSQDSKASGVSVNAQLERALQLLEQRIGELDKDDQQLVNDLLAQRKQIRQRVEGLAKRSAGGLRIRVHGDLHLGQVLVVKGDAYLIDFEGEPARALEERRAKHSPFKDVSGVLRSFDYAAAMAVRSAQSVDTSPEAAGARKRVADTYLAQARETFIEGYRSATTGIAHAWKDAKGEDAALELFTLEKAAYEVIYEAENRPAWLAVPLQGLRGLLQPSDGESI

SEQ ID NO: 15458 - protein, 405 aa, Methanosarcina mazei Go1
MKVVLDPVHGYIELDEVVQELLDTPQIQRLRRVRQLGFSNLVYPGANHTRFEHSLGTMHLASMLMKNLDSIDEDKKLEIRVASLLHDVGHGPFSHVTENVIYKYTRRRHDEIKEILGKGEIKEILKKYGIYPGELAKHVEGETSLGQILSSEIDVDRMDYLVRDAHYTGVAFGVVDYNRLINQMSFHEDRLVVDQGGLKAAESLLVSRFWMNTSVYYHHVTRISEAMCSKAVEHMIEDGEMDPFRLRQMDDIDLIAAMRSSKGYGGELARRLDSRNLYKRALYTGLEDAGKGVLKHRDKIERAEKEIAELAGVDQECVLVDIPKTPEMLEMKAMIKTDHKLVSLNEASHFVSILQEAHMDNWRMGVYCPREHCEAVGKAAKEYFNIKKVTKQFKLSDLENTKVQE

SEQ ID NO: 15459 - protein, 313 aa, Vicia faba
MGANSNLAESTHDLNEQISQLMQCKPLSEQQVKELCEKAKEILMDESNVQPVKSPVTICGDIHGQFHDLAELFRIGGKCPDTNYLFMGDYVDRGYYSVETVTLLVALKVRYPQRITILRGNHESRQITQVYGFYDECLRKYGSANVWKIFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 15460 - protein, 491 aa, Bacillus clausii KSM-K16
MTQAKDVALIFELSKQGRVGHSLPNLDIEEQPLESLLPEAYVREEEPELPEVSELQIMRHYTALSKRNHGVDSGFYPLGSCTMKYNPKINEDIARLPGLVHVHPYQPEEQVQGSLKMLYSLQTALAEITGMDEVTLQPAAGAHGEWTGLMMIRAYHEANGDKKRTKVVVPDSAHGTNPASATVAGFESVTVRTNEAGLVDLDHLREVVNEETAALMLTNPNTLGLFEADIQEMADIIHRAGGKLYYDGANSNAILGIARPGDMGFDVVHLNLHKTFTGPHGGGGPGSGPVGVKKELVPFLPKPVLVNDDGFFRFDSDRPQSIGRVKPYYGNYGINLRAYTYIRTMGPDGLRQVSENAVLNANYMMRRLESYYDLPYAQHCKHEFVLSGKRQKKLGVRTLDIAKRLLDFGYHPPTIYFPLNVEECMMIEPTETESKETLDEFIEAMIQIAKEAEESPELVQEAPHHTVIKRLDETLAARKPILRYEMKKETV

SEQ ID NO: 15461 - protein, 448 aa, Bacillus clausii KSM-K16
MNTHRYLPMTEEDKKEMLATIGVDSIEALFADIPESTRFKSQLAIEAALKEPELIAHFQKLADENQSIKTYTSFLGAGVYEHYIPSIVDHVISRSEFYTAYTPYQPEISQGELQAIFEFQTMICELTGMDIANSSMYDGPTALAEAAMLSCGHTKKKTILVSKAVHPEARAVLKTNAYGQRLNVIEIDANANVTDIESLKAAYNDEVACVIVQHPNFYGSLEPLAEIEEIVHQGKAQFVVSSNPLALGVLKPPGDFGADIVVGDAQPFGIPVQFGGPHCGYFATTKKLMRKIPGRLVGQTVDEEGRRGFVLTLQAREQHIRREKATSNICSNQALNALAASVAMTALGKQGVKEMAKQNVQKSAYLKKQLSLAGIDVVGDGPTFNEFVINCGQPVKDVNRQLLEKGMIGGFDLGSVEPERNGQMLVCVTELRTKEELDLFANEMGALV

SEQ ID NO: 15462 - protein, 474 aa, Thermus thermophilus HB27
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMSRIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 15463 - protein, 305 aa, Methylococcus capsulatus str. Bath
MYYLEPNKDYRNDSLRKGAEFSEAEIRIDTARHYDDCYWDYRTAWFDNENLALHYGYWEEGIKTHSQALINKNRIMAAIAGIEAGDHVLDAGCGIGGSSIWLAKHVGARATGITVSEQQVEHARRNARRHGVADKTEFQVADFCQTPFPDAVFDVVWAVESSCYATDKRDFFREAYRVLKPGGTLIACDGYAARREFDEAEWRAVMDCLNGWAVPNLSTVEEFHAGMEECGFREIHVTEATRETLPSSRRMYLTARWTAPMQWIMHWLGLRKKAQTANYKVALAQWKVFSEGMVRYCIFRAEKPV

SEQ ID NO: 15464 - protein, 488 aa, Nostoc sp. PCC 7120
MQIQTPNWVKNAVFYQIFPDRFARSKQPHKRLLRDARWEDWDAMPTLQGYKGGDLWGIMEQLDYIQDLGIDAIYFTPIFQSASNHRYHTHDYYQVDPMLGGNAAFKELLDASHERNIKVVLDGVFNHSSRGFFFFHDVLENGPHSPWVNWFKIEGWPLAPYTGELPANYVGWADNRALPVFNHDNPEVREYIMEIAEYWIKFGIDGWRLDVPFEIKTPGFWQEFRDRVKAINPEAYIVGEVWGDSSEWLDGTQFDGVMNYLFAGPTIAFAAGDRVVLEQVQSRDYQPYPPLFAAEYATKIQEVLQLYPWDIQLTQLNLLASHDTARLLTIAGGDQASIQLATLLLLTFPGAPSIYYGDEVGLPGGIDPDSRRGFPLEANWDREIYQTHRQLIALRRTYPALRTGDYQVIWAQGALYIFARTLGKEELIIAVNVGTATAQANVDVASLQTQPNKILYGQAEFHWHNTEETKQLFLSLPPRSGCILGLGD

SEQ ID NO: 15465 - protein, 409 aa, Desulfovibrio vulgaris subsp. vulgaris str. Hildenborough
MSICKAEEAIDAIRKGEMIILVDDEDRENEGDLTIAAQHVTPEVINFMATHGRGLICLALSPEWVDKLQLPLMARRNESKFGTNFTVSIEARRGVTTGISAADRATTILTAVADDVKAEDIVTPGHIFPLRAQKGGVMVRAGQTEGSVDLAKLANLKPAAVICEIMREDGEMARMPDLIEFAEKHNMKIATIKDLIRYRMQSGLLSVKRVGEAKMPTRYGDFQIIAYENELHDETHIALVKGDISPSEPVLVRVHSECLTGDVLGSLRCDCGGQLAAALCQIAAKGSGVLLYMRQEGRGIGLGNKIKAYGLQDQGYDTVEANHKLGFKADLRDYGIGAQILVDLGVRKMRMMTNNPKKIVGLEGYGIEVVERVPIELESCAFNEEYLRTKKEKMGHLLELKHHENGGDA

SEQ ID NO: 15466 - protein, 187 aa, Glycine max
  misc_feature (167)..(167): Xaa can be any naturally occurring amino acid
  unsure (1)..(187): unsure at all Xaa locations
MFSNQVHVFRSPFRVLKYPRTKTPPNTRLFLLLLHANNNNNTNAGTSPTFLCSSLSDDSFSTPKPNQLGYNPSEELFGLEELKPSTANSHTPEPRSWFGPNGQYIRELPCPSCRGRGYTPCTGTECGIERSRPDCPKCYGKCSGDCHLWEESIDEQPWEVLSPLKVXEDDEVDAKFGKKNAAAPSPK

SEQ ID NO: 15467 - protein, 188 aa, Brassica napus
  misc_feature (54)..(54): Xaa can be any naturally occurring amino acid
  unsure (1)..(188): unsure at all Xaa locations
VTGGDQVAAAMEIYGPRTTYVLAVKGFPGTHEFLLLDEELLKHDNKTPNFWEGXLYQAGNLNATFDKIEYSKLIDYYVKEKYNLRYTGGMVPDVNQIIVKEKGIFTNVTSPTAKAKLRLLFEVAPLGLLVENAGGFSSDGHNSVLDKTIVNLDDRTQVAYGSKNEIIRFEETLYGTSRLKNVPIGVTA

SEQ ID NO: 15468 - protein, 382 aa, Gibberella zeae PH-1
MSRTTTALVAPNLDGQFKLEQVHLYSLQPDEALVEIHASGVCHTDLACASGKLPCGKNAVLGHEGGGVVIETGSSVTNVTTGDKVLLSFSSCGTCPGCVSSHPAYCYEFNLYNFGGRRADGSATMFTMKEGRKRPMHSRFFGQSSFARHTIVHRTSIVKVPQETPLELFAPLGCGIQTGVGAIFNTLNVKPGSSVAVFGVGSVGLAAIMGAKARKAKTIIAIDLQTQRLELAKELGATHVVLGPDQDHIIDSIQDICPPIGVDFAVDCTGVPAIIETMVAALGMRGRAATVGAPGGMATAKIDIMSHLTYGKEYVGCSEGDSNPEVLIPELIDMHSRGELPLEKLVKQYHIEDYEKAFADMASGSVIKPVLTWEGLKRTSHM

SEQ ID NO: 15469 - protein, 733 aa, Arabidopsis thaliana
MKVQEGLFLVAIFFSLACTQLVKGQHQPGENCQNKCGNITIEYPFGISSGCYYPGNESFSITCKEDRPHVLSDIEVANFNHSGQLQVLLNRSSTCYDEQGKKTEEDSSFTLENLSLSANNKLTAVGCNALSLLDTFGMQNYSTACLSLCDSPPEADGECNGRGCCRVDVSAPLDSYTFETTSGRIKHMTSFHDFSPCTYAFLVEDDKFNFSSTEDLLNLRNVMRFPVLLDWSVGNQTCEQVGSTSICGGNSTCLDSTPRNGYICRCNEGFDGNPYLSAGYVNECTTSSTIHRHNCSDPKTCRNKVGGFYCKCQSGYRLDTTTMSCKRKEFAWTTILLVTTIGFLVILLGVACIQQRMKHLKDTKLREQFFEQNGGGMLTQRLSGAGPSNVDVKIFTEDGMKKATNGYAESRILGQGGQGTVYKGILPDNSIVAIKKARLGDSSQVEQFINEVLVLSQINHRNVVKLLGCCLETEVPLLVYEFITNGTLFDHLHGSMIDSSLTWEHRLKIAIEVAGTLAYLHSSASIPIIHRDIKTANILLDVNLTAKVADFGASRLIPMDKEELETMVQGTLGYLDPEYYNTGLLNEKSDVYSFGVVLMELLSGQKALCFKRPQSSKHLVSYFATATKENRLDEIIGGEVMNEDNLKEIQEAARIAAECTRLMGEERPRMKEVAAKLEALRVEKTKHKWSDQYPEENEHLIGGHILSAQGETSSSIGYDSIKNVAILDIETGR

SEQ ID NO: 15470 - protein, 544 aa, Arabidopsis thaliana
  misc_feature (214)..(214): Xaa can be any naturally occurring amino acid
  misc_feature (244)..(244): Xaa can be any naturally occurring amino acid
  misc_feature (259)..(259): Xaa can be any naturally occurring amino acid
  unsure (1)..(544): unsure at all Xaa locations
MSSINLSSSSPSTISLSRSRLSQSSTTLLHGLHRVTLPSNHPLSTFSIKTNTGKVKAAVISREDDLLSFTNGNTPLSNGSLIDDRTEEPLEADSVSLGTLAADSAPAPANGFVAEDDDGELDLPTPGFSSIPEAIEDIRQGKLVVVVDDEDRENEGDLVMAAQLATPEAMAFIVRHGTGIVCVSMKEDDLERLHLPLMVNQKENEEKLSTAFTXVTVGAKHGTNPGVSARDRATTILSLASRDXKPEAFNLSGHMTPLXYHRGGVLQRAGHTESCDEFPVLAGLDPVGVLCEIVDDDGSMARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 15471 - protein, 293 aa, Nocardia farcinica IFM 10152
MSEADVTARGDAALLGPAEVRALAERFGVRPTKQLGQNFVHDANTVRRIVTAAGVGRADTVLEVGPGLGSLTLALLDVVDSVVAVEIDPVLAEHLPRTVADRAPALAGRLRVVRDDALRVRAADLPASPTALVANLPYNVAVPVLLHLLAELPGLRTALVMVQAEVADRLAAEPGSRVYGVPSVKAGFFGTVRRAGAVGTQVFWPVPRVESGLVRVERYVEPPWPMDEQHRRRVFEIIDAAFAQRRKTLRAALAGWAGSPAEAERRLLAAGIDPTARGETLDTAAYVRLAAQA

SEQ ID NO: 15472 - protein, 398 aa, Bradyrhizobium sp. BTAi1
MNEQSPALRNFTINFGPQHPAAHGVLRLVLELDGEVVERVDPHIGLLHRGTEKLIETKTYLQAMPYFDRLDYVAPMNQEHAFCLAAERLLGIEVPRRGQLIRVLYSEIGRLLSHLLNVTTQAMDVGALTPPLWGFEEREKLMVFYERASGSRMHANYFRIGGVHQDLPPKLIDDIDAFCDPFLKVVDDLDQLLTGNRIFKQRNVDIGVVTLKQAWEWGFSGVMVRGSGAAWDLRKSQPYDVYAEMEFDVPIGKNGDCYDRYLIRMEEMRQSVRIMKQCIQKLRAPDGQGPVVVTDNKIAPPRRGEMKRSMEALIHHFKLYTEGVHVPAGEIYAAVEAPKGEFGVYLVSDGSNKPYKCKIRAPGFAHLQAMDFLCRGHLLADVSAILGSLDIVFGEVDR

SEQ ID NO: 15473 - protein, 176 aa, Triticum aestivum
  misc_feature (156)..(156): Xaa can be any naturally occurring amino acid
  unsure (1)..(176): unsure at all Xaa locations
MAPTVMASAGASVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQXVQCVSFIAFKPPGCKESGKG

SEQ ID NO: 15474 - protein, 714 aa, Arabidopsis thaliana
MKFQEGVFLVVIFFLAYTQLVKGQHQPREDCKLKCGNVTIEYPFGISTGCYYPGDDNFNLTCVVEEKLLLFGIIQVTNISHSGHVSVLFERFSECYEQKNETNGTALGYQLGSSFSLSSNNKFTLVGCNALSLLSTFGKQNYSTGCLSLCNSQPEANGRCNGVGCCTTEDFSVPFDSDTFQFGSVRLRNQVNNSLDLFNTSVYQFNPCTYAFLVEDGKFNFDSSKDLKNLRNVTRFPVALDWSIGNQTCEQAGSTRICGKNSSCYNSTTRNGYICKCNEGYDGNPYRSEGCKDIDECISDTHNCSDPKTCRNRDGGFDLIIIGVLVLLLAAICIQHATKQRKYTKLRRQFFEQNGGGMLIQRLSGAGLSNIDFKIFTEEGMKEATNGYDESRILGQGGQGTVYKGILPDNTIVAIKKARLADSRQVDQFIHEVLVLSQINHRNVVKILGCCLETEVPLLVYEFITNGTLFDHLHGSIFDSSLTWEHRLRIAIEVAGTLAYLHSSASIPIIHRDIKTANILLDENLTAKVADFGASKLIPMDKEQLTTMVQGTLGYLDPEYYTTGLLNEKSDVYSFGVVLMELLSGQKALCFERPQASKHLVSYFVSATEENRLHEIIDDQVLNEDNLKEIQEAARIAAECTRLMGEERPRMKEVAAKLEALRVEKTKHKWSDQYPEENEHLIGGHILSAQGETSSSIGYDSIKNVAILDIETGR

SEQ ID NO: 15475 - protein, 271 aa, Photobacterium profundum
MSSDQVHLGHRARKRFGQNFLNDPYIIDGIVSSINPLPGQNLVEIGPGLGALTEPVGRLVDKFSVIELDRDLAKRLRHHPDLADKLTIYEGDAMRFDFTQLIKPNNKLRIFGNLPYNISTPLMFHLFTFHEHVEDMHFMLQKEVVNRLAAGPGCKAYGRLTVMAQYYSRVTPVLEVPPESFTPAPKVDSAVVRLTPYEVLPHPCTNLKWLDRVCREGFNQRRKTIRNCYKALLTVEQLEDLGVNPGLRPENITLQQFVKMANWLDANHQNA

SEQ ID NO: 15476 - protein, 666 aa, Cryptococcus neoformans var. neoformans B-3501A
MSGNVACARVRSQSSTFSPLETRDGDEQESSSSDSQHGSSKRGPQRRATDLPSAADLYVPSLPGLPEMATHPTHPLNIYAGMLPSYPGEGKVGGEGQTGKDAKLYFLMAKARRNAGKERVIFWFNGGPGCSSFDGSLMEVGPFRTVPATETTSGMVEAKLVEGGWEEFATVVFVDQPPGTGYSYAATDGYLHDFDELSAHFIEFLQNFYTVFPELKGVDTYLAGESFAGQYIPFFADALIKSIELPNFPLKGIAIGNGWIDPKEQYPGYVEFAYEKGLIVSGTPEAEEMESALKRCQEEMDKYSDPFTTPVNINNCGQVMDSVTRPFTQELNGKKVCMNVYDVRLVDDFPACGMNWPPDLPDVYTFLRQDDVISALHATSKETAWVECNNKVSYELNLKKSHMSAALLPSILEAGVPILMFAGAEDLICNYKGIERIVNGLEWDGEKGFGNATSQEWYFNGTQVGTWQTSRGLSYAKIFDSSHMVGFDVPHVSNDMIMRFMDVDVSLLPGMTAQWPSRIGDDERTMIHVGDGESGGVPLIEGGNTDWEAWYNAIFAFLVLGILVSIAGLYFYFRRKPVSYRSRISLKQRSRRRRGHDMDEDEAAERMPLGSERLELDDIERAEGYEFHDGDGERYSREGKGKGKERAKDGEEVVFALGDDDEDDHH

SEQ ID NO: 15477 - protein, 284 aa, Candidatus Protochlamydia amoebophila UWE25
MPIYKPSELRLFLNQLGIFPKKGLSQNFLIDGNIIRKIVRASDVQPGNLVLEIGPGPGSLTQAMLEVEAHVVAVEKDFVLARELKRFQTPSKQLEIFCEDILMFSVEEELQSRLRDDQKAKVIANLPYHLTTPILAEMVVRRKLFSSLTVMVQEEVARRMTALPGQSDYSSFTIFLNFYSKPRYGFTVSRNCFYPAPKVDSAIVVLELKEPPPNIDAQVFFKITRTAFEQRRKMLRASLKSLFDPSKISNALEIIGQNPQARPEVLSLEDFIKLYHELYSSERH

SEQ ID NO: 15478 - protein, 519 aa, Arabidopsis thaliana
MVFISLFEISIAFFCFLLFRHFLINKKTHRLCPTNWPFFGMIPGLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 15479 - protein, 527 aa, Zymomonas mobilis subsp. mobilis ZM4
MTRVLISDKMDPRAAEVFRERGVEVDQITGLSPEELKKIINDYDGLAIRSATKVTKDIIAEAKNLKVIGRAGIGVDNIDIPAASSAGIVVMNTPFGNSITTAEQAIALMFALARQIPEANASTQASKWEKNRFMGVEVSGKTLGLIGAGNIGSIVADRAVGLKMKVIAYDPFLTPERALELGIEKADLETLLHKADFITLHVPLTDQTRNILSRENLAKTKKGVRIINCARGGLIDEEALKDALESGHVAGAALDVFLKEPAKENPLFGVPNFIATPHLGASTTEAQVNVAIQVAEQMADYLLTGGVSNALNMPSLSAEEAPRVRPYMALSEQLGRLLGQLEGDKIKSVSIEVEGAAAHLDQKPITSAVLSGLMGVYSQSVNMVNAPFLARERGLDVREIRHDREGAYHTLIRVTSRDDKGQEKSVAGTLFGSEGTRLVEIFGIKIEANLSGDMLYIVNDDAPGFIGRLGTLLGKAGVNIGTFHLGRRNTGGEAVLLLSVDSPVTAGKMAKVAELSGVREVKSLHFL

SEQ ID NO: 15480 - protein, 70 aa, Oryza sativa (japonica cultivar-group)
MAWRANLSRGVKEIRFLFCQSSPASAPAREFVKKNYGDIKARNPSLPVLIRECSGVEPQLWARYDKKNIP

SEQ ID NO: 15481 - protein, 148 aa, Bacillus licheniformis ATCC 14580
MEKTFVMVKPDGVQRQLIGEILLRFERKGLQLIGAKLMKVSEETAGEHYKEHNGKPFFGELVDFITSGPVFAMVWEGEDAIAVARQLIGKTNPKEALPGTIRGDFGMFVGKNIIHGSDSPESAAREINLFFKEDELVEDEKLMNQWIY

SEQ ID NO: 15482 - protein, 149 aa, Carboxydothermus hydrogenoformans Z-2901
MERTFIMVKPDGVQRGLVGEIISRFEKRGFKLVGLKLMQISRELAETHYGEHKGKPFFEGLLNFITSGPVVAMVWEGKEVIATAREMMGATNPLKAQPGTIRGTYGIDVGRNVIHGSDSPESAAREIALFFKEEELLSYEKTLDTWIYE

SEQ ID NO: 15483 - protein, 151 aa, Triticum aestivum
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGAAPKSPKKTTKSPKKA

SEQ ID NO: 15484 - protein, 330 aa, Oceanobacter sp. RED65
MKQALLDILADGQFHSGEEIGEALGVSRAAVWKQLKKLEALDIPLHSVKGKGYRLPEPVGLLSLSKLEQHGLTQDYFDSIDLALSLDSTNSAMMRLAETQPGGRHLIFAEMQTQGRGRRGRQWVSPFARNLYFSVLWTFEQGIAAIQGLSLAVGLSIYHTLKRYGLESHGLKWPNDILVAKDADTFAKLGGILIEITGDVSDQCQVVIGVGLNLDIQTRDLAHIDQLATGLRQQGIEFDRNELAATLLMDLSDTLNGFSQHGFSPLQQHWNEADALHGHKVNLILPSSELTGIARGVNAIGELQLEIDGQLQVYNGGEVTLRSQGKHHEA

SEQ ID NO: 15485 - protein, 156 aa, Magnetospirillum magnetotacticum MS-1
MRRAKIVCTIGPATESKEQLRALVDAGMDVARINRSHGSAEEHAAVYHGVREAAAESGRSVAVLVDLQGPKIRLGRFAGDEKHWLEEGDTFTITTEDVVGTKELVSTTHKGLPGDARVGDPILIDDGKVLVRVTGVEGPRVVTRVEVAGPVSNNRA

SEQ ID NO: 15486 - protein, 841 aa, Arabidopsis thaliana
MGKKWIVFFAYLLLSSFFISSSSAGITKESPLPIGQTLSSSNGFYELGFFNFNNSQNQYVGIWFKGIIPRVVVWVANREKPVTDSTANLAISNNGSLLLFNGKHGVAWSSGEALVSNGSRAELSDTGNLIVIDNFSGRTLWQSFDHLGDTMLPSSTLKYNLATGEKQVLSSWKSYTDPSVGDFVLQITPQVPTQVLVTKGSTPYYRSGPWAKTRFTGIPLMDDTFTGPVSVQQDTNGSGSLTYLNRNDRLQRTMLTSKGTQELSWHNGTDWVLNFVAPEHSCDYYGVCGPFGLCVKSVPPKCTCFKGFVPKLIEEWKRGNWTGGCVRRTELYCQGNSTGKYANVFHPVARIKPPDFYEFASFVNVEECQKSCLHNCSCLAFAYIDGIGCLMWNQDLMDAVQFSEGGELLSIRLARSELGGNKRKKAITASIVSLSLVVIIAFVAFCFWRYRVKHNVSADITTDASQVSWRNDLKPQDVPGLDFFDMHTIQTATNNFSISNKLGQGGFGPVYKGKLQDGKEIAVKRLSSSSGQGKEEFMNEIVLISKLQHKNLVRILGCCIEGEEKLLIYEFMLNNSLDTFLFGGFLLASFLYYQQLFLYMELSYLIVHTLYCRLDSRKRLEIDWPKRLDIIQGIARGIHYLHRDSHLKVIHRDLKVSNILLDEKMNPKISDFGLARMYQGTEYQDNTRRVVGTLGYMAPEYAWTGMFSEKSDIYSFGVLMLEIISGEKISRFSYGKEEKTLIAYAWESWCDTGGIDLLDKDVADSCRPLEVERCVQIGLLCVQHQPADRPNTLELLSMLTTTSDLPPPEQPTFVVHRRDDKSSSEDLITVNEMTKSVILGR

SEQ ID NO: 15487 - protein, 444 aa, Burkholderia pseudomallei K96243
MQDIDDFLRQHRITEVEAIIPDMAGIARGKIIPRNKFETGESMRLPQAVMVQTVTGDYPEDGTLTGVTDPDMVCVADASTICLIPWAVDPTAQVIHDCVHFDGSPVEISPRYVLRRVLDLYRARGWKPVVAPELEFYLVDMNKDPDLPLRPPVGRTGRAETGRQSYSIEAVNEFDPLFEDIYEYCELQGLDIDTLIHEVGAAQMEINFLHGDALSLADQVFLFKRTVREAALRHNMYATFMAKPMESEPGSAMHIHQSVVDIETGRNLFIGASGDVTPMFRSYLAGLQKYTPALMPIFAPYINSYRRLSRFMAAPINVQWGYDNRTVGFRIPHSAAAARRIENRIPGVDCNPYLAIAGTLAAGYLGVTQGLEPTEPLASDGYSLPYQLPRNLEEGLTLMSACAPLAEMLGEKFVKAYLALKETEYEAFFRVISSWERRHLLLHV

SEQ ID NO: 15488 - protein, 544 aa, Aspergillus oryzae
MVKLGKNSKRTPVRLRHKIEKASAAKQRKQRKLAKKNPEWRSKIKKDPGIPNLFPHKAQLLHEMEERKRLKAEEQERIRDEARARKKAQKESQQQGDDAEDVMENDIDLEGDSDDEDMDEDVDESSNPMAALLASARARAAEYEDQHESDDDDEMDEDEDEDMDGMDEDEEEGGAALGDSAPQLVSQTHSKESSRRQFDKVFKQVVDAADVVLYVLDARDPEGTRSKDVEREIMAAAGGNKRMILILNKIDLIPPPVLKNWLVHLRRYFPTLPLKASNGTANAHSFDHKQLTVKGTSETLFKALKSYAHSKNLKRSISVGVIGYPNVGKSSVINALTARLNKGSSNACPTGAEAGVTTNLREVKLDNKLKLIDSPGIVFPNAEKKKSKKKQVEERARLVLLNAIPPKQIEDPVPAVSLLLKRLSTSEDLKSKLLQLYGIPALFNAGDQTHDFLIHVARKRGRLGKHGVPNIEAAAMTVINDWRDGRIQGWVDAPVLPVVAATDDASAPAAAASGVDTKQVVTEWAKEFKIEGLWGDGADAEMAE

SEQ ID NO: 15489 - protein, 697 aa, Triticum aestivum
MAGAARGRRCRGAVLLLLAASVLAPLVLYGRFPVSPLPDSAGTGAFDRGDGSGSNLVWPHMAASEVSLAKDLTIERLGEHKNRVLSATDDWQAVEVARSHPSEKKIDTWEDPASRDAHQVVAVGNDSAQSTQDDMIKEVVSTDGRADGFRDPGDSKEAEEQDGQGMDEKELQDATELEHKDGSGASENNIAGTDTAGNLTLSLNKESAADTSSDQTTHASTNADLATSASSTYHSATSPDATIRIIKDQLIRAKTYLGVLASRGNHGTAKELRARMKDIQRALGDATDDGMLRQNVHGKIKAMEQTLGRIKRMHDGCSGAVNRLRTSLHSTEERLQSHRKDANYLAQLAAKSLPKGLHCLPLRLTNEYYSSNSNNKDFPNTEKLEDPELHHYAVFSDNVLAAAVVVNSTLVHAKKPANHVFHIVTDRLNYAAMKMWFLANPLGEAAVQVQNIEEFTWLNSSYSPVLKQLESSSMIDYYFGSGKARPGENPKFRNPKYLSILNHLRFYLPEIFPKLNKVLFLDDDTVVQQDLSALWSMDLKGKVNGAVETCGESFHRFDKYLNFSNPLIASNFDPHACGWAYGMNMFDLSEWRKQNITDVYHTWQNLNEDRLLWKLGSLPAGLVTFWNHTFPLDRSWHLLGLGYNPNVNEKEIRRASVIHYNGNLKPWLEIGLSKYRKYWSRHVNYDQVFIRECNINP

SEQ ID NO: 15490 - protein, 850 aa, Trichodesmium erythraeum IMS101
MQEVQPEKPYTEKVKIQIEDDRTGTSLDTIKRAIADNLYYLQGKNIEFATPYDYYMALAYTVRDRLLHRHLQTTKTYSNQNVKTVYYLSAEFLMGRQLAKNLVNVGCWEVARQALEESCLQLHDLIEKEPEPGLGNGGLGRLAACFLDSLATLQIPAVGYGIRYEFGIFKQLVHNGFQVEQPDKWLSLGNPWEIPRYEEKVEIKLGGDTETYTDKEGNYRVRWIPERTVIGMPYDTLVPGYNTNTVNNLRLWSAKASNEFDLQVFDSGDYNRAVEDKTVSENISKVLYPNDNIFQGKMLRLEQQYFFVSCSLQDIIRTHLSRNRNLDNFHKKVAIQLNDTHPSIGVAELMRLLIDEHKMEWEKAWKITQNTFGYTNHTLLAEALERWPVSMFKSLLPRHIEIIYEINFHLLEELKKRYPGDDRRLARMSLIEEQPEKSVRMAHLACTGAHAINGVAKLHTQLLKTDVLKDFYKLWPEKFTNKTNGITPRRWLLISNPKLALLITNKIGKNWINNLEEIQQLKQFVNDQEFRYNWSQIKYENKQDLATYIKQNIGVVVNPNSLFDIQVKRLHEYKRQLLNVFHIITLYNRIKENPDTDILHRTFIFGAKAAPGYSMAKLIIKLINAVAEIVNNDPDVRHRLKIVFIPNFSVSLGQQIYPAADLSEQISTAGKEASGTGNMKFSLNGALTIGTLDGANIEIREAVGADNFFLFGLTVEEVKALKYQGYNPQKYYNDNKELRQVIDRIASGYFSPGKPDLFQPLIVSLLEKDEYMLLADYQSYIDCQEEVNKAYRNPEYWTRMSIINSINMGKFSADRTISEYCQEIWNVDPVKIDMEAYNQETAGLQRHCQI

SEQ ID NO: 15491 - protein, 492 aa, Zea mays
MHGPYPTAAAAAASSSDDMAANGMKVALHRQVSGGSMKQNAELRRQASLESPRTGRATSRFLFGRQSSMDPNRRRGRSQSPVRAPEDLGVPDNLDATMQLLFFACQGDALGIEGLLRSGVDVNSINLDGRTALHIAACEGHRDVVRVLISWKANIDARDRWGSTAVADAKFYGHSRVYDLLKFHGAKVPRTKRTPMMVSAPAEIPEYELNPGEVQFRRGCDVTPGVYHIAKWNGTKVSVKILDRDGCSDQEAANSFRHELTVLEKVRHPNVVQFVGAVTQSIPMMIVSELHEEKDLSVCIQKKGKLKPQKVLRYGLDIARGMTYLHQCKPDPIIHCDLKPKHIFLDSGGQLKIAGFGVTRMSKVGTDKVRLIYHGALVDSFSYHTAPELYRNDAFDSSVDSYSFGFILYEMVEGSVRAPEDSGHSIRFEGLRPSLKGRLKGYPPDFKALVEECWHPQAMARPTFSEIIIRLDKIYAHFDKHGSWKDSLKLWK

SEQ ID NO: 15492 - protein, 476 aa, Burkholderia thailandensis E264
MNIHPVILCGGSGTRLWPMSRGGYPKQYLKLAGNTTLVQQTALRVRDVEGVGAPIVVTNNEQRFLVAEQLRQVGITPSSIVLEPMGRNTAPAIAIAALLALRESPDALLLVLPSDHVIDNETAFVDVVKTAASVASDAHLVTFGVTPTQAHTGYGYIRRGEAFAGDTRVYRVDAFVEKPDAPAAERFIADGGYYWNSGMFMLKASTYLDELRRHAPDIANQAELALGAAKRDHDFLRLDPEAFGASPNVSIDYAVMEKTERAAVVAAANLGWNDIGSWSALADIAATDAQRNALIGDVYTDAVENSYIRAEHRMVAALGLDNIVIVETADAVLVAHRDRAQDVKKVVEWLNASGRRESVTHRRVIRPWGAYEGIDQGERFQVKRIVVNPGAQLSLQMHHHRAEHWIVVKGTALVTNDGKEIILTENQSTYIPLGTTHRLKNPGKIPLELIEVQSGSYLGEDDIVRFEDTYGRTSAT

SEQ ID NO: 15493 - protein, 86 aa, Medicago truncatula
MSIFSPATRDRADGQVQYGFGLQSESLREASYQRADPNFVMLTPSKEHLAEGIVWETGKRPMLQSDIDAGHFDGLPRELRPLDKIL

SEQ ID NO: 15494 - protein, 412 aa, Burkholderia thailandensis E264
MKPIQKSNKLLNVCYDIRGPVLEHAKRLEEEGHRIIKLNIGNLAPFGFDAPDEIIQDMIRNLPTSSGYSDSKGVFAARKAIMHYTQQKGVHGVGLDDIYIGNGASELIVMATQALLNDGDEVLLPAPDYPLWTAAVSLSGGTPVHYICDESNRWMPDPDDIRRKITPNTKALVVINPNNPTGALYSDELLVELIAIAREHGLIIFADEVYDKIVYDGQSHTALASLAPDVITVTFNSLSKSYRSCGYRAGWMSVAGLTAENRRRAHDYLEGLGILSSMRLCANVPGQYAIQTALGGYQSINELIMPSGRLYKQRELAYDMLTAIPGVSCVKPEAALYMFPRLDPKLYPIENDQQFILELLLKERVLLVQGTGFNWPTPDHFRVVFLPNVDDLTDSIERIARFLDGYRKRHSA

SEQ ID NO: 15495 - protein, 315 aa, Schizosaccharomyces pombe
RARRIDGYKSVVNSYYDLATDLYEYGWSQSFHFSRFYKGEAFAQSIARHEHYLAYRMGIKPGSRVLDVGCGVGGPAREITEFTGCNLVGLNNNDYQISRCNNYAVKRNLDKKQVFVKGDFMHMPFEDNTFDYVYAIEATVHAPSLEGVYGEIFRVLKPGGVFGVYEWVMSDDYDSSIPKHREIAYNIEVGDGIPQMVRKCDAVEAIKKVGFNLLEEDDLTDHDNPDLPWYYPLTGDITKCQNIWDVFTVFRTSRLGKLVTRYSVQFLEKIGVAAKGTSKVGDTLAIAQKGLIEGGETHLFTPMFLMIAKKPETDA

SEQ ID NO: 15496 - protein, 361 aa, Medicago truncatula
MLIWKWIVSWYRNEVESPPPVVLVPPLFDFPPIAARNRMLESSYDVVFGKLALRCLFNDYFQQPKHFVTRIMLKPIDDPHVDLIATVSGPLDQKPDENINGNALFRWQRVLQMRSCAYYPRYGFGAFGVFPLLLKNRETSQDSGVMGLRYGSGNLSCGVTLMPFAKKDELPKSVWLVSKIGRVTAGVQYEPHHENAKLSNLMNWSCAMAYGVGSQSPLSPSFNFSLELVKSSQFVASFYQHMVVQRRVKNPLEENTVVGITNYIDFGFELQTSVDDAIAANNISDSTFQIAASWQANKNFLVKAKAGPKSSTMALAFKSWWKPSFTFSISGTSSRNFLFNLVSVIIFLSFTSRFLVEIWPW

SEQ ID NO: 15497 - protein, 553 aa, Triticum aestivum
  misc_feature (523)..(523): Xaa can be any naturally occurring amino acid
  unsure (1)..(553): unsure at all Xaa locations
MAPSIAPPSSPSCLRGKLFPRFTGTNSQPMNSVPTRPPTRPPTLASNSLRRTSSVHLANNNRIKSFHVCHAGVDPSERIVVNGQASPSKTVQADAAALGTISADMAPVVDGFSADDDELDLDLPTEGFSSIPEAIEDIRQGKYVIVVDDEDRENEEDLIMAAFTVTPEQVCSKKQAGTGPEFPGLRRPARPRLQLPLMVVAKENEEKLRTPFTVSVDAKEGTTTGVSAKDRANTVLALASPYSKPEDFNRPGHIFPLKYREGGVLKRAGHTEASVDLAMLAGLPPAAVLCEIVDDDDGSMALLPKLKEFAERENLKIVSIADLIRYRRKRDRLVERLCVTPLQLQWGSFESYCYRSLIDGMEHIAMIKGDVGDGQDILVRVHSECLTGDIFGSARCDCGGQLALAMTMIEKAGRGVVVYLRGHEGRGIGLGHKLRAYNLQDAGRDTVEANEDLGLPADSREYGIGAQILRDLGVRTMRLMTNNPAKYTGLKGYGLSVLGRVPLLTPITNENRRYMETKRLKMXGHIYEDPPNGHTSGMSDEEQYQEDSGSEQD

SEQ ID NO: 15498 - protein, 480 aa, Idiomarina loihiensis L2TR
MSSLTKKDCFIEGHWVPTDKRFSVTNPATGEVIAEVADADEDLTQRAINVAETALKSWRKKTARERAMLLRKWYEAMMDNKQALGELMSAEQGKPVAEAVGEVEYGASFVDWFAGEAERIDGDILPNADSSKRVMVTKEPVGVCAAITPWNFPNAMITRKIAPALAAGCTIVVKPPQLTPLSSLALAQLASEVGIPDGVINIIPTSDAKSVGKRLATSPQVRKLSFTGSTGVGKILMQQCSEHVTKLSLELGGNAPFLVFDDADIEQAAEQLIACKFRNAGQTCVSANRILVQQSVAEKFTDAVVSKVKALKVGPGTEENVDLGPLIDQDAVDKVQRLVLAAKSDGATIETGGSVMTELGDLFYAPTVITGVTEEMDISEEEIFGPVVAINTFETEEEGIEKANNTPFGLASYFAAKDTARIFRVSDALEYGMVGVNTGGISHAYNPFGGIKESGVGREGSKYGIDEYLELKTVTLGGLG

SEQ ID NO: 15499 - protein, 398 aa, Cucumis sativus
MALQAASLVSPALSIPKEGKSSVCLKDSSLFGISFSDHLKSEFSSSTLRCKRELNQQIGAIRAQTTATESPAVNKATPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFLLSRLLLEDLNKSSYPSKRLIIVGSITGNTNTLAGNVPPKANLGDLRGLAGGLNGLKSSMIDGGEFDGAKAYKDSKVCNMLTMQEFHKRYHEETGITFASLYPGCIATTGLFREHIPLFRILFPPFQKFITQGYVSEDEAGKRLAQVVSEPSLTKSGVYWSWNKNSASFENQLSQEASDAEKARKVWELSEKLVGLA

SEQ ID NO: 15500 - protein, 342 aa, Triticum aestivum
RPGEAVSSTGIGGGWQLAWKWSERQGEDGKKEGGFKRIYLHQEGVADSRRGSVVSLPGGGDATQGGSGFIHAAALVSHSALYSKDLMEERMAAGPAMIHPLEAAPKGSIWKDLFEPGVRRALFVGVGIQMLQQFAGINGVLYYTPQILEQAGVAVLLSNLGLSSASASILISSLTTLLMLPSIGVAMRLMDISGRRFLLLGTIPILIASLIVLGVVNVINLSTVPHAVLSTVSVIVYFCCFVMGFGPIPNILCAEIFPTRVRGVCIAICALTFWICDIIVTYSLPVMLNAIGLAGVFGIYAVVCCIAFVFVYLKVPETKGMPLEVITEFFAVGAKQAQATIA

SEQ ID NO: 15501 - protein, 110 aa, Zea mays
MASGSNPDSMDTEPPGVLSIAVERNPPESRLQQLGVKSWPKWGCPPGKFPVKFDARQTCYLLKGKVRAHIKGSSECVEFGAGDLVVFPKGLSCTWDVVAAVDKYYKFDSS

SEQ ID NO: 15502 - protein, 469 aa, Rhodobacter sphaeroides 2.4.1
MSKVADALKLMKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGTAVKAEAYLKASGIGDVAYFGPEAEFFIFDDVRYSVTPAKVAYQIDADAAAWNTDSEYEMGNLAHRAGHKGGYFPVNPIDEAQDLRGEMLSTMKRMGMKVDKHHHEVATCQHELGLIFGGLTEQADNILKYKYVIHNVAAAYGKTVTFMPKPMKGDNGSGMHVNMSIWKDGKPLFAGDKYADLSQEALWFIGGILKHAKALNALTNPATNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 15503 - protein, 195 aa, Nostoc punctiforme PCC 73102
MLTPGKFDFYVLTLSWSPDYCAKNGTRDPQQCGSGRKLGFVLHGLWPQYQTGYPANCSTQKLPSEVKQRFPNLYPSNKLYDHEWEKHGTCSGKTPAEYLGLSKNLKDAIAIPAAYNRPNKPLRTTITNFKNSFVSANNKITADGVAPFCSGSGRFLQEVFFCYSKNGEPGICSAEILKRSRKSCGQPDFLVRNVR

SEQ ID NO: 15504 - protein, 315 aa, Flavobacteria bacterium BBFL7
MKSLKFKNGDELFPIGLGTWKSKPGEVKNAVISALESGYTHIDCAAIYGNEKEIGEAFNEVFSKGDIKREDVWITSKLWNNAHLPKDVEPAMKQTLQDLQLDYLDLYLIHWPVAFKPDVQSPEGPEDFLTPQEAPVSETWNAMTQLKEKGLAKHIGVSNFSKQKLDELISNTDEIPEMNQVELHPLLQQNELFEYCSNKGIHLTGYSPLGSGDRSEGMKQENEPNMFEKTAVQKIASKHNVSPAQVLINWSAQRGTAVIPKSTNPGRIKENLEAARIQLDKEDLKDLAQLDEHYRYVTGKFFEVEEKGYKNIYDE

SEQ ID NO: 15505 - protein, 1241 aa, Neurospora crassa
MGKLIRLELFNFKSYKGHHTLLFGDSYFTSIIGPNGSGKSNSMDAISFVLGIKSSHLRSTHLRDLVYRGHPSQRSSRNDPKTAWVMAVYEDDAGDEQRWKRTITNSGSSEYRINDRVVTAQQYNDALEAENILIKARNFLVFQGDVEAIASQSPQDLTRLIEQISGSLEYKADYEKLQAEVEQAAENQNFQLHRRRGINSEIKQYQEQKKEAENFQRKTEERDEAVITHILWKLYHFQKVMDESSAQIQEHQENLKEFRRNVEAFENKLDAARKEQATVGREVGKVERNIKAKEKDIEDKENSLVPIDEKIAQSTQDMGVLRKRIVEVKKDRDSQASSISKLQKDLATVEKAQQQFEKQWAETLKKQGKELSDEDRKEYTSLQAEAMKKTADNRAKLANLTRQLKSDEVTVNSLKGKIDNFEAAIEKLQTEVQSIKDRKDASEDAVQQLRSDIAAKKKEYNKLQSERVRINQTRTAQEEKLREILRKLEDAESGRRQNEKETRLRNMISDLRRIYPGVRGRVGDLCKPKQKKFDEAVITALGRDFDAVVVDTEKVGMDCVQYLKEQRFPPLTFIPLDNIKVNSSVSAVKGISGARLTIDTIDFDPSLERAISYACGGSVVCDNLHIAKDIVYGRKIQVKAVTLEGFVIHKAGTMTGGRLPNEKGGKRRFEEHDIQNLQRMAQSLKDEVAALAHSGRRTAKEDALLVEFTALEQRLKIQEGELAAFEKNLKSKQKELDHQERQLDDYEPKYEEKHGELERTRATVQKFEKAISDVEDKIFKDFCKRLGYENVRAYEAQQGTLEQEAAQKRQDFDIQKQRIQSNITWEMSQHTATSDRIASLERTLQRHERDLDTYRQEKASIEEELAEDREALEELEQSLEELKVSHAEKTKKVQEAKQDLQRRSRDIEVRLKEISNLEATVQQSSAQKLALLRRCKLEQIQIPLQQGSLDDIPNEDMLLQKDQDAMDVDGEDEDQEAELLEAAMDDYGVEINYDNLDDALLQDPNDEVEEKLQEKISALTAEIEKLNPNMRAIERLESVKSRLESTEKDFEDSRAALKAARDAFNQVKDKRFELFNKAFTHIQEQITHVYKDLTRSDAYPLGGQAYLDIEEDTDTPYLSGIKYHAMPPLKRFRDMEHLSGGEKTMAALALLFAIHSYQPSPFFVLDEVDAALDNANVEKIKKYIREHAGPGMQFIVISLKAGLFQDSESLVGVYRDQDVNSSKTLTLDVSFSPPFLLLLTI

SEQ ID NO: 15506 - protein, 262 aa, Candidatus Pelagibacter ubique HTCC1002
MFIKAKKSLGQNFLIDREVLEKIVSITDITNKEVLEIGPGSGNLTTYILKKKPKKLYVVEKDDDLAILLKEKFDTEIKIINDDILKVSESTISDQKLSVFGNLPYNISTEILSKWILNIGSNFWFDSLVLMFQKEVADRIISKFNNSNYGRLSILSSWKLNVKKILDIKPQSFSPRPKIDSSLLLFTPKENFFKLKDPKNLEKITRIFFSQRRKMLKKPFNQVFDNGKEVAEKFGIDLNLRPQNLEPEVYFKLVKEYEDLRG

SEQ ID NO: 15507 - protein, 373 aa, Silicibacter pomeroyi DSS-3
MSFETPGPVEARLRDAISPIEEIIDEARKGRMYILVDHEDRENEGDLCIAAEFADAAAINFMATHGRGLICLPMTADRIDRLGLPMMAVNNSSRHETAFTVSIEAREGVSTGISAADRALTVATAINEQNTMASLATPGHIFPLRAKRGGVLVRAGHTEAAVDISRLAGLNPSGVICEIMKEDGTMARLPDLVDFAERHGMKIGTISDLISYRARNDNLVDETARSTVTSEYGGDWEMRIFTDQTHGIEHVVLVKGDISTPEPVLTRTHALHEASDVLGLGPKPTQELPRAMEKIAAEGRGVVCLFRQPRNALYASDEDGVRTIKQTGLGAQILSKMGLHELILLTDSPQTRYLGLDAYGLTIVGTRPILKDA

SEQ ID NO: 15508 - protein, 542 aa, Yarrowia lipolytica
MIYTANSSPSTNLQWLSTLNTDDIPTKNYRKSSIIGTIGPNTNSAEMISKLRQAGLNIVRMNFSHGSYEYHQSVIENARESEQRFRGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLATPTLSEFSSVSKLFNTNLLDYKTYSMVIKSVNGGVLYK

SEQ ID NO: 15509 - protein, 540 aa, Shewanella oneidensis MR-1
MSELTWWRGAVIYQIYPRSLLDTNGDGVGDLRGIITKLDYIASLNVDAIWISPFFKSPMADFGYDISDYREIDPLFGSMQDFDELIEKAHQRGIKVIIDQVLSHTSDQHAWFIESRESRTNPKADWYVWADPREDGTPPNNWLAIFGGCAWEWEPRRQQYYLHNFLRSQPDINFHNPDVRQAVLDNVEFWLKKGVDGFRLDAITFCFHDELLRDNPAKPKEKRQGRGFSEDNPYAYQYHYYNNDRPQTIQFIEALRQLINRYPGTVTLGEVSAEDSLAVMAAYTKGDDRLHMAYSFELLTDDYSAAYIRQTVEALENSIGDGWPCWAIGNHDVQRVASRWGRGKQTSDMAKMLNAMLCSLRGSVCSYQGEELGLTEVPIEFHELQDPFGKTFWPMFKGRDGCRTPMPWEQYADFSGFSQVSPWLPIAAAHRALAVDLQEADCHSVLHGYRQFLAWRKCYPALITSEIEFLDAPEPLLVFVRKLGEQKLLVCFNLLDAETQLSLTGLKLQQELAGHGLKTAHRQGDSLIFSAYASFYALLA

SEQ ID NO: 15510 - protein, 309 aa, Cryptococcus neoformans var. neoformans B-3501A
MSAPTSFKLNNGVEIPAVGLGTWQAPPGQVQAAVAHALKNGYRHLDCALIYQNEAEVGDGIKESGVPRSEIFITSKVWNTHQPNVADGLRQTLEALQTDYLDLYLIHWPVRLVPNESSGLLPVNPDGSRAVDRDWDQSETWRQMEEVYASGKVKAIGVANWSIPYLEELKKTWKIVPAVNQVELHPFLPQHKLVKYCRDLGILLEAYSPLGSTNAPLLSDPEINAIAEKYKTSPATICISYQVNRGIVVLPKSVSPKRIEDNLKTIPIEKEDMVKLDGMAAAGKAQRINTPKWGWDLGFDDWYGPVKQQ

SEQ ID NO: 15511 - protein, 252 aa, Oryza sativa
MEQRKFLLCLILGLLAASGPAKTVNADSPFDFYYLILMWPGAYCTDSEYGCCVPKYGYPSEDFFVKSFMTFDSSENTAVVRCNSDNPFDINKLDSIENNLNHYWSNIKCPRTDGVNSWKSEWNSYGVCSGLKELDYFKAGLQLRKNADVLSALAEQGIKPDYQLYNTAFIKWAVNQKLGVTPGVQCRDGPFGKKQLYEIYLCVDKDAKSFIDCPVLPNLSCPAEVLFHPFHTWMLNTTSAANIVIPTETVLA

SEQ ID NO: 15512 - protein, 520 aa, Saccharomyces cerevisiae
MRVRKRQSRRTSTKLKEGIKKKASAHRKKEKKMAKKDVTWRSRSKKDPGIPSNFPYKAKILEEIEAKKMKDLEERELAKQQRLEARKAAKEQGVDAMDEDMIEDDENGLAALVESAQQAAAEYEGTPSNDADVRDDELDVIDYNIDFYGEDVEGESELEKSRKAYDKIFKSVIDASDVILYVLDARDPESTRSRKVEEAVLQSQGKRLILILNKVDLIPPHVLEQWLNYLKSSFPTIPLRASSGAVNGTSFNRKLSQTTTASALLESLKTYSNNSNLKRSIVVGVIGYPNVGKSSVINALLARRGGQSKACPVGNEAGVTTSLREIKIDNKLKILDSPGICFPSENKKRSKVEHEAELALLNALPAKHIVDPYPAVLMLVKRLAKSDEMTESFKKLYEIPPIPANDADTFTKHFLIHVARKRGRLGKGGIPNLASAGLSVLNDWRDGKILGWVLPNTSAAASQQDKQNLSTINTGTKQAPIAANESTIVSEWSKEFDLDGLFSSLDKAIDASKDQDTMME

SEQ ID NO: 15513 - protein, 504 aa, Micromonospora echinospora
MLPGGTSNRPRGRSRVPPPAGVAMVHARRAPARVPTGTRTDSSRTQMDSVHSDLKVAIVVADIAIVLIVGSLLIMLFRRLKQPPVIGEITAGIVLGPSLLGLLPGDVTGFLFPVELRAHLSMISQVGLLLFMFLVGWEFNGQLLKRRSGAVATVSLSAIGLAFTLGIGAAALLYDRHDVVDGEKISFGYFAAFLGIAMSITAFPVLARLLTETGLARTRVGALSLAAAALDDVMAWTLLAFIVVIFGAGGDGTSTLVTVLGLFLLYVALMVFAVRPLLRRLVARLVRGGTASPFLVPLIAAGAFLSAYATSWIGVHAVFGAFAFGLVMPREPRALLAESLHMPLESATRLLLPIFFIVTGLNVNIGALGWTGLGELAIIMVAAIVGKLVAASLAARASGMNWQESYAVGLLMNTRGLTELVILNIGLSLGVLDGEMFTMMVLMALLTTAMAVPLLPRGLPRAPGGLFDIPSVTVPSGAAARRTPAQGDATDAATTGQEVPSGKS

SEQ ID NO: 15514 - protein, 471 aa, Ralstonia metallidurans CH34
MAQSVADVMKLVNENDVKFVDFRFTDTKGKEQHVSVPVSHFDEDKFESGHAFDGSSIAGWKGIEASDMLLMPDSGTAYIDPFYEEPTLVLSCDVIEPSDGKGYDRDPRSIAKRAEAYLKSTGLGDTAFFGPEPEFFIFDGVTWNIDMQGCSVKIQSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSIWKDGQNLFAGNGYAGLSEFALYYIGGIIKHARALNAITNPGTNSYKRLVPGFEAPVKLAYSARNRSASIRIPYVSNPKGRRIETRFPDPLMNPYLGFSALMMAGLDGVMNKIHPGEAADKNLYDLPPEEDAKIPTVCSSLDQALEYLDNDREFLTRGGVFSNSMLDAYIELKMEEVTRFRMTTHPIEFDMYYSL

SEQ ID NO: 15515 - protein, 788 aa, uncultured archaeon GZfos17C7
MEETEKDRNIRILHSGVFTPLRRWATKWSLWPCHFLTSCCGVELAHTGACGYDMERLGTLNMGISRQANFIMVEGTITRKMARALRIVWEQMPDPKFVNVIGTCGQRGGIFWNSYNITRPSDIVPVDFFIPGCPITPESLLRGVRAVQEKIEGRDNTTIRFKHVELPSGDGEENRAPTTPKIFAPTPLVRVDVPRDVDWAFGKDLVKNLKAQLNGLYTSITVTDKNRIAIKTSPENLVETSRKLSDTMGVDHVKSVNVIDVPHERKFMVEYMVSGYTEELMPVILTIFTEIGREAEPEIPSLTSLWESANYSERELHDFFGVKFKGNEGMKGKFLLAPDTPDTPLRKDFKLEEEQYTIEEGVPLTPTITPPHYMPPSSSLSYSESELEDLKMPAYEDVLKEAEKNDEFVAFIGPHHSGSGHLRWVMRMKGDIIKDVIPDPGYVHRSMEKIAENRLYIQNVPLTERPNISDPINMNLGYVRAIENALGIEVPERAKYIRTIMAELSRIGAFFYDMGIFPLFMGHSTGFMYSFAIREMVLELMVRMTGSRCTPSFIVPGGIRRDIPDDVLDRTRKFTTAIHKRLKKYENIFVYNPVLISRMKEVGVLTREEAIRCGIVGPFLRASGVEYDVRKAEPYEVYDKLDWEATTGDAGDCLGRIFGRLEEMKQSVEIVRQAVDAVQEMPRGGVISEEILGDYKEASDDIRGYLYNVYGDLVLPKGEWTSVTEAARGTVLYSIISDGESNVPYRVRIITPCWMNLRGIIEASKGERVADFWTVYASFGYFPPEADR

SEQ ID NO: 15516 - protein, 379 aa, Picrophilus torridus DSM 9790
MVSSRLSQISESATVSMSNRASELRKAGKKLYNFGIGEPDMTTPDNIIKMAFDDAMSGKTHYTPSAGIPELREKIALKMKSKNNIDVVAKNVLVTPTKFSINLALYTIIDPGDEVLIPSPYYVSYPDIVKINSGKPVFADCDDEYNIDIDNLRRAITPKTRAILINNPVNPTGKVLSEKNIRETVDFALENNLYIISDEIYEDIIYRGKMFSPASIPEAFDKTVTVSGFSKSYAMTGWRVGYMVAPEEIIKSADKIQQQTLTCAPSISQYAALHALDDDDSVKHIRETFEKRRDLVVSLLKETNLHFYEPEGAFYVFPGYESDVKSYDAAMNLLENKNVIVTPGAPFGSEYHFRISFATSEDDIKNGIPLIGEYFKSIS

SEQ ID NO: 15517 - protein, 331 aa, Idiomarina loihiensis L2TR
MKQAERLDQLITLLANGEFHSGQAIGESLAISRAAVNQHIHKLEELGLELFSVTGRGYKLAWPIELLQARVIENESPEKWRQSPEFEVKSVVDSSNDRVKELAKEGPLEAGFSIFAEAQTAGRGRRGKKWISPFGNNLYFSVYWPLDEGIHGAMGLSLAAGVALAECFTDLGIEGVSVKWPNDVYIRGKKVTGILVDLETSPEGAAHSIIGIGINLTMPEHVGASIDQAWTDLNSELPQPMSRNHIAAQVRASVLSALQQYEQHGLAAFQQSWRRYDCFLDKPVKLIMGQRVCLGTCRGIDENGALLVEDEQGVRRYFGGEVSLRAQDATN

SEQ ID NO: 15518 - protein, 241 aa, Ustilago maydis 521
MFDSIEDAVADIRAGKFVVVLDDEDRENEGDLIISASLCTTQQMAWFIQHTSGFICIALTPDRIAQLEIPMMVPNNTEKNKTAYTVTVDYKHGTTTGISAHDRALTSRQLADESLSAQADDFTRPGHMNPLRYTQGGVRVRMGHTEASVDLCKLAGLPPAGLLCELVDPDDEDGGIASRDACLKFAKKWGLKVTTIEMLKKYREQKEGELAHDDRQRLADDQVRGVKIDVQKVVPPTTTAA

SEQ ID NO: 15519 - protein, 469 aa, Bradyrhizobium sp. BTAi1
MKTAKDVLKAIKDNDVKYVDLRFTDPRGKWQHVTFDVSMIDEDIFAEGTMFDGSSIAGWKAINESDMCLMPDPVTATIDPFFAETTMIITCDVLEPTTGEPYNRDPRGIAKKAEAMVKSMGVGDTVFVGPEAEFFVFDDVRYSSSPYNTGFRLDSSELPTNSDTEYEGGNLGHRIRTKAGYFPVPPQDSVQDMRSEMLGAMARMGVKVEKHHHEVASAQHELGMKFDTLTLMADQMQIYKYCIHQVAHIYGKTATFMPKPVYGDNGSGMHVHQSIWKDGKPVFAGNKYSDLSETCLSYIAGIIKHAKAINAFTNPSTNSYKRLVPGYEAPVLLAYSARNRSASCRIPYTSSPKAKRVEVRFPDPLANPYLGFAAMLMAGLDGVKNKLDPGPAMDKDLYDLPKEELKQIPTVCGSLREALENLDKDRAFLKAGGVFDDDFIDSYIALKMTEVERFEMTPHPVEFDMYYSG

SEQ ID NO: 15520 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESG

SEQ ID NO: 15521 - protein, 427 aa, Geobacter metallireducens GS-15
MNTSHSKELFAKAQEIIPGGVNSPVRAFKSVGAEPVFIKKASGSTIIDADDNAYIDYVGSWGPMILGHCHPRIVASVQRATENGSSFGAPTELEITLAEMVVAAVPSIEMVRMVSSGTEATMSAIRLARGYTGRDKIIKFSGCYHGHADSLLVKAGSGAATFGVPDSPGVPRDFAQHTLTATFNDLESVEELICAHSREVACIIVEPIAGNMGTVPPRAGFLEGLREICTNEGIILIFDEVMTGFRVAYGGAQERYGITPDMTTLGKIIGGGLPVGAFGGKREIMQQLSPSGGVYQAGTLSGNPLAMTAGIETLKLLQEDGFYGRLEEKSRALAEGIADAARRAGYPIYSTRVGSMFCAFFTNGEVHDWTSAAMCDTKSFATFFRSMLEEGIYLAPSQFETAFVSIAHSSEDIEKTIAAAFSCFKKL

SEQ ID NO: 15522 - protein, 485 aa, Flavobacteria bacterium BBFL7
MSSTSVYSLKFGLMSKRRKRANKTFENVPVVDAGAKGKSVAKTEDGAVIFLKNAVPGDVVDIQTFKKRKSYFEGEATVFHTLSDRRTEPVCKHFGTCGGCKWQHMSYESQLFFKQKEVVENLTRIGHLELPEVTPIAGSEEQYYYRNKMEFSFSASRWLTLEEIQSEVQIEDKKALGFHIPGMWDKILHLDECHLHPAIGEQIRLSVHAFAEAEQIEYFNPREKTGVLRTLMLRMSSTGEIMVVIQFFKEDEKARISLLEHLKNSFPQIKSLQYIINEKANDTIYDQEVICYDGRDHIFEEMEGLQFKINAKSFYQTNSKQAFELYKITRDFAGLTGEELVYDLYTGTGTIAQFVAKKANHVVGIESVPVAIEDAKANAAHNGIDNTTFFAGDMRDVFTADFIAEHGAPDVVITDPPRDGMHKDVVAQLLALAAPRIVYVSCNSATQARDLALLNEQYKVVKYQPVDMFPQTHHVESVVLLEIIK

SEQ ID NO: 15523 - protein, 808 aa, Arabidopsis thaliana
MGIHLGEIGIVLFPCFLWLSLFLSCGYAAITISSPLTLGQTLSSPGGFYELGFFSPNNSHNQYVGIWFKKITPRVVVWVANREKPITNPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTVRYSVGGEFLSIRLASSELAGNRRTKIIVGSISLSIFVILAFGSYKYWRYRAKQNDSWKNGLEPQEISGLTFFEMNTIRTATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDEKMNPKISDFGLARMFQGTQHKTTLVRVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAIDRPNIAQVVTMMTSATDLPRPKQPLFALQIQDQESVVSVSKSVNHVTQTEIYGR

SEQ ID NO: 15524 - protein, 237 aa, Enterococcus faecium
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNS

SEQ ID NO: 15525 - protein, 506 aa, Aspergillus oryzae
MSDDDDFMQDSGDEDYDFEYEDADDDESGDIGIENKYYNAKQMKIDNPEEAIDEFLEVPALEQEKGDWGFKGLKQAIKLEFKLGRYSDAVEHYRELLTYVKSAVTRNYSEKSINNMLDYIEKGSDDDKAYQCMEEFYSLTLHSFQNTNNERLWLKTNIKLARLWLERKEYGQLSKKVRELHRACQREDGSDDPSKGTYLLELYALEIQMYAETKNNKRLKALYQRALRVRSAVPHPKIMGIIRECGGKMHMSEENWEEAQSDFFESFRNYDEAGSMQRIQVLKYLVLTTMLMKSDINPFYSQETKPYKSDPRISAMTDLVDAFQRDDIHAYEAVLSKNPDVLADPFIAENIDEVSRNMRTKAVLKLIAPYTRFTLAFISKHIKISIQEVQDILSFLILDKKLNAKIDQENGTVVVESTSDVDRLRSLEEWNASLRTLWRATLNDGEGFRTDETSQLHGMRGGPLFQSGFGDEAPPAVGLRAGRRLRTGWKGKGSGHGPKATGAGGY

SEQ ID NO: 15526 - protein, 482 aa, Schizosaccharomyces pombe
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKDEEW

SEQ ID NO: 15527 - protein, 329 aa, Bacteroides thetaiotaomicron VPI-5482
MDKIIGLGNALIDVLATLKDDTLLDELELPKGSMQLIDDAKLQQINTKFSQMKTHLATGGSAGNAILGLACLGAGTGFIGKVGNDHYGDFFRKNLQKNNIEDNLLTSEQLPSGVASTFISQDGERTFGTYLGAAASLKAEDLTLEMFKGYAYLFIEGYLVQDHEMILHAIELAKEAGLQICLDMASYNIVENDLEFFSLLINKYVDIVFANEEEAKAFTGEEPEEALRVIAKKCSIAIVKVGANGSYIRKGTEEIKVSAIPVEKVLDTTGAGDYFAAGFLYGLTCGYSLEKCAKIGSILSGNVIQVIGTTISPERWDEIKLNINKVLAE

SEQ ID NO: 15528 - protein, 180 aa, Triticum aestivum
MARRGTEAFPDLGAHCDREDCNQLDFLPFDCNGCGKVFCTEHRAYVDHGCPLAADNGRTVVVCEACGDSIERAGSDETDAQILEKHARSRRGCDPARKLKPRCPARRCKETLTFSNTSHCKECGQKLCLKHRFPEDHGCSRVSPVGAAAAARRAGDCGRDAQKTKDGGGWALPPLIRNFN

SEQ ID NO: 15529 - protein, 311 aa, Bacteroides thetaiotaomicron VPI-5482
MKVVVIGSSNIDMVAQVNHLPAPGETVGDASFMQSLGGKGANQAVAAARLGGSVTFITSLGNDMYAEILKKHFKKEGITTDYIIDDVNQPTGTALIFVADSGENCIAVAPGANYSLLPGSIIHFSKVIDEADIIVMQAEIPYETIKRIALLAKQKGKKVLFNPAPACLIDEELMKAIDILVVNELEAAFISGIEYTGNNLEEIALSLLQAGARNAVITLGSQGVYMKNDKEIIQLPGYKVNAIDTIAAGDTFCGALAVICAQREIDRDALSFANAAAAIAVTRSGAQPSIPTLDEVKHFMLEKELALSFNF

SEQ ID NO: 15530 - protein, 336 aa, Gibberella zeae PH-1
MSESLQHQAAGDATPFAFIWRQLFQTVSSIPNAVDLHGQVALVTGSNVGLGFESARQLLALNLSHMILAVRSERRGDEAAKKLRKEFPSAKIEVSIVDMSCYDSIMTFAKRCKTLPRLDIAILNAGLSQPTFERTEGTGHEVTFQINYLSTVLLALVLIPILREKHGASSPARLSVVGSDTSYYANWNGSESESVLEIMDNPKYFDSWEAYKATKLLLLMFTRELSKRVPSSDVIINVSNPGACRGTQFGQTERSMLQEAFLYAASLILGRTPNVGARQYVDAVTVKGAESHGSFISEGRIKAFPPIMYEQRGLALQDQLWNETMKEFARFNIERV

SEQ ID NO: 15531 - protein, 438 aa, Streptomyces coelicolor A3(2)
MSELAYPYEAPASQALFDRAAAVTPGGVNSPVRAFRAVGGTPRFMVSGTGPYLTDADGREYVDLVCSWGPMILGHAHPEVIAAVQEAVARGTSFGTPAEGEVALAEAMVERVAPLEEVRLVSSGTEATMSAIRLARGFTRRTKVIKFAGCYHGHVDSLLAAAGSGVATFALPDTPGVTGAQASDTIVLPYNDLDAVHAAFAAHPGEIACVITEASPGNMGVVPPLPGFNQGLKDACAANGALFVSDEVMTGFRTSLAGWFGVEGVVPDLMTFGKVMGGGFPAAAFGGRADVMAHLAPAGPVYQAGTLSGNPVATAAGLAQLRLLDDAAYDTVDAVSAQIQALVTEALTKEGVAHTLQNASNMFSVFFTDRPVVNYEDAKAQESFRFTAFFHSLLANGVYLPPSSFESWFVSTAHDERAVQRIADALPAAARAAAEATA

SEQ ID NO: 15532 - protein, 337 aa, Burkholderia sp. 383
MSIARRTTLSKFLIEQQRETNNLPADLRLLIEVVARACKAISYNVSKGALGEALGTAGSENVQGEVQKKLDILSNEILLDANEWGGNLAAMASEEMETFFPIPANYPRGEYLLVFDPLDGSSNIDVNVSIGTIFSVLRCPDGKQATEESFLQPGTQQVAAGYAVYGPQTVFVLTTGNGVNCFTLDREVGSWVLTQSNMQIPADTREYAINASNARHWYDPVKRYVDELNAGKDGPRGDNFNMRWIASMVSDVHRILNRGGVFMYPADKRTPDRPGKLRLMYEANPMSFIVEQAGGAATTGTQRIMEVQPTGLHQRVPVFLGSKNEVDRVTGYHQEKQ

SEQ ID NO: 15533 - protein, 420 aa, Wolbachia endosymbiont of Drosophila ananassae
SGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFKAKRYIDEIKKSAPNLYNLCFKYFTPQERFLYLKQRDFAGIEGISIDYLVMEKAKNVAMIEANFDWLDVGTWNSVLELSEKFSKEPVSFQHVIREKEPVSTTKSNKNLLGGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 15534 - protein, 250 aa, Caulobacter crescentus CB15
MTGVSPVTVPPIVVLDEIDSTNAEARRRAEAGAVEPLWLVGLRQTAGRGRRGRAWETGEGNLAATLLFRTERPPAEAAQVSFVAALAVADLLARYVPSHLISLKWPNDPLLGGLKVSGILVESGASPFGGLWLAVGIGVNLKRKPIDAERPATAIATYLEAPPSPQEAAEVLAEAFERWLRTWDILGFRAIADAWTARAHGLGEPCVARLGHETVEGVAEALDADGALRLRLADGSLRRITAGDVFFGGA

SEQ ID NO: 15535 - protein, 328 aa, Blumeria graminis
MDTKMEDVGKTPEPIRFQTTTEPASISTLDGWIENLMACKQLPEVDVLRLCEKAREVLHSESNVQPVKCPVTVCGDIHGQFHDLMELFRIGGPNPDTNYLFMGDYVDRGYYSVETVTLLVALKIRYPQRITILRGNHESRQITQVYGFYDECLRKYGNANVWKYFTNLFDFLPLTALIENQIFCLHGGLSPSIDTLDNIKSLDRIQEVPHEGPMCDLLWSDPDDRCGWGISPRGAGYTFGQDISEAFNHNNGLTLVARAHQLVMEGYNWSQDRNVVTIFSAPNYCYRCGNQAAIMEIDEHLKYTFLQFDPCPRAGEPMVTRRTPDYFL

SEQ ID NO: 15536 - protein, 815 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRDVRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 15537 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKKYPDAYVRIIGFVNIRQVQCVSFIAFKPPGCEESG

SEQ ID NO: 15538 - protein, 428 aa, Xanthobacter autotrophicus Py2
MSENAALQARRTKAIPRGIATAYPVFAQKAEGSEVWDADGTRYIDFAGGIAVLNTGHRHPRVLAAVRAQLDAYTHTAFQIVPYEPYVALCERLNAIAPFTGAAKSILFSTGAEAVENAVKIAKAATGRTGVISFSGGFHGRTALTMALTGKVLPYKKKFGISPPGIFHLPFPCADHGVSVADTLKALDYLFRADIGPQDVAAIIIEPVQGEGGFLPAPTELLVALRQTCDAHGIVLIADEVQTGFARTGRMFGIEHSGVEPDLVTVAKSLAGGFPLSGVIGREAIMDAAEPGGLGGTYAGNPIACAAALAVLDVIAEEKLVERANAIGARIKDALTRMALRNDAVAIGSIRGPGAMVAFDVVKKRGTVEPDADAARRVTQAALADGLILITCGVYGNTIRLLNPLTIPDALLDEGLGKLERALVAGAA

SEQ ID NO: 15539 - protein, 485 aa, Escherichia coli
MSDKSFIAVVMAGGTGSRLWPLSRELYPKQFLKIGGELSLLQSTLNRLSKLSFDAPLVITNDNHRFIVAEQLRQMNQLSGNIILEPCGKNTAPAIALAAFSALKRDKNKDPILLVLAADHIIKNEEAFCEAIKSAMFMAEEDKIVTFGIIPTYAETGYGYINIGARVESNIEVDNAHFYVAKKFVEKPERELAEKYFSSKKYLWNSGMFMFKASVFLSELKKYRPDIFEVCEEAISASSKDLDFIRLPERMFEKCPSESIDFAVMENTKRCVVCPVDIGWSDVGSWQSLWELSDKSPSGDVCKGDTLTYNTKNNYIYSDSALVAAVGVENIVIVQTKDAVLVANKSEVQDVKKIVDLLKKNNRTEHVTHREVFRPWGKFDSIDQGDRYTVKKIVVKPGEGLSLRMHHHRSEHWIVLSGTAKVILEGTEKLITVNESIYIPLGASYSLENPGVIPLILIEVSSGDYLGEDDIVRQKERYKKKINHE

SEQ ID NO: 15540 - protein, 274 aa, Clostridium acetobutylicum ATCC 824
MLDINSFTVLNNGVKMPWLGFGTYKIEYEESSVDYIKTALKVGYRHLDTAAVYGNEPIVGKAVKESGIPRNEIFITSKVWNNKHGYDKTLKAFEDTLKRLDTDYLDLYLIHWPKTLNKETWKALEKLYKDGRVRAIGVSNFKVHHLEEILEDCEIVPMVNQVEYHPQFPQTEVHEFCKKNKIQLESWGPLMQGKIFDIPLMKELSLKYGKTISQIALRWDLQMGVVTIPKSINENRIKENCDLYDFEISKEDMKKIESLNTGVRIGHDPDTITF

SEQ ID NO: 15541 - protein, 168 aa, Avena clauda
VMASSATTVAPFQGLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 15542 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 15543 - protein, 410 aa, Zea mays
MRDGRVSFQLQHTGEIYISQGCNVTQTVFNGINVLAGVGLLSTPFTIHEAGWTGLAVLACFAIVCCYTGILLKHCFESKDGISSYPDIGEAAFGRIGRVLISIILYTELYSYCVEFIILEGDNLTSIFPKAGFDWLGIHVDGKHFFGVLTAILVLPTVWLRDLRVLSYLSAGGVIATLLVFLSVGLVGVTDGIGFHSTGKAVNWSGMPFAIGIYGFCYSGHSVFPNIYQSMSDRSKFPKALFICFAICTAIYGSFAVIGFLMFGKNTLSQITLNLPKHSFASEVALWTTVINPFTKFALLLNPLARSLEELRPEGFMNETSCAIILRTALLASTVCIAFLLPFFGLVMSLIGSLLSILVAVIMPPLCFLKIAQNKATCAQVIASICIVMLGVISAALGTYSSVKKIVENY

SEQ ID NO: 15544 - protein, 348 aa, Lactococcus lactis subsp. lactis Il1403
MKSVYFVEKNKMQVREFPKAQLVKETDAIIKIVRACVCGSDLWWFRGISERQPGPVGHEAIGLIEEVGTGVKNFKVGDFVIVPFTHGCGHCPICLAGFEANCPNAKDGVNGGYQGEFYRAINTDGALVKIPGQPSDYSDDQLASLTALADVMPTGFHAAKAADVHEGDTVVVFGDGAVGLCAVISAKLLGAKRIIAMSRHEDRAALARDFGATDIIDERGEEAIQKIMSLTNGYGADAALECVGTKQAIESAFQAVRAGGRVGRVGVPHDVDYNEWIDSLFWKNIQLGGGVASVARWDKEILLEAVLSGEINPGRVFTAEFSLDEIQKAYEAMDQRTAIKSLLRISEV

SEQ ID NO: 15545 - protein, 247 aa, Glycine max
  misc_feature (30)..(30): Xaa can be any naturally occurring amino acid
  misc_feature (240)..(240): Xaa can be any naturally occurring amino acid
  unsure (1)..(247): unsure at all Xaa locations
MAAYKLVLIRHGESAWNLENRFSGWYDADXSAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRXAMGAVAA

SEQ ID NO: 15546 - protein, 338 aa, Ralstonia metallidurans CH34
MTRISLTRYLVEEQRKHNTIEPELRLLIEVVARACKAISNAVSKGALAGVLGSAGTGNVQGETQQKLDVIANEVLLDANEWGGHLAAMASEEMDSFYEIPNRYPKGEYLLLFDPLDGSSNIDVNVSIGTIFSVLHMHKPGQTVTEHDFMQPGTQQVAAGYAVYGPQTTLVLTVGNGVHMFTLDREAGSFVLTQSDVMIPEDTKEFAINMSNMRHWAPPVRRYIDECLAGDEGPRGKNFNMRWIASMVADVHRILTRGGVFMYPWDKREPEKPGKLRLMYEANPMAFLVEQAGGAATNGQQRILDVEPTKLHQRVSVILGSKNEVERVTRYHQEDAAKA

SEQ ID NO: 15547 - protein, 353 aa, Oryza sativa
MEALHEEMPFDLAFHPSSPLVATSLITGELYLFRYAAESQPERLFAAKSHKESCRAVRFVESGNVILTGSADCSILASDVETGKPIARLEDAHENGINRLVCLTETTVASGDDEGCIKVWDTRERSCCNTFHCHEDYISDMTYVSDSTQILATSGDGTLSVSNLRRNKVKSQSEFSEDELLSVVVMKNGKKVVCGTPSGALLLYSWGFFKDCSDRFLGHAQSVDTMLKLDEETLISGASDGVIRLVGILPNRIIQPLAEHSEYPIEALAFSNDRNYLGSISHDKMLRLWDLQDLLNRQQLVQDDKLGEQDSDDSDDDGMDVDMDPNSSKGSRSTKTSKGQSSDRPTSDFFADL

SEQ ID NO: 15548 - protein, 412 aa, Solibacter usitatus Ellin6076
MTKTSLDKSKIKILLLEGIHPSAVEKFRQDGYDNIECHQKSLTGSALEEAAADAYFVGIRSATQLERAFFENASRLTGVGCFCIGTNQVNLSAAEERGVPVFNAPFSNTRSVAELVLAEIIILMRGIPQRNAAAHRGGWLKTATGSHEVRGKTLGIVGYGHIGTQVGVLAESLGMQVVTYDVESKLALGNARALGSLDALLEISDVVTLHVPETPATFQMIGAEQLARMKPGARLINASRGTVVEIQALAAALASQHLAGAAIDVFPAEPKSTADLFYSPLRGMDNVLLTPHVGGSTEEAQENIGVEVAQKLIKYSDNGSTLGAVNFPEVSLPEHPGKHRVLHIHHNQPGVLSAINAVFSEDAINIAAEYLQTDAKVGYVVIDVETDERDETANIRRKLELVPGTIRTRILY

SEQ ID NO: 15549 - protein, 286 aa, Saccharomyces cerevisiae
MTYTLAILGCGVMGQALLSAIYNAPKAADETAAAFYPSKIITCNHDEPSAQQVTDLVETFDESPNGIKVESTYGHNVSAVEEASVVLLGTKPFLAEEVLNGVKSVIGGKLLISLAAGWTIDQLSQYTSTVCRVMTNTPAKYGYGCAVVSYSADVSKEQKPLVNELISQVGKYVELPEKNMDAATALVGSGPAFVLLMLESLMESGLKLGIPLQESKECAMKVLEGTVKMVEKSGAHPSVLKHQVCTPGGTTIAGLCVMEEKGVKSGIINGVEEAARVASQLGQKKK

SEQ ID NO: 15550 - protein, 403 aa, Streptomyces coelicolor A3(2)
MHNTTAVLIELGAIILALGLLGRIAGRVGFSPIPLYLLAGLAFGHGGMLPMQASEEFTATGAEIGVILLLLLLGLEYSASELVTNLKTQYPSGAVDFVLNAVPGAVAALVLGWGPVAAVALAGVTWISSSGVIAKVLGDLGRLGNRETPVVLGVLVIEDLAMAVYLPILTALLAGVSLAGGAVTLLISLGTVGAVLYLALRHGRLISRAVSSDSAETLLLVVLGLTLVVAGLAQELQVSAAVGAFLVGIALSGEVAEGASSLLTPLRDLFAAVFFVFFGLSTNPADIPPVLVPALLLAAVTALTKVATGWYAAHRAGLRGAGRWRAGGTLVARGEFSIVIAGLAVGVEPRIGPLATAYVLILVVIGPLTARFTEPLARRLTRGPRKAAPATATTPAESTHANA

SEQ ID NO: 15551 - protein, 288 aa, delta proteobacterium MLMS-1
MRPDQAQKILSQHKLAPSKQRGQNFLVQPAVAERIVEVAEIEPTATVVELGVGLGALTRPLAARCAKVIGLELDAGIVNYHRQSGELPANVELRHQDLLRADYPAMAAEQGGKIKIIANLPYSITNPLLFRLLVQRRALDWVVLMIQKEVADRLVAAVGSKEYGVLTVLLGACATVERLLAVGPGNFFPRPKVDSVVIRLDFRNFPHVPDDAEFGRLRRVVDAAFNQRRKTLLNSLSAGLPELDRETIAAALAAAELDSGLRAERLTTADFRRLSAKLPPLSAKSPPR

SEQ ID NO: 15552 - protein, 280 aa, Bordetella bronchiseptica RB50
MSAEVRSLSLPEPAALARAIAARLPAFRDISWVGSTGSTNADLLARARAGGGARPCLLGAHLQESGRGRAGRPWQNRVGAALMFSCAFDVDLPPSQLPALSPLAGMAACEALRQLVGQPAGLLVKWPNDVQWHDAKLAGVLVESVRNPAGTGHAVVIGMGLNLHGGDALSQALQRSVADWNDVAGPGEKGPDAAADLVATVARAWQDAAHTLQQEGFGAFGARFARVDALAGRPVNVIDRGEILYTGAASGVDDHGRLLVQAADGMRPVSVGEISIRPQA

SEQ ID NO: 15553 - protein, 433 aa, uncultured bacterium
MVACGAEPFAPGAVFNIHHMKDSGMQQLSLDKDKIRFLLLEGVHQNALDVLHKNGYTNIEYLKTALDESTLLEKVRDVHFLGIRSRTQVTPKVLEAANKLVGIGCFCIGTNQVALQHAMRKGVPVFNAPYSNTRSVAELVLGQLILLLRGIPQKNALVHRGGWSKSAEGSWEARGKTLGIVGYGNIGSQLSVLAESLGMHVVYYDTVTKLPLGNARQLGSLNELLGLADVVTLHVPEIPSTQNMMRAEHFAKMKPGAIFINAARGTCVDIDDLAAALQSQHIGGAAIDVFPVEPKANDEEFQSPLRAFDNVILTPHIGGSTLEAQANIGLEVAEKFVRYSDCGTTLSAVNFPEVSIPLGAGKHRLLHIHENVPGILSNINRVFAENGINIAAQSLMTNDAIGYLVIDVDAEYSEVALQKIQSIPGTIRSRVLY

SEQ ID NO: 15554 - protein, 336 aa, Caulobacter crescentus CB15
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 15555 - protein, 269 aa, Bacillus cereus G9241
MKEQGEPITMLTAYDYPSAKLAEEAKVDMILVGDSLGMVVLGYDSTVPVTVEDMIHHTKAVRRGAKETFIVTDMPFMSYHVSPQDTMVNARRIVQESGAHALKVEGAGEVLSTIHYLTNAGIPVVAHLGLTPQSVGVLGGYKVQGKDAESAKKLIEDAKRCEEAGAIALVLECVPMQLAELISKQLTIPTIGIGAGKKVDGQVLVYHDLISYGVNRVPKFVKQYTSVQEEIVRGISQYVTEVKTGQFPEEIHSFTMKEEECLALYGGKQ

SEQ ID NO: 15556 - protein, 228 aa, Ralstonia metallidurans CH34
MTQDELKALVAQAAADYVKQEVPEGAVLGVGTGSTANLFIDAVAAFKERFSGAVSSSEASTRRLQQHGFNVLDLNEVDSIPVYVDGADEIDNSGAMIKGGGGALTREKIVASVADRFVCIADGSKLVPTMGAFPLPVEVIPMARAAVARSLAALGGQPRLRMTKEGGIYKTDNGNVILDVSGLKIENPKALEQQINQLPGVVTVGLFALRGANVLLLGTEQGVQRSDY

SEQ ID NO: 15557 - protein, 752 aa, Guillardia theta
MNRLIVDEINQNADDNSVVYLNSNKIDNLKLFRGDTILIKTKKKKDTVCIIMSDDNCELEKIRINKTVRENLNIGIGDIVTIHHFTDLKFGKRIHVLPFKDSILGYNGNIFEDFLKPYFLDAYRPIKKGDVFNIKSGNNTFDFRVIEIDPVDYCIVGPDTIIFCEGEPLDRLDTVDYEKITYESIGGCQKQLSQIRELVELPLKHPQLFNTVGIKPPRGVLMYGPSGCGKTLIAKAVANETGAFLYSINGPEIMSKLAGESESNLKKAFDEAEKNSPSIIFIDEIDSIAPKRDKSQGEVERRIVSHLLTLLDGINLNSQVVVIACTNRPNSVDQALRRFGRFDREIDISVPDDKGRLEILQIHTKNMLIDNSVDLEAICKETYGFVGADLAQLCTEAALLCIKESIENFDLEEENIPLVVLNSLRVSQDHFKLALDQSNPSAFRETAVEIPNITWEDIGGLENVKRELQETVQYPVEHPEKFEKFGMQPSKGVLFYGPPGCGKTLLAKAIANECQANFISIKGPELLTMWFGESENNVREVFDKARQASPCVLFFDELDSIARARGSSGSDGGGAGDRVINQILTEIDGVGVRKNVFVIGATNRPDILDPAIMRPGRLDQLVYIPLPDRKSRIQIFRATLRKSPLSKEIDLEVLSRATSGFSGADITEICQRACKLAIRESIFKDIQFAKNSESIVSNNEKYIDPVPEITKEHFLEAMKYARRSVSDSDIRKYEMFAQKLQTSRGFSKEIKF

SEQ ID NO: 15558 - protein, 457 aa, Escherichia coli K12
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 15559 - protein, 168 aa, Avena maroccana
VMASSATSVAPFQELKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 15560 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIREVEEVKKEYPDAYVRIIGFDNIRQVQCVSFIAFKPPGCEESG

SEQ ID NO: 15561 - protein, 270 aa, Mesorhizobium loti MAFF303099
MVSKNTRPTVADIRAMKGRGQKFSMLYVTSLEEAAAADAAGVDMLSIEGRFFSPEMREAAGRCFVQVGLPYGPAGNLVTAEDYLKTAYHFMRIGGDCFYCAASLDIQKTLCDNAVPVVAHVGLIPSQCTWTGGFKAVGRTAESARAVWDHVKRLETIGCFGAELEVVPDRIAELITRSTPMIMLGMGAGPHADAQYLFSEDVLGHTSGHKPRHAKTYRNFAAELERLQRERIAAYREFISDVKTGTYPEPQHVVSIADEELAAFRAPLGL

SEQ ID NO: 15562 - protein, 395 aa, Bacillus cereus G9241
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGAEYTSIAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDDWAKALLEEEKVALVPGTGFGAPNNVRLSYATSLEQVEKALERIHTFMKSKVQA

SEQ ID NO: 15563 - protein, 292 aa, Glycine max
MEGNSGGGGGGGGGNDVELLCKTLQVEHKLFYFDLKENPRGRYLKISEKTSATRSTIIVPFSGISWFLDLFNYYVNSDDQDLFSKELQLDTKVFYFDIGENRRGRFLKVSEASVSRNRSTIIVPAGSSRDEGWAAFRNILAEINEASRLFILPNQQNSESSEHLVGLSDDVGAGFISGHSTQPATSSELNVDRSVDLPPQDEIGNLGVSKVIRADQKRFFFDLGSNNRGHFLRISEVAGSDRSSIILPLSGLKQFHEIVGHFVEITKDRIEGMAVANVRTIDPPSKMNANLG

SEQ ID NO: 15564 - protein, 680 aa, Arabidopsis thaliana
MSDDPGQMLLIYDDPSDQRSLSLDDASSTEESPDDNNLSLEAVHNAIPYLGQIFLTHDTAYEFYSTFAKRCGFSIRRHRTEGKDGVGKGLTRRYFVCHRAGNTPIKTLSEGKPQRNRRSSRCGCQAYLRISKLTELGSTEWRVTGFANHHNHELLEPNQVRFLPAYRSISDADKSRILMFSKTGISVQQMMRLLELEKCVEPGFLPFTEKDVRNLLQSAAELDPEDENIDFLRMCQSIKEKDPNFKFEFTLDANDKLENIAWSYASSIQSYELFGDAVVFDTTHRLSAVEMPLGIWVGVNNYGVPCFFGCVLLRDENLRSWSWALQAFTGFMNGKAPQTILTDHNMCLKEAIAGEMPATKHALCIWMVVGKFPSWFNAGLGERYNDWKAEFYRLYHLESVEEFELGWRDMVNSFGLHTNRHINNLYASRSLWSLPYLRSHFLAGMTLTGRSKAINAFIQRFLSAQTRLAHFVEQVAVVVDFKDQATEQQTMQQNLQNISLKTGAPMESHAASVLTPFAFSKLQEQLVLAAHYASFQMDEGYLVRHHTKLDGGRKVYWVPQEGIISCSCQLFEFSGFLCRHALRVLSTGNCFQVPDRYLPLRWRRISTSFSKTFRSNAEDHGERVQLLQNLVSTLVSESAKSKERLDIATEQTSILLSRIREQPVSSLAIRDISSSVQRNF

SEQ ID NO: 15565 - protein, 334 aa, Triticum aestivum
  misc_feature (112)..(112): Xaa can be any naturally occurring amino acid
  misc_feature (129)..(129): Xaa can be any naturally occurring amino acid
  misc_feature (199)..(199): Xaa can be any naturally occurring amino acid
  unsure (1)..(334): unsure at all Xaa locations
AYLGDTIEQVCTKKQAGTGPEFPGYRRPTRPLFCTPGALQYLSGVILFEETLYQSTKGGKPFVDILKAGNVLPGIKVDKGTIELAGTNGETTTQGFDDLGKRCAKYYEAGAXRFAKWRAVLKIGATEPXSQLSIDQNAQGLARYAIICQENGLVPIVEPEILVDGPHDIDRCAYVTEIVLAACYKALNDQHVLLEGTLXLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 15566 - protein, 283 aa, Helicobacter hepaticus
MEEYRSKKRFGQNFLQDSHFLHKIIQSIPDIPIQCIEIGVGLGDLTQELLKIESLIAYEVDLDLCSLLNKKFSNQIQSGRLNIIYKDILNLPSQQAWLHTHEYKVVSNLPYYIATHIILRLLRDRFCRAFLVMTQKEVAQKFCATTGQKEFCALSVLVESFGKAKMLFEVPKEAFSPMPKVTSSVFVIHKYSQQNQIEDSFLCDLESFLKIAFYAPRKTLFKNLSQVFDKKLLEEVFENENIKSNARAHEVKTKSFHHILQFLKKRNDNGKQTLTRTTKQRPS

SEQ ID NO: 15567 - protein, 242 aa, Rhodobacter sphaeroides 2.4.1
MARHALDSVDSTNAVAARLASSLSGPAWIVAAEQTAGRGRRGRPWSSRRGNFYGTHLLHPTEPREVVALRSFVAALALRDACVALTGLPEAFSLKWPNDVLLNGGKLAGILLESLGQGGRVQHLAIGIGVNLIAAPDAAEVEPGAVRPVSLLAETGVRVTPETFLEALAPAYARREESFTRLGFGPTREAWLSHAARLGEQIRARTGHELREGLFETVDAHGALVLKTGSGRVAIPAAEVFF

SEQ ID NO: 15568 - protein, 246 aa, Triticum aestivum
  misc_feature (152)..(152): Xaa can be any naturally occurring amino acid
  misc_feature (179)..(179): Xaa can be any naturally occurring amino acid
  misc_feature (185)..(185): Xaa can be any naturally occurring amino acid
  misc_feature (190)..(190): Xaa can be any naturally occurring amino acid
  misc_feature (192)..(192): Xaa can be any naturally occurring amino acid
  unsure (1)..(246): unsure at all Xaa locations
MGGLSLQHPWAFAFGLLGNVISFMTYLAPLPTFYRIYRGKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVGFSVSVFVAPLXVIRLVVRTRSVEFMPFSLSLSLTVSAXVWFLYXLLIKXKXVALTNILGFAFGVIQMGFTPSNAMPCLHRHMCGRFMLAGAGQSQHARSHQRCIK

SEQ ID NO: 15569 - protein, 107 aa, Ralstonia eutropha JMP134
MQVIQPTELAQWLADASRAKPVLLDVREPWEVQTCAMPGITHIPMRDIPARAAELDEDADIVCICHHGMRSMQVAAFLERQGYAKVYNLTGGVDAWASQVDPAMPKY

SEQ ID NO: 15570 - protein, 282 aa, Rhodococcus sp. RHA1
MWTDLNRPPLNADNLRAALVRGDDDSDTRRFWARLDVVQETGSTNADLLARAATSNCDRHVLLAEFQGSGRGRHSRAWVSPPQAQIAVSVLLTMPGMSVQDMGWLPLLTGVAVVDALRAATKVPAELKWPNDVLIDGRKVAGILAEVSATAPDPAVVVGIGLNVSLTRDELPVEHATSLVLEGAEVSDRDTLVRAVLRAIADRWQQWHDANWDVTELAEAYRARCGTLGQRVRAELPGGRELIGIATDVDAEGRVVIAPDGQPGTIAVAAGDITHLRPVRTE

SEQ ID NO: 15571 - protein, 114 aa, Arabidopsis thaliana
  misc_feature (37)..(37): Xaa can be any naturally occurring amino acid
  misc_feature (53)..(53): Xaa can be any naturally occurring amino acid
  misc_feature (68)..(68): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(78): Xaa can be any naturally occurring amino acid
  misc_feature (80)..(80): Xaa can be any naturally occurring amino acid
  misc_feature (86)..(87): Xaa can be any naturally occurring amino acid
  misc_feature (89)..(89): Xaa can be any naturally occurring amino acid
  misc_feature (94)..(94): Xaa can be any naturally occurring amino acid
  misc_feature (100)..(100): Xaa can be any naturally occurring amino acid
  misc_feature (102)..(103): Xaa can be any naturally occurring amino acid
  misc_feature (108)..(109): Xaa can be any naturally occurring amino acid
  unsure (1)..(114): unsure at all Xaa locations
MASSMLSSTAVVTSPAQATMVAPFTGLKSSASFPVNXKGNNGITSITSNGGRXSCMKVWPPIGKKEFXTLSYXPXPSXVXFAKEVXXLXGTSGXPCVEFXLXXGFFFXXHGKHF

SEQ ID NO: 15572 - protein, 434 aa, Schizosaccharomyces pombe
MVYIKCRYVCFCCAFISNTTSKSIFNELRCPVTLTFLQFGFVAFFSAVCLLFRKQFLGGTGIQKPSKYVLYTTLPLSIFQIGGHVFGSLATTKIPVSTVHTVKALSPLFTVLAYRFMFRHVYSAMTYFSLVPLTFGVTLACSFELSADIVGLLYALISTCIFVSQNIFGSKIFMEAKSHSTHTKKHYNKLNLLLYSSGVAFIVMIPVWLYQEGFAYLPEVGSPVFLNLIYNGLSHFFQNILAFTLLSIISPVAYSIASLIKRIFVIVVSIIWFQQATNFTQGSGIFLTAIGLWLYDRSKKGNLYESCKVKEFEKDALELEEQTMEDEKSYPSSGTQSPFYGKNFLPQITPRLDSVVPLISDSPMTPNSVYSNEGVTSSVSGNATPASVRQSTQNDFSNSNIHDRRSSYTFQLNNFKAPQPSRLWATETVPTLKI

SEQ ID NO: 15573 - protein, 317 aa, Aspergillus oryzae
MASLLRLLRMQYTLPVDPTVSFAGKTVVLTGATSGLGFEAAIKLLNLGVESLIIGSRSLERGDATKTELEKCTTRQGVIQVWELDMNSFQSVKTFADRIQKEIKQLDIALLNAGLCNKVYTTSPEGWEETLQVNALSTSLLALLLLPKLRDSSSDSNPAHLAVVSSQQFVQVKATSLRTEGSLLEHLNDPRHFSGTKQYGISKLLLEYVLKTMADRERNENGTLPVIVNTISPGLCVSSLGRQYDRFYERWVVWLFYKLFARTAEQGSRSIVSATYQGAESHGKCWRSDGYLEYVSAYFPFISLLYLWTYVRVFITC

SEQ ID NO: 15574 - protein, 223 aa, uncultured bacterium
MTQDEMKTLVGLAALDHVQAGSIVGVGTGSTVDKFIDALGAALKTDPQRVVGAVSSSVRSTERLQSLGVKVLPAESVSRLAVYIDGADEINHQGDMIKGGGAALTREKIVADLAERFVCIADETKLVQTLGKFPLPVEVIPMAAAQVIRAFAAQGGQARVREGVVTDNGNLIVDVTGLSITDPARLESDVNQWPGVVTVGIFARNRASVCLLGTPNGVKTLNF

SEQ ID NO: 15575 - protein, 426 aa, Aspergillus oryzae
MNNKMQSPTILLLGTFDTKTPELTYTHQTLLTQTPQPNILVLDVSHHPPPTTTTSVTDLNITHTIPQKDLPGQRAEYIKAASEHATTIVADLYKENKIHGIISIGGSCGTNIATAAMRNALPVGFPKLMVSTMASGDVKPYVEETDVTMMYSVVDIAGRNWILEGILRNAACAIFGMAGGYYKSLLKSQSHREGGNGGSRGKKRVGITMFGVTTPGVDRIRAHLEDVYGFEVYVFHATGAGGKAMERLIREGQLDAVVDLTTSEVVDEVMGGVLSAGPERLVAAARAGIPQVVSVGACDMVNFGPRNTIPERYEGRLIYEHNPTVTLVRPNAEETVAVAKFIAEKLRSCAVKPELIRLVLPTGGISMIDTPGQPFYDPEVDEVLFLTLEKELDGTGISILRDPRAINDPEFAVSVADMLGDLVKSL

SEQ ID NO: 15576 - protein, 279 aa, Aspergillus oryzae
MPRPTTRQEVLDRLRKTVADGKIIVGAGAGIGLTAKFIEKGGADLILVYNSGRFRMAGRGSLAGMMPYSDANQVVVEMASEVLPIVENTPVLAGVCGTDPFRDMRTFLTELRRLGFIGVQNFPTVGLIDGKFRQNLEETGMGYDREVEMIRIAHEMDLVTTPYAFTVDEGERMARAGADIIVVHVGLTTSGTIGAQTALSLDDCVTIIQEIRDAVVKINPEIIVLCHGGPLAGPKDAEYVLKRTKGVHGFYGASSMERLPVEMAIQENAEAFKKLQVNV

SEQ ID NO: 15577 - protein, 269 aa, Blastopirellula marina DSM 3645
MSSHKPASDRITVPKFVAMKRDGKKISMLTAYDHTMAQLLDEAGVDSILVGDSLSMVVQGHDTTLPVTLDEMIYHAKMVARAVHRALVIVDLPFPSFHLGVYSAIESAGRILKETGAQAVKLEGGVEQAEVIAGLVSAGIPVMAHVGLRPQLVMQMGGYKVQRDEEQLLADALAAQNAGAFGMVLECVPRSAAAKISAELTIPTIGIGAGAGCDGQVLVVNDMLGLTGGYVPKFVKAYADLRGQITTAARQYCEEVRGGAFPADEHSFK

SEQ ID NO: 15578 - protein, 475 aa, Moorella thermoacetica ATCC 39073
MSKTPGEVLEMARKNNIQMVDLKFIDLPGTWQHFSVPLDEFDEGAFTSGVGFDGSSIRGFKTINESDMILVPDPDTAFIDPFCDVPTLSLVCNVYDPMTGQNYNRDPRFVAKKAEAYLKETGIADTSYWGPEAEFFILDHVRFDQSQYAGYYFLDSDEGFWNSGVEMNGHPNLGYRPRYKEGYFPVPPTDTLQNLRTEMVLLLKQMGIAVEAHHHEVATAGQGEIDMKYAPLTRMADQLMMFKYVVKNVAIKHNKTATFMPKPVFQDNGSGMHVHQSLWKGNEPLFYDANGYAGLSELALYYIGGLLKHAPVLTAFCSPTTNSFKRLVPGFEAPVNLVYSQRNRSAAIRIPMYSSSPAAKRIEYRPPDPSCNPYLAFAALLMAGLDGIKNKIHPGEPLDKDIYDLPPEEAARVKSLPDSLEEAIAALEKDHEFLLQGGVFDEDLINAWIEYKQKREINQIKLRPHPYEFVLYYDV

SEQ ID NO: 15579 - protein, 118 aa, Prunus avium
TMPSNCIGSQFEWRKLYPHMRSKLKISWPDVESGNDTKFWEGEWNKHGTCSVEKLNQMQYFERSYAMWRSYNITKILQNASIVPSTTRTWTYSDIVSPIKAATGRTPLLRCKQDKKTQ

SEQ ID NO: 15580 - protein, 204 aa, Wolbachia endosymbiont of Drosophila ananassae
MPDLKTMMLNFGPQHPAAHGVLRLVLEMDGEVIERADPHIGLLHRGTEKLIEHKTYLQALPYFDRLDYVSPMSQEHAYSLCVEKLLQCEVPIRAKYLRVLFCELTRILNHLLNVSSQALDVGAMTPLLWLFEEREKILEFYERASGARFHAAYIRPGGIAADVPEDLIEDIAKFIEQFPKYIDDWSEMRLLLSGLYMNFVVFID

SEQ ID NO: 15581 - protein, 476 aa, uncultured bacterium
MEDGRMTPEQVLEFAKENNVEFVDVRFLDFPGLWQHLTVPVTELTLQSFTQGFGFDGSSIRGWQAINESDMLIIPVPDTAIIDPFCQHPTLSMICDIQDPLTRQRYSRDPRSIARKASDHMCSTGIADTAYFGPELEFFIFDQVCYDQGMNYAHYRVDSREGTWRRGQDEPDNLGNQLRPKEGYFPVPPADTMHNLRSEMVAVLQQCGIEVETHHHEVATGGQAEIDMRFDKLVRMGDKMMLYKYILKNVAARHGKVVTFMPKPLHGDNGSGMHTHFSLFKGDQPLFFDKDKYAEFSDLGRWSIGGLIKHAGAVVAFTNPTTNSFKRLVPGFEAPVNLFWSMRNRSAFVRIPVYQHNPNTKRIEFRCPDSSCNPYLAFSAILMAALDGIENRLDPGPAVDENLYEMSPERVAEIGQTPTSLEGALDALGRDHQFLLKGGVFTEDVIHYWIQYKMDNEVNQLRSRPHPYEFCLYFDI

SEQ ID NO: 15582 - protein, 143 aa, Idiomarina loihiensis L2TR
MALERTLSIIKPDAVAKNLIGAIYNRFESAGLRIVGAKMMHLSKEQAEGFYAEHKERPFFGALVEFMTSGPIVVQVLEGEDAVRKNRDIMGATNPAEALAGTIRADYAETIDENAVHGSDATESAAREISYFFSDEEVCQRTR

SEQ ID NO: 15583 - protein, 267 aa, Desulfitobacterium hafniense Y51
MKKISFIGAGNMAEAIIKGLTGAGSYEIRVTNRSNQAKLAQMKEDYGIIPASFMEAVKDSEIILLAVKPKDVGEVLAQAREGMKSNQLLISVAAGIPLVLLEKHLPHCPIIRAMPNTSSAVLHSMTGLVKGQSVTEENQRDVEAIFGAVGKYIWITEEQMNPLIAMSGSGPAYFYLFTEALVKAGVDMGFSQEAAENLAKETLMGAAKMLAQSGKSPGELRVAVTSPKGTTQEALNVFLEKGLEELVAQAAKACKHRAQAMEREYLG

SEQ ID NO: 15584 - protein, 227 aa, Haemophilus influenzae R2866
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDSEIMDFEIPTGQPLVLKLDDKLNYVEHYYL

SEQ ID NO: 15585 - protein, 287 aa, Bacillus anthracis
MKKKNHKYRGKKLNRGESPNFSGQHLMHNKKLIEEIVDRANISIDDTVLELGAGAGALTTVLSQKAGKVLAVENDSKFVDILTRKTAQHSNTKIIHQDIMKIHLPKEKFVVVSNIPYAITTPIMKMLLNNPASGFQKGIIVMEKGAAKRFTSKFIKNSYVLAWRMWFDIGIVREISKEHFSPPPKVDSAMVRITRKKDAPLSHKHYIAFRGLAEYALKEPNIPLCVRLRGIFTPRQMKHLRKSLKINNEKTVGTLTENQWAVIFNTMTQYVMHHKWPRANKRKPGEI

SEQ ID NO: 15586 - protein, 141 aa, Chlamydophila caviae
MEQTLSIIKPDSVGKAHIGEIVAIFEKSGFRIAAMKMVHLSVKEAEGFYAVHKSRPFFQELVDFMISGPVVVMVLEGDNAVVRNREIMGATNPQEAAQGTIRAQFGESIGINAVHGSDSLENAAIEINYFFSKIEIVNSAK

SEQ ID NO: 15587 - protein, 421 aa, Synechococcus sp. CC9605
MSQRTYHDPLHRGIGLDRQAPAEGMVMDLVDTAPFQRLRRIRQLGPAYLTFHSAESSRFTHSLGVFHLARRAFERMLPLAPELETYRGLLYGAALLHDIGHGPLSHTGEEMFGLRHEAWSARVIRHHPEIRDCLESHESGTAEAVANLLEHGRSPHPLIKHLVSSQLDCDRLDYLLRDSYSTGTRYGQLDLDRILGALTLAPDGDMAIHPKGLMAVEHYLVVRNLMYRSVYNHRLNVVCNWLLEKLIQTARQLGPEQVWADEVMASWLWQPDQIGLEDFLANDDQRTGYHLQRWQAEAPAALAELSGRFLDRRLLKATAVEHLSPADQLQLLAAARRLADRHGHDPELCCGLRHQQLRGYHPYRGGLRLWDGQQLQALEKASPLVASLATPAATSWLIHPRDISAELRQEMDVEWPRAAAA

SEQ ID NO: 15588 - protein, 156 aa, Triticum aestivum
MEVSGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTSEKEGKEPKSPKKATKSPKKATKA

SEQ ID NO: 15589 - protein, 472 aa, Bacillus cereus ATCC 10987
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAIGVVLSYIAPKNLFVYVYSASVLPGMVPWFVILISQINFRKEKGAEMKDHPFKMPFAPVTNYLTIAFLIMVLIGMWFNDDTRISLIVGIIFLAIVTISFYAFGIGKRTPLDVQNDQEISSK

SEQ ID NO: 15590 - protein, 462 aa, Streptomyces coelicolor A3(2)
MSPGQKEALPVADRTPPLGVEELHALVAAGDIDTVVLAFPDMQGRLQGKRFAARFFLDEVLEHGTEGCNYLLAVDADMNTVDGYAMSSWDRGYGDFAMRADPATLRRLPWNEGTAMAVADLAWEDGSPVLAAPRQILRRQLERLAGHGYTAQVGTELEFIVFRDTYEHAWDANYRGLTPANQYNVDYSVLGTGRVEPLLRRIRNEMAGAGLTVESAKGECNPGQHEIAFRYDEALVTCDQHAVYKTGAKEIAAQEGMSLTFMAKYNELEGNSCHIHLSLADADGRNAMAEGGGMSDVMRHFLAGQLVALREFSLLYAPHINSYKRFQPGSFAPTAVAWGHDNRTCALRVVGHGRSLRFENRLPGGDVNPYLAVAGLVAAGLHGIEQRLELPEPCPGNAYTADFAHVPTTLREAAELWENSTLAKAAFGDEVVAHYRNMARVELDAFDAAVTDWELRRSFERM

SEQ ID NO: 15591 - protein, 334 aa, Xylella fastidiosa Ann-1
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLVAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILDYIEDKVVATDFRGETCTCVFDADAGIALDPTFIKLIAWYDNEWGYSNKCLEIAKVIAAK

SEQ ID NO: 15592 - protein, 339 aa, Brassica napus
MADKKIKIGINGFGRIGRLVARVILQRNDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIKKAIKEESEGKLKGILGYTEDDVVSTDFVGDNRSSIFDAKAGIALSDNFVKLVSWYDNEWGYSTRVVDLIIHMSKAA

SEQ ID NO: 15593 - protein, 244 aa, Frankia sp. EAN1pec
MTGSRTLLLLRHGESAWNAADRFAGWVDVPLSARGRVQAGRCGDLLRDTGLLPDVVHTSLLRRAVSTADLALDAADRHWIPVRRSWRLNERHYGALQGRNRMQVRAEYGADLLRFWRRSFHGTPPPIDPGSVFGQDDDARYRELGVHVPRTESIADVLDRLRPYYESEIANDLDAGRTVLVVAHGNVLRALIRHLGAQAGDPADDDLSEVRLPTGALLRYDLTDVGLPVRPGGVLLSASGATQK

SEQ ID NO: 15594 - protein, 132 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKTSGRTGKPSQEL

SEQ ID NO: 15595 - protein, 118 aa, Prunus avium
TMPSNCIGSQFNDSKVYPKLRSKLKRSWPDVESGNDTRFWEGEWNKHGKCSERTLNQFQYFERSHEMWNFHNITEILKNASIVPHPTQTWSYADIVAPIKAATKRTPLLRCRQDKNTE

SEQ ID NO: 15596 - protein, 231 aa, Escherichia coli
MRVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 15597 - protein, 660 aa, Arabidopsis thaliana
MQRSCRTRRRVSVNKFNGRNSFYKVSLSLVFLLWVLLFFSTLLISHGDGAKDEPLNDSMGMADPDDGQSDEKVVPFDGPLSLASASVDVTSDLSRNDDVNLSEESEDKEQEAEISSTVSGNDIESKDTYLLKQSEINKKDTGIDAGSKYDDFPKKSEINNTGTWNDTEGKDDNNFLKQSQLNKTGTGNDTESSDNEFLEQNQMNKTVLGNGTEINVSKVDQPSRAVPLGLDEFKSRASNSRNKSLSDQVSGVIHRMEPGGKEYNYASASKGAKVLSSNKEAKGAASILSRDNDKYLRNPCSTEGKFVVVELSEETLVNTIKIANFEHYSSNLKEFELQGTLVYPTDTWVHMGNFTASNVKHEQNFTLLEPKWVRYLKLNFISHYGSEFYCTLSLIEVYGVDAVERMLEDLISVQDNKNAYKPREGDSEHKEKPMQQIESLEGDDGADKSTHREKEKEAPPENMLAKTEASMAKSSNKLSEPVEEMRHHQPGSRMPGDTVLKILMQKLRSLDLNLSILERYLEELNLRYGNIFKEMDREAGVREKAIVALRLDLEGMKERQEGMVSEAEEMKEWRKRVEAEMEKAEKEKENIRQSLEQVSKRLEWMEKKCLTVFTVCLGFGIIAVIAVVIGMGTGLAEKTGSGAWLLLLISSTFIMFVLSL

SEQ ID NO: 15598 - protein, 117 aa, Arabidopsis thaliana
  misc_feature (80)..(80): Xaa can be any naturally occurring amino acid
  unsure (1)..(117): unsure at all Xaa locations
MASSMLSSATMVASPAQVTMVAPFSGFKESVAFSVTRKVNNDITSIISNGGIVNCMQVGPPIGKKKFETLSYLPDLNDSXLAKEVDYFIREKRVPLGGTCRGGMEFEHREARVLTPE

SEQ ID NO: 15599 - protein, 110 aa, Triticum aestivum
  misc_feature (84)..(84): Xaa can be any naturally occurring amino acid
  misc_feature (97)..(97): Xaa can be any naturally occurring amino acid
  misc_feature (109)..(109): Xaa can be any naturally occurring amino acid
  unsure (1)..(110): unsure at all Xaa locations
TLQRTVPAAVPAIVFLSGGQSEEEATLNLNAMNKLQTKKPWNLSFSFGRALQQSTLKAWVRQDGERGEGQGRRSWVRCKANSEXTLGTYKGDATLGXGALESSNVKDYXY

SEQ ID NO: 15600 - protein, 403 aa, Pseudomonas putida KT2440
MQFSKSNKLANVCYDIRGPVLKHAKRLEEEGHRILKLNIGNPAPFGFEAPDEILQDVIRNLPTAQGYSDSKGLFSARKAVMQYCQQKDIEGVTIEDIYLGNGVSELIVMSMQALLNNGDEVLIPAPDYPLWTAAVSLAGGKPVHYLCDEQADWFPDLEDIKAKITPNTKALVIINPNNPTGAVYSKELLLGMLELARQHNLVVFSDEIYDKILYDEAVHISTASLAPDLLCLTFNGLSKSYRVAGFRSGWLIISGPKHHAHSYIEGIDMLANMRLCANVPAQHAIQTALGGYQSINDLVLPPGRLLEQRNRTYELLNDIPGVSCVKPMGALYAFPRIDPKVCPILNDEKFALDLLLSEKLLIVQGTAFNWPWPDHFRVVTLPRVDDLEAAIGRIGNFLKGYSQ

SEQ ID NO: 15601 - protein, 515 aa, Schizosaccharomyces pombe
MGQGSSKHADSKLDSYPSFSRSDTQGSIKSLKSLKTVLGKGKDSNHDRRTSTDTTHSRHRYPETPPSLPPPPSPGILATSPAVLQKHQQEDSGNSSQSPTSPHPSNQPAMLSPSTAASQHHHHHSSSSSYAVSPTSPTSPTSSGPIGSNFDSASEHNGPVYPQDQQGPVIIPNSAISSTDPDDPETVVSLNVDEMIQRLIHVGYSRKSSKSVCLKNAEITSICMAVREIFLSQPTLLELTPPVKIVGDVHGQYSDLIRLFEMCGFPPSSNYLFLGDYVDRGKQSLETILLLFLYKIRYPENFFLLRGNHECANITRVYGFYDECKRRCNIKIWKTFINTFNCLPIASVVAGKIFCVHGGLSPSLSHMDDIREIPRPTDVPDYGLLNDLLWSDPADTENDWEDNERGVSFVFNKNVIRQFLAKHDFDLICRAHMVVEDGYEFFNDRTLCTVFSAPNYCGEFDNWGAVMSVNSELLCSFELIKPLDQAAIRRELKKSKRSGMAIYQSPPAEQVTQSV

SEQ ID NO: 15602 - protein, 125 aa, Prunus avium
TKPSNCNGSQYDDRKVYPDLRSDLKRSWPDVESGNDTKFWEGEWNKHGTCSEQTLNQFQYFERSHDMWMSKNITEVLQNASIVPSARQRWKYSDIVAPIKTATGRTPLLRCKPDPTQNKSGPKTQ

SEQ ID NO: 15603 - protein, 393 aa, Arabidopsis thaliana
  misc_feature (163)..(163): Xaa can be any naturally occurring amino acid
  misc_feature (174)..(174): Xaa can be any naturally occurring amino acid
  misc_feature (195)..(195): Xaa can be any naturally occurring amino acid
  misc_feature (208)..(208): Xaa can be any naturally occurring amino acid
  misc_feature (228)..(228): Xaa can be any naturally occurring amino acid
  misc_feature (242)..(242): Xaa can be any naturally occurring amino acid
  misc_feature (272)..(272): Xaa can be any naturally occurring amino acid
  misc_feature (286)..(286): Xaa can be any naturally occurring amino acid
  misc_feature (303)..(303): Xaa can be any naturally occurring amino acid
  unsure (1)..(393): unsure at all Xaa locations
RTRPPTRPAFFRISFHFSLISRSLRPTMSAFTSKFADELIANAAYIGTPGKGILAADESTGTIGKRLASINVENVETNRRNLRELLFTARGALPCLSGVILFEETLYQKSSDGKLFVDILKEGGVLPGIKVDKGTVELAGTDGETTTQGLDGLGDRWEKYYEXHGARFAKWRAXLKIGENEPSEHFPFMRTAYGXLARIRMIICEENXLFPNCSSLYIVNRRDSHENXRKCAAVTERELAAXKRIFTDNKFFVVGTIANLNVVSLAYQRPSXVSPEVIVRHYVGAXRRAVPPGVPAIVVLSGXQSEEEATRNLNAMNQLKTKKPWSLSFSFGRALQQSSLKTWAGKEENVKAAQEALYVRCKANSEATLGTYKGDAKLGDGAAESLHVKDYKY

SEQ ID NO: 15604 - protein, 141 aa, Ralstonia metallidurans CH34
MAIERTLSIIKPDAVAKNVIGQIYARFEAAGLKVVAAKMVHLSRGEAEQFYAVHKARPFFKDLVDFMVSGPVMIQALEGESAIAKNRDLMGATDPKKAEKGTIRADFADSIDANAVHGSDAPETAAVEVAFFFPGMNVYSR

SEQ ID NO: 15605 - protein, 264 aa, Escherichia coli K12
MKPTTISLLQKYKQEKKRFATITAYDYSFAKLFADEGLNVMLVGDSLGMTVQGHDSTLPVTVADIAYHTAAVRRGAPNCLLLADLPFMAYATPEQAFENAATVMRAGANMVKIEGGEWLVETVQMLTERAVPVCGHLGLTPQSVNIFGGYKVQGRGDEAGDQLLSDALALEAAGAQLLVLECVPVELAKRITEALAIPVIGIGAGNVTDGQILVMHDAFGITGGHIPKFAKNFLAETGDIRAAVRQYMAEVESGVYPGEEHSFH

SEQ ID NO: 15606 - protein, 120 aa, Prunus avium
TKPSNCNGLKFEAKKLSPEMQTKLKKSWPDVESGNDTKFWEGEWNKHGKCSEQTLNQMQYFERSFAMWKSYNITEILKNASIVPHPTQTWKYSDIASPIKAVTKTTPLLRCKRDHPNKPE

SEQ ID NO: 15607 - protein, 215 aa, Haemophilus influenzae R2866
MNQSILSPFGNTAEERVLNAINAFKNGTGVLVLDDEDRENEGDLIFPAETITPEQMAKLIRYGSGIVCLCITDERCQQLNLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 15608 - protein, 406 aa, Exiguobacterium sibiricum 255-15
MDHLIFEVGTALILVAIAALLANKLNFSIIPFLIVLGMIVGPHAPTIGILDFKFIESAEFISFLGRIGVLFLLFYLGLEFSIGKLIRSGKSIVTSGTIYLSINFTGGLLYGFIAGFPLYEVLIIAGIITISSSAIVAKVLVDLRRTGNTETELILGIIMFEDIFLAVYLSVLSGLLLGDGTTLLSSVTSILIALGYMLLFFVIARKATPLLNRMLKIASDEVFIIVVFAALFFVAGFSETIHVAEAIGALLLGLVFSETDQGERIEHLVVPFRDFFGAIFFFSFGLSIDPTMLLDAVWLALGAVVITIVGNYVAGMIAGRRAGLSHKASSNIGLTIVSRGEFSIIVANLGIAGGLMDILSPFSALYVLILAILGPLMTKESKRIYNFMNGIFKWTEPKPKKTKPKA

SEQ ID NO: 15609 - protein, 509 aa, Geobacter metallireducens GS-15
MELPLCDFPFTLQLDLQKTTKESSEMMILKNSSLLKQQCYLDGHWCCADGGATIDVTNPATGEILGVVPKMGTQETRRAIEAANGALDGWKARTAKERSAILRRWFELIMENLEDLAVIMTAEQGKPLAESRGEIAYAASFIEWFAEEGKRIYGDTIPSYARDKRIVVIKEPIGVCAAITPWNFPAAMITRKAGPALAAGCTMVVKPATATPFSALALALIGEQAGIPAGVFSVITGSSKEIGDEMTGNPIVRKLTFTGSTEVGKQLTAQCAGTMKKVSMELGGNAPFIVFDDADLDAAVEGAIASKYRNTGQTCVCTNRILVQESVYEAFSAKLVAAVSKMTVGDGLKGEVQQGPLIDMTALEKVEEHIADAVAKGARVVLGGKRHALGGTFFEPTIITDVTPGMLVAREETFGPLAPLFKFSTDEEAIRMANDTEFGLASYFYSRDIRRVWKVSEALEYGMVGINTGLISSEVAPFGGVKESGVGREGSKYGIEEFVEVKYLCMGGI

SEQ ID NO: 15610 - protein, 393 aa, Ralstonia eutropha JMP134
MDPQRLATASRLANIDAFHVMELAKQANELERVGRHIIHMGIGEPDFTAAEPVVRAAEAAMRRGVTQYTGALGIHALREAIAGYYKTMYGLEIPARRVIVTAGASGALLLACAVLVEIGAEVLMPDPSYPCNRHFVAAFDGAARMIPSGPAERFQLTAAQVEAHWNERTRGVLLASPSNPTGTSILPDELGRILQAVRARQGFAILDEIYQGLSYDAPPVSALSLDDNVVTVNSFSKYFNMTGWRLGWLVVPDALVADFEKVAQNLFICASAVAQHAALACFSPEAMAIYDERKAEFRRRRDLIVPALESLGLHVPVMPDGAFYVYADCRQVNHPAAGDADKLTQAMLHDAGVVMVPGQDFGPHTAQDYIRISYATSRQNIEEAMARLQKLFR

SEQ ID NO: 15611 - protein, 334 aa, Flavobacteria bacterium BBFL7
MIVKLILYCKFHCIKQTIMSKNQFGKNGWTPDIIGSLKGKTYVITGTTSGTGLEAAKILLAKDAKVVMLNRNNTKAQDTIAKFKSELGNHIEVSNIQMDLAQLASVRKAAKQVLSTIPHIDALICNAAIAQVPKQVLTVDGFESQLGVNHYGNFLLQGLLFPLIDKSNGRIVTVGSEGYKMGIKTIKFDDMNWDNDYNPNTVYSQSKLAQIMSVYELQDRLKNAGKSNVKVYACHPGASRTSLIKTSGSLMTRFIWQMMKLSPFVQSAEKGSYPALMCATEPELDQKRYYGPTSGNYWKGPVGECNLEPHAKDKATMVKLWEVSEDATGFQWNL

SEQ ID NO: 15612 - protein, 473 aa, Artemisia annua
  misc_feature (68)..(68): Xaa can be any naturally occurring amino acid
  unsure (1)..(473): unsure at all Xaa locations
MELYTTSLLFIVSFSTIIFLLFRRNSAFWRSINTPPGSTGLPLIGETFQIISAYKTENPEPFIDARVXKYGSVFTTHVFGERTVFSADVEINKFILQNEGRLFESSYPGSIANLVGKHSLLLMRGGLHRRMHSLTMSFANSTIIKDHLLADIDRLVRLNLDSWTGRILLMDEAKKITFELTLKQLLSIEPCEWSENLRKEYMLVIEGFFCIPLPFFSLTYRRAIQARKRVTEALHLVVRERRIEREKGVKKNDMLAALFDSDGDEENFYDDEIVDFLVSLLVAGYDTTSTTMTLAVKYLTDTPSALAQLKEEHDAIRAKKGASVALEWDDYKSMPFTQCVVNETLRLSNIISGVFRRAITDVKIKDYTIPKGAKVFTSLRAVHLDQDNFEDARVFNPWRWQKTSDSASFMPFGGGPRRCPGHELARVALSVFLHHLITHFSWKPAEEDKVVFFPTTRTQKRYPIIVEQRNVVG

SEQ ID NO: 15613 - protein, 391 aa, Ralstonia eutropha JMP134
MFERPPDSWPPLAPICRPAAMTIARTEDIIADIRAGRMVILVDEEDRENEGDLVLAADFVTPDAINFMAKHGRGLICLTLTAERCRQLNLQPMVSRNGTQHGTNFTVSIEAAEGVTTGISAADRSRTVEAAVARDAKPSDLVQPGHIFPLTAQPGGVLIRAGHTEAGCDLGALAGLTPAAVICEIMKDDGTMARLPDLIEFAQEHNLKIGTIADLIHYRSRTESIVERVGERAMETPYGTFHSIAYRDKPTGHAHLALVKGTPSADKETLVRVHEPLSVLDLLEVSRTTHSWSMPAALEAIAKAESGVMVLLNCGDSADQLFTQFTALDEPQNRPRRKPDLRTYGMGAQILKDVGVGKMRVLAAAQRMPSMTGYDLEVTGYQPMNGQAKQN

SEQ ID NO: 15614 - protein, 340 aa, Brassica napus
RPRVREMEDEDSSAPTFTITVDAKSGTSTGVSASDRAMTVLTLASLEAKPDDFRRPGHVFPLKYREGGVLRRAGHTEASVDLMILAGLRPVSVLSAILDQEDGSMASLPYMKKLATEHDIPIVSLTDLIRYRRKRDKLVERITVSRLPTKWGLFQAYCYRSKLDGAENIALVKGNIGNGQDILVRVHSECLTGDIFGSARCDCGNQLELAMQLIEKEGRGVVVYLRGHEGRGIGLGHKLRAYNLQDEGHDTVQANLELGLAIDAREYGIGAQMLRDIGVRTMRLMTNNPAKFTGLKGYGLAVVGRVPVVTPITNENRRYMETKRKKMGHIYISDIDQPLV

SEQ ID NO: 15615 - protein, 317 aa, Yarrowia lipolytica CLIB122
MEHIKNFWAAKPQYKEVEYADQRDKTFVVTGGLSGVGMECARLLLKKRARVVIVGRNKDFARDLLSELARDIPEGEAAFVELDLADLESVKKGGQEIARHYPVIHGVVLNAGTMAPPYAKTKQGHEIHWGTNVMGHHLLMKYLEPSVLRAAHDSPPGTVRIVWVAASSSTLIPGLEGSIRFNTNNEDEKKPPHVLYNMSKTGNAYEAYLWSKFHPHSGVSSVSMDPGNLSTNLTRHSGGLVHRFKDYVLYPAKFGAYTELAALLSPTIKDGDHLVPWGVPGTLRHDVDEARRGPKGEEMWIELERDTQAFFQPEEVH

SEQ ID NO: 15616 - protein, 309 aa, Schizosaccharomyces pombe
MSVSGKIGEVDRWIEQLSRCEPLSEEDVIQMCDLAKEVLSVESNVQSVRCPVTVCGDIHGQFHDLMELFNIGGPSPDTNYLFMGDYVDRGYHSVETVSLLIAFKIRYPQRITILRGNHESRQITQVYGFYDECLRKYGNANVWQYFTDLFDYLPLTALIEDRIFCLHGGLSPSIDTLDHVRILDRVQEVPHEGPICDLLWSDPDDRPGWGISPRGAGYTFGPDIAEAFNHNNGLDLIARAHQLVMEGYNWTTNHNVVTIFSAPNYCYRCGNQAAIMGIDDHINYAFIQYDTAPRKEELHVTRRTPDYFL

SEQ ID NO: 15617 - protein, 485 aa, Bacteroides thetaiotaomicron VPI-5482
MLLKQTKIVASISDRRCDVDFIKQLFEAGMNVVRMNTAHASREGFEALIANVRSVSNRIAILMDTKGPEVRTTANAEPIPYQIGDKVKIVGNPDQETTRECIAVSYPNFVNDLNIGGLVLIDDGDLELEVIDKTADYLLCEVKNDATLGSRKSVNVPGVRINLPSLTEKDRNNILYAIEKDIDFIAHSFVRNRQDVLDIREILDAHNSDIRIIAKIENQEGVDNIDEILEVADGVMVARGDLGIEVPQERIPGIQRVLIRKCILAKKPVIVATQMLHTMINNPRPTRAEVTDIANAIYYRTDALMLSGETAYGKYPVDAVKTMTKIAAQAEKDKLEENDIRIPLNENSNDVTAFLAKQAVKATSKLKIRAIITDSYSGRTARNLAAFRGKFPVLAICYKEKTMRHLALSYGVEAIYMPELANGQEYYFAALRRLLKEGRLQPTDMVGYLSSGKAGTQTSFLEINVVEDALKHAGETVLPNNNRYL

SEQ ID NO: 15618 - protein, 420 aa, Aspergillus oryzae
MAESITTLKQQLIDEFIQANPKSKAAFDRARNALPAGNTRSVLWSEPFPLTLQSGNGAHVTSVDGQEYLDFVSDFTAGLYGHSHPVIKQAVKDALATGFSLGGVVEKEAQLGEILQTRFKSIERVRFCNSGTEANTFALATAKAFTGRNKILVFDSGYHGGTISFHGTTPNPMNLPHEFVVGAFNDIERTQSLVDNSLAAILIEPMQMAGGVRPASIEFLRFLRESATKVGAVLIFDEVVTSRLHYHGLQGAREVYPDMTTLGKYLGGGFPFGAFGGRADIMEQFNPIAHGRSVLHHSGTFNNNIFTMTAAVAAAELVTKQSLAELNKLGDDLRATGNSIVQQAGLKDIVFVGYGSTVGMGFLGDRGQVLREVFYFTLVKQGILMGRRGFLCLNLAHTKEHIDRFLDVVKVFAEQHRADV

SEQ ID NO: 15619 - protein, 338 aa, Candidatus Kuenenia stuttgartiensis
MSGSKIITVQRHIIEQERDHPEATGELTGLLWDLTIAAKIISREVNRAGLADILGLTGQENIHGEEVKKLDEYANDVIIKSMDHGGHLCVMASEENEDIIPIPDQYPKGKYMLMFDPLDGSSNIDANVSVGTIFSIYRRKTTAGNGTLEDCLRKGVEQVAAGYIVYGSSTMLVYTAGHGSHGFTLDPGIGEFLLSHKNIQIPSRGKIYSINEGNTNTWDEGTRKYINDLKKVTPETGQKPYSLRYIGSLVADFHRTLLYGGIFLYPADYKDPNKPKSKLRLLYEAAPLAFIVEQAGGKASTGDTAIMEIKAEQLHQKTPLIIGSKEDVEKYEGYFKNK

SEQ ID NO: 15620 - protein, 129 aa, Glycine max
  misc_feature (13)..(13): Xaa can be any naturally occurring amino acid
  unsure (1)..(129): unsure at all Xaa locations
TCVPWLLKLMISXSSQTNELYQLASVAFCLLVAWCSDKLGLSLELGSFAAGVMISTTDLGQHTLEQVEPIRNFFAALFLASIGMLIHVHFLWNHVDILLAAVILVIIIKTIVATSDVKGFGYNNETSVL

SEQ ID NO: 15621 - protein, 120 aa, Prunus avium
RKPSNCNGSQFDDRKVYPDLRSDLKRSWPDVEGGNDTKFWEGEWNKHGKCSEQTLNQFQYFERSHDMWMSYNITEVLKNASIVPNAKQRWKYSDIVSPIKGATGRTPLLRCKRDPATNTE

SEQ ID NO: 15622 - protein, 408 aa, Yersinia pestis CO92
MILNVYVVISIFIMNAMSLLSVEVSNFTFVGLFKNDNVNIVSIHRVLLLLEELMSQLPEKMSAVVCHGPQDYRLEHVPTPVPKAKELVIKVKGCGICAGDCKCKNGAKMFWGETPWVKPPVVPGHEFYGHIVALGEGTESKYKLGERVIAEQIVPCWDCRYCNSGSYWMCETHNIYGFQKDVAEGGMAEYMRFSENAIVHKIPESLSHEDAVLIEPMACAIHTVARGDIQLDDVVVLAGAGPLGLCMVPVARLKTPKKLIVIDTIEERLALAKAFGADVVINPLKEDADKIVKSLTGGYGCDVYIEATGAPIGVTQGLQMIRKLGRFVEFSVFGQETTVDWSIIGDRKELDIRGAHLAPYSYEIATDLFERGLVTSKGIVTHSYSLDDWEKAFELADSTNSIKVILVP

SEQ ID NO: 15623 - protein, 66 aa, Triticum aestivum
GILDPRKRKAEKKRRKANRFSVLNDMDADYDFKVDYQMEDAADGEDEDAGDEAKEDNEPMTGVDDS

SEQ ID NO: 15624 - protein, 118 aa, Prunus avium
TMPSNCNGTQFKMQNLFPYLRSRLKMSWPDVESGNDTKFWEGEWNKHGTCSERILNIMQYFQRSQAMWKSHNITEILKNASIVPHPTQTWKYSDIVSPIKSATGRTPLLRCKQDKSTQ

SEQ ID NO: 15625 - protein, 491 aa, Nocardioides sp. JS614
MSLMRTKSVEQSIADTEDPDHKLRKELGALDLMVFGVGVTIGAGIFVLTGTVAASNSGPALALSFLIAAVACALAALCYAEFASTVPVAGSAYTFSYATLGELVAWIIGWDLILEFTIGAAALSTSFSGYLQELLDGTPFEVPTQFGSAADGFIDLPAVVIALLVMLVLIRGTKLSSMVNQVVVAIKLAVVAAVIVVGVAYVDPSNWTPFIPDSQPVGDAEGGFRQLPLITTLLGIEPAVFGIGGVIAGAAVVFFAFIGFDVVATTAEEARNPQRDIPIGILGSLAIVTVLYMAVSLVVTGVQSYQDIDPDDPAPLATAFSAAGVSWVGDLISVGACIGLVVVAMILMLGQCRVAFAMGRDGLLPRSVAKVHPSFGTPYRITLITGFVVAAIAGFVDLSTLADLVNIGTLFAFILVSLGVVVLRRTRPELPRSFRTPFAPVVATLATLLCFYLMLNLKGETWERFLIWMALGFVVYFVYGRRHSRVGPRRA

SEQ ID NO: 15626 - protein, 119 aa, Prunus avium
WRPSNCTGTQFKQLSPQLRSKLKISWPDVEGGNDTRFWEMEWNKHGTCSEESLNQMQYFQRSFAMWRSHNITEILKNASIVPHPTKTWKYSDIVSPIQTAIKRTPLLRCKRDKAHPNIQ

SEQ ID NO: 15627 - protein, 471 aa, Exiguobacterium sibiricum 255-15
MIEQNVINGVWYDTEETIPVFNPATKELLGHVPSSTADDAQRAVDAASTAFVDWSERTADDRADKIDAWYRLIQEHRDELADIMTREQGKPFIEARGEIDYGNQYVRWYAEEARRIYGETIPASVPGKRLFVEKEPVGVVAAITPWNFPAAMITRKLAPALAAGCTVVLKPSEETPYTALRLVELAIEAGIPAGAINVLTGDAATISGVWQADSRVRKITFTGSTAVGKLIMRQAADTMKKLSLELGGHAPFIVTENADLDKAVQGAIRSKFRNGGQACVATNRFYVQASVLDTFTEKFVAEVKRLKVGNGLDADSTIGPLINAKAVAKVKAHIDDAVAKGATILTGGTIDDSVGYFVEPTVLGNVTEDMICMQEETFGPLAPISVFETLDEVIERANNTPYGLAAYAFSEKIDEALRLGKKLEYGIVGLNDGAPSAAQAPFGGYKESGLGREGGVYGIEDYLEVKYLSLG

SEQ ID NO: 15628 - protein, 495 aa, Medicago truncatula
MAFSFPDVFCWIQNLPPISEWETNSISLNVCSSTTSQPLLNLTISKIHQSLKLSFMIVAEFNNIDPIHLWTSKPFMPSSKTTNLLDKETISNLFINFIQDILHYGSNKNSPLIRFPKLDSGPNLPNIFNLTFFTLFVLVCIYEAPKNISDACIGFLKDHLTSTQSRQASNLLMKLLGSNLQEQWMRSVNLAITNWVGEIEEQHQNMFRTPCSLFSYAFSTSGLWKVQLYCPATCMDVEKSESHPHDKLEFSLKYHQVESVLQFNYKVVVKEEWVEIMVNVDNIRCDVTKLVNDSLVKERGAGATEKHFPSRISLQLTPTIQNQVMSLSVGKSTENPKKEIGIDKGIEASIEPPNPLGLKVSAGESTTVSLKPWKFEQSVYGYSANLNWFLHDSMDGKEVFSSKPSKCALINPKSWFKNRYSSAYRPFTRQGGVIFAGDEYGERVWWKVDKGAIGKTMEWEIRGWIWLTYWPNKRVTLYNETRRMEFREIVYLDVA

SEQ ID NO: 15629 - protein, 491 aa, Silicibacter pomeroyi DSS-3
MTETALSARADIADKALVRSFSYINGKWCAAANGETFAVTDPADGTELGHAASLSAEESSAAVDAAQAAFPAWAGRLPQERAALLRRWYELLLEHKEDLARIMVLEQGKPLSEARGEIDYGAAFVEFYAEEAKRPNIEGVTSHLPDAEVELWREPVGVAALITPWNFPSAMLTRKAAAALAAGCTVVAHPSRETPFSALALAELAERAGVPPGVFNVVTGTAATVVEPWTRDTRVRALSFTGSTEIGKLLYRQSADTVKRLVMELGGHAPVIVFKDCDLDKAVSETIKAKFATSGQDCLGANRILVERPVYADFCARFTLAAQALTLGPGMADCDLGPLMNEQAVQKQEDHVADALARGARLACGGRRHPRGPLFYEPTVLVDVPPDALIMSQETFGPVAAIAPFDTEEEAVARANDSEYGLVAYVHSNDPRRIYRLSRALQYGMVAVNRTKVTGAPIPFGGTKQSGLGREGARLGMEAFTEVKYICRDWA

SEQ ID NO: 15630 - protein, 507 aa, Triticum aestivum
  misc_feature (413)..(413): Xaa can be any naturally occurring amino acid
  unsure (1)..(507): unsure at all Xaa locations
HASGRARDVVYRVLSAACEDGDLSIEEAIDAVEDIFRRNASDLYKLNVANGSIHQTTMIADNRIASSCVEQDVLFVRIVWNDASGQHRCRVVPAGRFYEIARNKGVGLTFASMGMTSFCDGPADGTNLTGVGEIRLMPDMSTLLRLPWSTREEMVIADMQIRPGEAWEYCPRYALRKVTKVLLDEFNVTMKAGFENEFYLRRKLVSEGHERWVPYDNSSYCSTSSFDGASSILQEVYSSLKVANIVVEQLHAEAGKGQFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNSYDRIQPNTWSGAYLCWGKENREAPLRTACPPGVPLDMVSNFEIKSFDGCANXPHLGLAAIVAAGIDGLRKGLKLPEPIESNPADYATKLKRLPQDLLESVESLAADKTLHELIGDKLITAIIAVRKAEIDHYSKNPGAFGDLIHRY

SEQ ID NO: 15631 - protein, 427 aa, Bordetella parapertussis
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLPLEFNNLAAVDAAFSQHGAEIACVIVEPVAGNMNLIKPAEGFLAGLRELCTRHGAVLIFDEVMTGFRVGPQGVQGLTGVRPDLTTLAKVIGGGMPVGAFGGRADLMAHITPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 15632 - protein, 589 aa, Agrobacterium tumefaciens str. C58
MMKIPYIPQDAPFNGDQRAWLAGFLAGLHSRTAIGLETSVAAAAPKSAASVLNILVGTQTGNAEALAMDIAAAARTQGMQPVVTALDDVSMDSLGSMKRVIVVTSTYGEGEMPDNAQLFWEALAADSAPRLDEMNFAVLALGDTGYDGFCQAGKLIDTRFEQLGGRRMKARIDCDIDFEDAAAAWIGEALPLALAVDGGKEAAVTMPDIAAQPTRAKSGWSRKNPYPATVGVNRRLSGSGSSKEIRHYEFDLRESGLDYEAGDALGVVPLNNPKLAGALLGHFGAVGDSQVAGLDRPVGDALLNIYEISTPSRELVAEIGKRAGHEELSHILANGDKEQLAAFLWSKDILDLLNLGGKPLFELAEFVTFLKPLQHRAYSISSSPLLAKDSVHLTIASVRYRAEGRERGGVCSTYLADRVEAGQSAGIFVSPNKAFRVPQDDNAPVIMVGPGTGIAPFRAFLQERQARGARGKNWLFFGDQHRQSDFIYENELGDMSRDGVLTRLDLAFSRDQAEKIYVQTRMRQNGKALYQWLEEGGYFYVCGDATRMAKDVDDALHSIISDEAGISAEAASDYVNRLKREKRYLRDVY

SEQ ID NO: 15633 - protein, 248 aa, Bacteroides thetaiotaomicron VPI-5482
MKKIVLLRHGESAWNKENRFTGWTDVDLTEKGVAEAEKAGVTLREYGFNFDKAYTSYLKRAVKTLNCVLDKMNLDWIPVEKSWRLNEKHYGDLQGLNKAETAEKYGEEQVLIWRRSYDIAPNPLSESDLRNPRFDYRYHEVSDAELPRTESLKDTIDRIMPYWESDIFPALKDAHTLLVVAHGNSLRGIIKHLKHISDEDIIKLNLPTAVPYVFEFDENLNVANDYFLGNPEEIRKLMEAVANQGKKK

SEQ ID NO: 15634 - protein, 398 aa, Lactococcus lactis subsp. lactis Il1403
MFQYNKVEEALAALKAGEMIIVSDDENRENEGDLICAAEFISPEIINFMASEAKGLICAPLSETYAKNLQLEAMVEKNTDNHGTAFTVSVDHIETSTGISAFERALTIKKLVDAESLPSDFRRPGHVFPLIAKKNGLFERNGHTEATVDLLRLAGLKEVGVCVEIMDEDGTMMHKEKLKEKAQEWGLKYITIKAIQEYLKQNELQVEQVTRAKLPTKYGMFDILGFVNKINGEHHVALVKGDIGDGQAILCRVHSECLTSDAFGSLKCDCGGQLEEALKKINDEGRGVLLYLRQEGRGIGLINKLRAYSLQDEGLDTVEANLALGFEEDEREYSIGAQILKIIGVKSLKLMTNNPQKINDFQKYGLVVEERVALQIKDNPFDLDYLKVKQNKMGHLFD

SEQ ID NO: 15635 - protein, 277 aa, Bordetella parapertussis
MKNDLSIAFIGGGNMAAALASGLAGKVCPAANIHVVDINADSHAGWRARGMSAAAAPDATLAGCRVWVYAVKPQHMREAVAGTRPWLRPDTLIVSVAAGIHADTLAGWLGEPGQPWQRLVRCMPNTPALVGAGMTGLAALPGVTPQDRELAGQLLTSVGEVVWVDGDAGLDAVTALSGSGPAYVFLFIEALIAGGRAVGLTDEQARQLALGTLAGATRLAAQSDEPPAVLRERVTSKGGTTATALDVYAQGDFAGLVERAMQAAARRSRELAEEFGR

SEQ ID NO: 15636 - protein, 255 aa, Escherichia coli CFT073
MRSKYMAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 15637 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 15638 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 15639 - protein, 80 aa, Anabaena variabilis ATCC 29413
MITPQQVEAMIKAELPDAQVQVQDLTGGGDHYQVTVVSSQFAGKRLVQQHQLVYGALRQAMSTEAIHALALKTYTPETSQ

SEQ ID NO: 15640 - protein, 478 aa, Burkholderia xenovorans LB400
MHRATKIVATIGPASNTPEILLQMIQAGLDVVRLNFSHGTADDHRQRAGFVREAARQAGREVAIMADLQGPKIRVGKFENGKIMLVAGEPFVLDADCELGNEQRAGLDYKDLPRDLKPGDVLLLNDGLIVLNVSRVIGNEIHTVVKIGGELSNNKGINRQGGGLSAPALTAKDMEDIRTAMSLGVDYVAVSFPKNATDMEMARQLANIAGAPFGVKPKMIAKIERAEAIPALQGILDASDGIMVARGDLAVEVGNAAVPALQKRMIRMARESNKFVITATQMMESMIHAPVPTRAEVSDVANAVLDGTDAVMLSAESAAGKYPVQTIETMAAICIEAEKSEQSELDKDFLDRTFTRIDQSIAMGALFTAFHLGAKAIVALTESGSTALWMSRHWTHVPIFALTPRVGSERAMALYRNVTSLHLDTNTDRDTALQQALETVVSKGYASRGDMVVLTVGEPMGQAGGTNTLKIVRVGEPY

SEQ ID NO: 15641 - protein, 458 aa, Listeria monocytogenes str. 1/2a F6854
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQILKASNRKTKIRHN

SEQ ID NO: 15642 - protein, 280 aa, Streptococcus agalactiae A909
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 15643 - protein, 272 aa, Thellungiella halophila
MATQPPSSSSAREEFVYMAKLAEQAERYEEMVEFMEKVAKAVDKEELTVEERNLLSVAYKNVIGARRASWRIISSIEQKEESRGNNDHVSLIRDYRTKIETELSGICDGILKLLDTMLIPAAASGDSKVFYLKMKGDYHRYLAEFKTSQERKDAAEHTLNAYKAAQDIANAELAPTHPIRLGLALNFSVFYYEILNSPDRACNLAKQAFDDAIAELDTLGEESYKDSTLIMQLLRDNLTLWTSDMQDDDDVIKEAAAAAPAAPKPAEEQQQS

SEQ ID NO: 15644 - protein, 412 aa, Zea mays
MAALSVPLHAAAGSRAAAADPVKVPCVRSTGSAHFGRAFPSVAVSSLAARHIEPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 15645 - protein, 1110 aa, Ashbya gossypii ATCC 10895
MNNQNPFANIGTPSFNLSQIPQHILQSLTPMQLQMIQQRHRQILMQRQQHQMGAGGAAGAASSAEGIGNQDGHQAGSQHQSPNVMTPVGAGGMGTPGMSGMMERSGSNQGVYLNVAQKAQLLKAQQQQLALMQQQQIQQAQAQQSPQAQQAQQGLHNQQAQHSPRNAQVKQAQQSHQVQAQQSQQNQPSQQTQQVQQMLQRQQQQQETQRQQKQQQQQQQLSQSPQPGQSPVVTPSINLPVQIAQLPPHLQLQWLNNLKQQAISKNNGNAVAMITQLQQQVQMSIQQKQQQQQQHQQQQQQQQQHQQQQNQQHQQQQHQQQQHQQQHQQNQLQQKQQQQQQQQQQQNQQHQQLQQQQLQQQPQQQPQQPQQPQQPQQPQPQPQPQPQPQPQQPQQPQQQSQQHQQQQQQQLQQQLQPQPQPHHHHHHQQQKQQLQQQQQQQLQQQQQQQQQNQQHQQHQQQNQQHQHQQQQQHQQQQQQQQQSPQQQSPQSQVHGNLPDLSKGGMSPSMQMSPNPQAQGPQPTQQVPHYMSHLPSGYQIPRQSTPQSSGTPQPLQKQLLPQGQMGTVNHASEHSNNLQISSSVPPNVSVSHMGTSTEADLPKFQTIYEDPKETLLTSSDAWSRSLKAQNIDPPSDLLLYEQIISRDQLNSLQLVRERNGYEPMSKFGFSNKEYLTRLLQDLNYYKELKNTRMKSITNTSQGTVSKSIWGDGYSGYGNGFTNTVTNVVIGGELSGEYISLNDVYDVTMQHDIEELVPIRLEFDTERDRFSLRDTFIWNKNEKLVKLEEFVMRTLEDYRFAQPTQYCDAVLNAIREQLNEFQTNPFKHIRNANRIGGDDLRIKIRLDIVVGQNELLDTVEWDISNPDNDPEEFAQVMCEELQLPGEFMTAIAHSIREQVHVYHKALALIGYKFDGSFIDDDDIRSRFLPVITLDEVFRASSDCKTYTPNLLEISAPELERLEKDKDRDTRRKRRQGRFNRRGAVAFPDAMPDLNDIPKTFRIPVPSTILPGGVDLGPPVGSYTVVSTSSQQPRPPKPRPVEAPCRIITHERGRSLLLSIRLRAPVATAQKAPATAPGVAPAVPPVVLSDNPTPPYPYAVPSQLDAQDSPRHR

SEQ ID NO: 15646 - protein, 268 aa, Rickettsia prowazekii
MIINKIMNIGKFKLIVFDEIDSTSSEAMRIARHNKVYADYAIFAKSQTRGRGRSGKNWQSRLGNLHVSLLMRPDKELELLPQLCFVTALAVYDTILSCILYAGSNQLINNFNAVSVCPQNYSIQLKWPNDILMNGRKIAGILLESVKMDNNYYLIIGIGINITYHPENIDQPTTSLITENLMHVVPKALLKILIKNFEKYYKIWHHNGFPFIRKKWIEHAYKLNENINIKYRNDIVTGLFKDIDNTGNIILQLNTQEIISFSTAELYF

SEQ ID NO: 15647 - protein, 393 aa, Brassica rapa subsp. pekinensis
MAEGEEIQPLVCDNGTGMVKLKFGDSTSDHYFICEQAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELDTAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 15648 - protein, 396 aa, Streptomyces coelicolor A3(2)
MKAVTWQGKRDVRVEEVPDPKIQEPTDAVIRVTSSGLCGSDLHLYEVLTPFMTPGDILGHEPMGIVEEVGPEVTNLKPGDRVVVPFQIACGHCYMCDTGLPTQCETTQVTGEGMGAPLFGYTRLYGAIPGGQAEYLRVPQAQFGPIKVPEGPADDRFVYLSDVLPTAWQAVEYAAVPQGGSLAVLGLGPIGDMACRIARLKGIDKVFGVDLVPERLERARERGVETFDLRSFDNEKELVSAIQDRTGGRGPDAVIDAVGTEAHGGAVAKLVQQTAAVLPRAIGGPLAERFSIDRLAALYTAIDLVRRGGTISLSGVYGGMADPMPMLTMFDKQIQLRMGQANVRRWSDEIVPYLTDDDPLGVDGFATHRMPLADAPHAYEMFQKKQDGAVKVLMQP

SEQ ID NO: 15649 - protein, 120 aa, Prunus avium
TKPSNCNGSKYEDRKVYPKLRSKLKRSWPDVESGNDTRFWEGEWNKHGRCSEQTLNQMQYFEISHDMWVSYNITEILKNASIVPHPTQKWSYSDIVSPIKTATKRTPLLRCKTDPATNTE

SEQ ID NO: 15650 - protein, 435 aa, Ruminococcus albus 8
MKYTEREVLQFVEENDVKFIKLMFCDIFGALKSVSVPASELSGIFAKGLLFDASKLSGFMNFSSTDLILFPDPDTLALLPWRPQQGRVVRFFCTIKYTDGTVFEGDGRTFLRNAVEYARGKGYNFQIGTSCEFYVFEKNDNGHITKIPHDYAGYCDIAPADKGENLRRDICLTLEQMDIYPESSRHESGPGQNEIDFQYSNALNAADNLVTFKNVVKSVADRNGLYATFMPKPLCDRPGSGLHIMLFCMKGTENIFKPRLDELGHEAKSMIAGILERVREITLFLNSTASSYSRLGNSRAPKYITWSHENFAQLIRVPMINTDENAMILRSPDNTCNPYFALGLIIYAALEGALSGAELCSATNLSPDNIAELTERLPATLDEAIEAARSSSFLADRLPENLIEHVLNEKSREAKEYAECEDKEMFETVRYFYTL

SEQ ID NO: 15651 - protein, 340 aa, uncultured bacterium
MKAVVFHGKDAGLKIEDIPVPQIKGDQILVKVAACGVCHTDLHYIEHGVPTFKKPPIVLGHEASGIVEKAGANVTNVKPGQRVLIPAVLTCGHCPACRQGRENICSNMTMLGNHFDGAYAEYVAVPAKDVLGLPEAIPLQEASIIADAISTPYHAVKNRAQVKPGDTVVVFGCGGVGINAVQMASAAGGYVIAVDINPRKLEWAREFGAAKTVDASKVDRVSKEIKKLTGGGADIAMEVIGNPRTIEQAFECVRVGGRLCVVGYTHEAISIVAGKIMFKELEIVGSLGCRPVDYVPLIRMVEQGKIDLKRQVTHRFGLDELGQAFEVMKEGLSLRSIVIP

SEQ ID NO: 15652 - protein, 118 aa, Prunus avium
TKPSNCNGSQFDGRKVSPQLRAKLKRSWPDVESGNDTRFWEGEWNKHGRCSEQTLNQMQYFERSQNMWRSYNITEILRNASIVPHPTQTWTYSDIVSPIKKATKRTPLLRCKQDKKTQ

SEQ ID NO: 15653 - protein, 86 aa, Glycine max
MASSMISSPAVTTVNRAGAGMVAPFTGLKSMAGFPTRNTNSDITCVASNGGRVRWVRVWPPIGEREWESVCSLPNVPDRAVRGDVQ

SEQ ID NO: 15654 - protein, 863 aa, Zea mays
MVGTSPGGGVFCFSSMVSSPRLLFLLLAGASLCCVAAQKTDTLRQGESLSGAATLVSSPEGVFEAGFFAPDPKQPSRQYLGIWYHSISPRTVVWVANRVAPATSASPSLTLTVTGDLRVLDGTAANGTADAPLLWSSNTTSRAGPRGGYSAVLQDTGSLEVRSEDGVLWDSFWHPTDTILSGMRITLQAPGRGPKERMLFTSWASETDPSPGRYALGLDPGNSGQAYIWKDGNVTYWRSGQWNGVNFIGIPWRPLYRSGFTPAIDPVLGNYYTYTATNTSLQRFVVLPNGTDICYMVRKSSQDWELVWYQPSNECEYYATCGPNAKCTASQDGKAKCTCLKGFHPKLQEQWNAGNWSQGCIRSPPLGCETNQSGDGFLPMGNIKWPDFSYWVSTVGDEPGCRTVCLNNCSCGAYVYTATTGCLAWGNELIDMHELQTGAYTLNLKLPASELRGHHPIWKIATIISAIVLFVLAACLLLWWKHGRNIKDAVHGSWRSRHSSTQSQQNSAMLDISQSIRFDDDVEDGKSHELKVYSLDRIRTATSNFSDSNKLGEGGFGPVYMGTLPGGEEVAVKRLCRNSGQGLEEFKNEVILIAKLQHRNLVRLLGCCIPREEKILVYEYMPNKSLDAFLFNPEKQRLLDWKKRFDIIEGIARGLLYLHRDSRLRVVHRDLKASNILLDADMKPKISDFGMARMFGGDQNQFNTNRVVGTFGYMSPEYAMEGIFSVKSDVYGFGVLILEIITGKRAVSFHCHEDSLNIAGYAWRQWNEDNAAELIDPVIRASCSVRQVLRCIHIALLCVQDHADERPDIPTVILMLSNDSSSLPNPRPPTLMLRGREIESSKSSEKDRSHSIGTVTMTQLHGR

SEQ ID NO: 15655 - protein, 429 aa, Bacillus cereus ATCC 14579
MKKFDKSIAAFEEAQDLMPGGVNSPVRAFKSVGMNPLFMERGKGSKVYDIDGNEYIDYVLSWGPLIHGHANDRVVEALKSVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 15656 - protein, 123 aa, Lycium parishii
NYSTTLNHCDHTKTYKKFKDNKEKSDLYKRWPDLTITEFDCLDKQAFWSREYMKHGTCCSDKFDRVQYFALAMALKDKFDLLKSLRNHGINRGYSYTVQKINSTIKAITRGYPNLTCAGPREL

SEQ ID NO: 15657 - protein, 130 aa, Lycium parishii
NKSAMLNNCETDDDDDKYKDILDPYKIKQLESLWPDLTSKVGDIKKHQGFWGHEFNKHGTCSVVLYKQDAYFDLAIKLKNKFDLLTTLRSGGIIPGKTCTVKNVEDAIQAVTIKVPNLNCIGDSGGIMEL

SEQ ID NO: 15658 - protein, 175 aa, Triticum aestivum
MAPAVMASSATSVAPFQGLKSTAGLPVSRRSNGASLGSVSNGGRIRRMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 15659 - protein, 318 aa, Kluyveromyces lactis NRRL Y-1140
MWSNGMIRCIGRRWYSLQNSSAVAATAKAVHQLTVKDIMAKYHRRNPISMVTAYDYITASWAQNANSDMILVGDSVAMCSLGYESTTQLSLDEFQYHVGAVCRAPGPAFVVVDMPFGSFERSISDGIGNAFQLLHLNPKVQAVKVECGLSQDDYSLEYIKELVRRGISVIGHIGLTPQRVHSLGGYKAQGGQQSTDAVALYNVSQTLQQIGCFGIVLECIPHKISSVITDKLHIPTIGIGAGPDTSGQVLVQSDVLGMLPGHKPKFVKMFADFKKDAVSALSQYVQEVHDKSFPHIGHHTFKVNDEVYQDFISKIDTE

SEQ ID NO: 15660 - protein, 245 aa, Ralstonia metallidurans CH34
MRQKLVIGNWKMHGSLAANAALLEGIKAAPARAKLAVCAPFPYLAQCQTLLSGSQVAWGAQDVSSEARGAFTGEVAASMLGEFGCGYALVGHSERRTYHGETDAVVAAKALRALEFDIVPVVCVGETLAEREAGQTEAVVGRQLQAVLDALSIEQLGRIVLAYEPVWAIGTGKTATSAQAQEVHAALRARVTAKDAGVAARMAILYGGSVKPDNAAELFSMSDIDGGLIGGASLKADDFLAIGNA

SEQ ID NO: 15661 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTDADPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 15662 - protein, 272 aa, Xylella fastidiosa Ann-1
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATALLRVGAQMIKIEGAGHKLEVISYLVEREIPVCSHLGLTPQSVLRLGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 15663 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSFPFLDLCAMLVCKLFSA

SEQ ID NO: 15664 - protein, 126 aa, Lycium parishii
NQSRRLNDCDPSADFDIIPEGENRTNLDKRWPQLENTKEFALAKQPFWEKEYRKHGTCCKNLYNEAAYFDLAMNLKDKFDLLTILRDQGITPGKYYTVKKVEDAIRTVTHQIPKLNCLDDSLGLEL

SEQ ID NO: 15665 - protein, 792 aa, Aspergillus nidulans FGSC A4
MSTDYEKRLSLDDMALKTGDHIETIGKAAAVDATVAANVDDIPISLYVWMVALSASIAGMLFGYDTGIISAVLVYIKDALGGRYLTSSEKELITSLCSGGAFFGSIFAGNTADRWGRKTALYLGCVLFVVGAVLQAAAYTIAQMAVGRVIVGFGVGSAAMIVPLYVAEIAPSKARGRLVGLNNVSITGGQVIAYAIGAAFASVPHGWRVMVGLGGLPPIVLACLLPFCPESPRHLVYNGRMEEARAVLRKLYRGATDVQIESVLASILAGCEEARAISGNEGGWAKIVRLHTVPSNFRALLCACGLMVLSQISGFNTLMYYSSTIFSLVGFTSPTAVGLVVAGTNLIMTFANMILVDRLGRRRLLLSTVWGMSAGLIAVSVAFSFIHVDVNATEVTPQSVTTPAIVVLIFIIWFVVFYGVSVGNTAWMSADFFPLEVRAMGTMWMTCSSWASNVIVSSTFLSMTNAMTMAGTFGFYAGICGVSYVLIYFFYPEVSGLILEEIKEVFEHGFGVSTYIPTPTMRSRLRVWLQIGRPISGLIDRGVAAFDGGYRKFQPESARCIRAKPSISSKCRPFEVFVYYGYSQLPSVHASQNPDIQNSDVRKIWERRIQLGLLGLQRVTTRIERKDKLMLARLQAVPRLFLEARSKAACPTLGTTSPLTSKAAHVPITRRDYKIILATRQSAEDNGDRHDEKMPWRCERRKRSRFRSVTTRDESNERQITVYFLDYLLYLTTLLQESCWKIVHPAYGLDLKHFDDEAADPRTERHAVFSTGLRVSDDYTTKKWNIGLGSLQ

SEQ ID NO: 15666 - protein, 175 aa, Triticum aestivum
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 15667 - protein, 236 aa, Zea mays
  misc_feature (113)..(113): Xaa can be any naturally occurring amino acid
  misc_feature (202)..(202): Xaa can be any naturally occurring amino acid
  unsure (1)..(236): unsure at all Xaa locations
VAVAKSNFFFFKKKTPSRRTTKKPRTCAATRDASHGLWAGADASHGLWSAAGASSSSSLIFLGTGCSGALPDARCLIQPSEPPGTVCSTALSLPPDRNPNYRHSFVATHVWVXGNTSLLVDYCHDDGTHRYILIDVGKTFREQVLRWFVHHEVPSIDSVILTHEHADAVLGLDDLWVALPSCQRNGSAKVPVFLTQFTMDSXAARFPNLVEQKLQGGDDFARPAHLDWTKIEGDVC

SEQ ID NO: 15668 - protein, 128 aa, Lycium parishii
NKSRRLNFCRRGTKYIKSTDEGRKIALEYRWPNLTTTEAESKKEQIFWENEYIKHGTCCLPLYDQNAYFNLAVDLKDKFDLLDILATHGIRPGATHLTSQKIADAIRSVTQGIPNISCYDDLQGKSEL

SEQ ID NO: 15669 - protein, 380 aa, Glycine max
MAATVSSAWSKPGAWALDSEEHEAELLQQNNNNPNDKPLADFPSLAAAAATKPKKKKAQTYSLAEFTAKPDSAFADQDPVVLPTGPRQRTAEELDRTRLGGGFRNYGDRPNRNNSSGGDESSNSRWGSSRVSDEPRRNGFGARDSNRELPPSRADETDNWAAAKKPSGGFERRERDKGGFFDSQSRADESDSWVSNKSFVPSEGRRFGSNGGGFERERRVVGFGSSGGADSDNWNTKKGESNVGSESVGGRPKLVLQPRTVSVSDEGVDGNNAGKPKGVNPFGEARPREQVLAEKGQDWKKIDEQLESVKIKEASGGDGFGKRGFGSSNGGGGRATLPESRTERSWRKPQFDDDRPKSAEKVEDEPDQKKEVEDEHVEKN

SEQ ID NO: 15670 - protein, 248 aa, Brassica rapa subsp. pekinensis
MSSKLIQPPPMAASREAISRRTGNAKMLLPFINLNGKTLSFSDNPFRLRPMCIGKVTEQSSASSPNEQQVEEEEEEDITVSQIKEELYEALQGINRGVFGVKSDKKAEIEGLVKLLECRNPTPEPTGELDKIGGCWKLIYSTITVLGSKRTKLGLRDFVSLGDLLQEIDIAQGKTVHVLKFDVRGLNLHDGEFRIVANFKIISKTSVEITYESSTIMPDQLMNIFKKNMNLLLGIFNPEGLFEISYPF

SEQ ID NO: 15671 - protein, 558 aa, Shigella flexneri 2a str. 301
MHHATPLITTIVGGLVLAFILGMLANKLRISPLVGYLLAGVLAGPFTPGFVADTKLAPELAELGVILLMFGVGLHFSLKDLMAVKSIAIPGAIAQIAVATLLGMALSAVLGWSLMTGIVFGLCLSTASTVVLLRALEERQLIDSQRGQIAIGWLIVEDLVMVLTLVLLPAVAGMMEQGDVGFATLAVDMGITIGKVIAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLILIQQPLAVLATLAIILFGKSVAALFLVRLFGHSQRTALTIAASLAQIGEFAFILAGLGMALNLLPQAGQNLVLAGAILSIMLNPVLFALLEKYLAKTETLEEQTLEEAIEEEKQIPVDICNHALLVGYGRVGSLLGEKLLASDIPLVVIETSRTRVDELRERGVRAVLGNAANEEIMQLAHLECAKWLILTIPNGYEAGEIVASARAKNPDIEIIARAHYDDEVTYITERGANQVVMGEREIARTMLELLETPPAGEVVTG

SEQ ID NO: 15672 - protein, 548 aa, Arabidopsis thaliana
MANSDSGDKDAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSVPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 15673 - protein, 429 aa, Picrophilus torridus DSM 9790
MDYDDVMLKTIGLKDKMDLFKDIPESLRIDIDLGPEIGEMELIKQFYEISKMNKKPEHFFLGNGIYRRYIPSLVDEIISRYEFLTSYTPYQPEISQGILQALFEYQSLICDLTGMDVTNSSMYDGFTALAEAVRMAYRINGRSEVLIPENLYKSKRSVINNYIHGLGIKLIEYKFNNGLIDLEDLNNKIGSNTCAIIGEIPNSYGILDKNVFEIKDIKKDSILISYYDPVSLGIIKPPGEYDADIAVAEGQQLGIHMNYGGPLLGLFSFKKDYIHKSPGRLIGESNDVNGRRAFVMTLQAREQHIRRARATSNICSNQALLAIAASVYLSVNGASGLYNIAMKTIENSEKLRRSMKSIGIEPVFNQRSFSDNLFNVKIKDFDEKLKNNDIAGGIKYRDLTGSGEDTWRFFSVTEMNDDNDFNALLKLGD

SEQ ID NO: 15674 - protein, 279 aa, Glycine max
MWKWLFSREPAPPPPPVVLVPPLFDFPPLAARNRMLHSSYDVVFGKLALTSLFEDYFHQARNFTTRIMLKPIEDPHVDLIATVSGPLDHKPKDSIAGDALFRWQSDVNDPHTFMDLYVSTSNPILQMRSCAYYPKYGFGAFGVFPLLLKKRESSQDYGLMGLRYGSGNLSFGVTLLPFAMKDELPKSAWLVSKMGRLTAGVQYEPQQGNAKLSNLMNWSCAMGYGVGSGSPLCPSFNFNLELVKSSQFIASFYQHMVVQRRVKNPLEENSVVGITNYID

SEQ ID NO: 15675 - protein, 318 aa, Streptococcus agalactiae A909
MDKKKILVTGIVPKEGLRKLMDRFDVTYSEDRPFSRDYVLEHLSEYDGWLLMGQKGDKEMIDAGENLQIISLNAVGFDHVDTAYAKEKGIVVSNSPQAVRVPTAEMTFALILAASKRLAFYDSIVRSGEWIDPSEQRYQGLTLQGSTLGIYGMGRIGLTVANFAKAFGMTVVYNDVYRLPEDKEKELGVTYLEFDQLIETADVITIHAPALPSTIHKFNKDVFAKMKSRSYLINAARGPIVSEEALIEALKEGEIAGAGLDVFENEPQVSEGLRSLDNVIMSPHAGTGTIEGRRTLAEEAADNIIAFFDGKPQNIVNK

SEQ ID NO: 15676 - protein, 270 aa, Bacillus anthracis str. A2012
MKEQGEPITMLTAYDYPSAKLAEEAEVDMILVGDSLGMVVLGYDSTVPVTVEDMIHHTKAVRRGAKETFIVTDMPFMSYHVSLQDTMVNARRIVQESGAHALKVEGAGEVISTIHYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVAEVKTRQFPEEKHSFTMKEEECLALYGGKQS

SEQ ID NO: 15677 - protein, 257 aa, Aspergillus oryzae
MYIERWQKQHGKRLDHDERVRKRQAREAHQQSKDAQNLRGLRAKLYQQKRHAEKIQMRKRIKAQEEKNVKSSAPDEPSKTPLPQYLLDRSQATNAKALSSAIKDKRKEQAAKFAVPLPKVKGISEEEMFKVVNTGKKTHKKSWKRMITKPTFVGNDFTRVNPKRERFIRPMGLRYKKANVTHPELGVTVQLPIISVKKNPQNPLYTSLGVLTKGTIVEVNVSELGLVTTSGRVVWGKYAQISNNPENDGCVNAVLLV

SEQ ID NO: 15678 - protein, 1851 aa, Yarrowia lipolytica CLIB122
MALTPDANTDMKRNEAKKHDISGPLPDSASIRSSTAGKLQSVTQGLGLRKLSKQNSVRSLGSDTSSIYSHNDPDGGNLHTIPTNSSAFSSLAYDSISQKSNKPIHVPYLPAAGDNASGSGFVPQNISAPIPPLPQQQHHGSLHSLPNMLKTGHRRKSSMSSHDTSSTEAESTLSGGSRPPSINSARESSISLARMDLEHPPDEATIHQLYMQLMNKRDFKNLPEEARRQMISYPTDKKWTLIVQDHLADHQKGRLRQSHHTPHLPTPSQSNNSHSPEFYVRKILDNTITSKQLGNLWVSLRTEPVDWVRDFIDAQGQVALAAWLQQINSRTNNSEGFLDREYDIVRCLKALLNLRDGADHAVRTSKCVAPIVRSLVSPRLSTRKLVTDVLTFLAHWDAPKGHDQVLAGLSQLKQHLNEVSRFDAWFSVVEQTLAGRGKFGSLVGASDDLRSGGVSIESLLMEYSLATMFLINILIQGVEDIRVRVHLRSQMKACGLPRIAARMQALNYDLLTEQLQKYDEQAALDFEDLVALDRQANVGDMTDPVAIAEEIWSRVEHTQGEGHFVSIMQHLLLIREDPREDGARMLQLVDAVVTHLVMDRIMPDVDFRSVVNFSVQSLLGKLHTDDQARRAILEAKEALRDVEIAEAEKMRMEEQLQQGSDGVISKLHQTLEEMEHNARISRRQNDALRSELEDAREQSLVKLQEQELEIRELYMMLKEREVAAADTSMVSTEGGKSQGIIDRQRMLQRLEQQVHQKTAEYGSLSVGRNQVEPSPRLRELRDRMEALQLQARELESYDFDEDEFDTEEPDASTPALTKEDLYARRLEKLERLKKLQEASGELALSFNAADVSKQDLYERRLQQVERLRRLQEASGDVALAMNDPGIQLSAEEIELIERHRRGEKQQQGQPQAATATLVEIRKPKAVAGDGSGGGDGIGSGSGTGSGNGTGNGPDAATMPSIHDRPSALPFANELVAKFKGGKGGDGHGDIDSADEDAGDSSVTRVKKETKTEPEDVVIEIDDEPEAKKEKENAHSPVKFTGGPPPPPPPPPPPMFTGGPPPMFTGGPPPPPPPPPPGFTGGPPPPGFTGGPPPPGFTGGPPPPPPPPPLPPGFTGGPPPPAPAFVAGATPSPSPSPQLPSGFETPIGRPKRKLKQMHWEKLENVEHTFWAQLSSGDVEADLYKKGIFDEVERIFAAKEAKKMIGKRGAKEGDFEKLSVIARDLSQQIGINFHTFNDLGVPEIVSELMSVSRRVRNPVLLEFLLKDEVLEIPNSVTRQLTPYSTRFEDGEVREPEKNVEDLERNDQIYLQTVFDLQHYWRQRTRAILMTCTFEKEYSDLVTKLTSVDAACETLKNSEMLRRIFLIILSVGNYMNDANKQATGFKLATLQRLIFTKDEKNTITFLHYVEQLVRNSFPEVDSFIDELAPVCAIERLSVEHLQNDCRDYMQNISNIQTSLDVGALSDPKRLHPRDRIITHMHLHMDSARRKRNFLQDHLQTTLAEFSQIMRFFGEDPGDMQSQSTFFGKFVAFVKEYRKAKDENLHREEENRIYEARKQRALASRKAAEDAAAAAAESGENLVMDDLLERLRKSSHGARSARRRAAARKNQDASSKLYQENLIEDADDYDKSIIIEGDTTEIREGSPNADADTTEVQPARDDEADTEAPAVAPSSRTSTRLSVDVSRGDVPEGVSTPRTPHETEDAHTPDRAVPEVAVTTPNDDDDDDVGTRAQNLLQALRSGGASPRGHRSTGSVGSMSQGRLAEMRARKANRLRNKMSIGSDSDLGPHLSPSATNRSPSAAEKIKVEEDIEAERRDSAEPETEIESSEEPDSPTPRRPGTASSQSSRYTNDEE

SEQ ID NO: 15679 - protein, 304 aa, Aspergillus oryzae
MPLEAKEIELKAKALTKAATQNEPAANIVSLLKELQQGVKATEDLLRSTRVGIIVNKFKQHKSPEVSRLSSEIVSRWRNEVNKQKASGSPAPSQRSSNSPRPAQNGTASPAGTTPTDKASKLSVAPDKRTWKADGVDINQTGNKIRDSCIGLMYDGLCLNSTEAPRNVLSKASAVEAAAYKSLGPETKEQYRTKIRSLFQNLKNKSNPSLRIRVLSNDVTPDQFVRMSHDELRSDEQREKDAKIQKENMDKAMVAQAERSISTSLQCGKCGQRKVTYTEAQTRSADEPMTLFCTCLNCGKSWKQ

SEQ ID NO: 15680 - protein, 215 aa, Xanthomonas oryzae pv. oryzae KACC10331
MSEAKRLAAEKAIDYVEDGMIVGVGTGSTVAYFIDALGHIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDVVLTDNGNVVLDVHNLQITDPVALERSLNQIPGVVCVGLFARRPADVVIVGGEPPRVL

SEQ ID NO: 15681 - protein, 222 aa, Phanerochaete chrysosporium
TLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEGGMWVKMREAQAMGQVA

SEQ ID NO: 15682 - protein, 392 aa, Phytophthora infestans
MSLKKIKNFSINFGPQHPAAHGVLRLILELNGEVVQKADSHIGLLHRGTEKLIEYKNYLQALPYFDRLDYVSMMCQEHAYVLAIEKLLNCDIPLRAQYIRVLFSEITRILNHLLAVCCHALDVGAMTPYFWGFEEREKLMEFYERVSGARMHAAYFRPGGVNQDLPKGLLNDIYIFCDQFNTRLDEIEEMLTNNRIWKQRLVDIGIVSAKDALNLGFSGVMLRGSGISWDLRKTQPYEIYDQLDFDIPVGTNGDCYDRYLIRIEEMRQSIRIILQILNKIPNGPIKLDDKKITNPNRIQIKNSMESLIHHFKYYSENISINSGETYTVIEAPKGEYGVYLVSDGTNKPYRCKIKSPGFLHLQALDFLAKNHMIADVVTIIGTLDVVFGEIDR

SEQ ID NO: 15683 - protein, 460 aa, Vibrio cholerae
MKICPVVLSGGVGSRLWPLSREHFPKQCLILTDLLSSLLQQTLVRTIHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPMRAETGYGYIKAGQDSCVEKFVEKPDLATAQSYLESGDYLWNSGMFLFQASQYLAELTQHRPAMYAAVESAYGNRTEDLDFIRIGTEAFTACPSESIDYAIMEPTQNAKVVPYNGDWSDIGAWDALHDYCEKDSNHIVLVGDVMAESTTNSLVRAESRLVATVGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFS

SEQ ID NO: 15684 - protein, 468 aa, Photorhabdus luminescens subsp. laumondii TTO1
MAENIHTSLSTKTGETQLQRNLSNRHIQLIAIGGAIGTGLFMGSGKTISLAGPSIIFVYMIIGFMLFFVMRAMGELLLSNLNYKSFSDFSADLLGPWAGFFVGWTYWFCWVITGIADVVAITSYISYWQPDFPQWITSLLCVSLLLSLNLATVKLFGEMEFWFAMIKIVAIIALIATGAVLIGMHFQSPAGHTASLANIWNDGGFFPKGLSGFFAGFQIAIFAFVGIELVGTAAAETKDPMKSLPRAINAIPIRIITFYVLALIIIMSVTPWRSIIADKSPFVELFVLIGLPAAASIVNFVVLTSAASSANSGVFSTSRMLFGLAKEGDAPQQFSRLSRRSVPASGLIFTCLCLSCGVVLIYLIPDVMHVFTLVTTVSAILFMFIWSMILCSYLVYRKRRPALHKASTYKMPLGIIMSWVCLTFFAFVLILLTLRDDTRQALIITPVWFLILIIGFQIVKKRRTRLYS

SEQ ID NO: 15685 - protein, 265 aa, Salinibacter ruber DSM 13855
MPLPLAADTRDRLSTDRFGRSMRGFETVGSTNERAAQWAAAGAPEGATVLTEYQTTGRGRHGRDWTADKGRNLLFSVVLRPTLPPDRFGLLTVAAGVAVAEAIEDFVSPHSAALKWPNDVLLEGRKACGILLESSLAPPNTDAVVVLGVGLNVNQTDFPDALADTATSLRLASGRPVPRPPLLARLLRALERRYDAVQHNGAGSVRGAFRERLAALGSSLSLRLPGTDETLSGTVQGITETGALRLRTADGVEKTVHAGEVTTRR

SEQ ID NO: 15686 - protein, 130 aa, Lycium parishii
NNSAMLNNCVVVNPPLRYIKFSDPRKVTELDKRWPQLKYPNFYGTDRQPLWRHEFLKHGSCGINRYKQPAYFDLAMNLKDKFDLLSTLRNHGITPGSTYQLDDIEKAVMTVSIKVPSLKCIEKPPGNVEL

SEQ ID NO: 15687 - protein, 393 aa, Lotus japonicus
MNVPATRKDLMIVNMGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFREREFIYDLFEAATGMRMMHNFFRIGGVAADLPHGWIDKCFDFCNYFFTRVVEYQKLITRNPIFLERVEGVGVVGGEEVINWGLSGPMLRASGIQWDLRQVDNYECYEEFDWEVQWQKEGDSLARYLVRIGEMMESIKIIQQALEGIPGGPYENLEIRCFGREKEPEWNDFEYRFIGKKPSPTFELPKQELYVRVEAPKGELGIFLIGDQNGFPWRWKIRPPGFINLQILPQLVKRMKLADIMTILGSIDIIMGEVDR

SEQ ID NO: 15688 - protein, 129 aa, Lycium parishii
NNSVMINNCVVKPPLRYNKITDARKISELDKRWPQLKYEINFGRNKQYLWKNEFLKHGSCSIKRYQQPAYFDLAMNLKDKFDLLSTLRNHRITPGSTYQLDDIEKAIKTVSIKVPSLRCVEKNPGNVEL

SEQ ID NO: 15689 - protein, 454 aa, Zea mays
MEMEPILLLCLSLLAHGAEPACREARFTGTVLPLMRVQQLVLPPTTHSPPPNRLRFRHDVSLTVPVAVGAPPQNVTMVLDTGSELSWLRCNGSRVPSTPPPQAPAAFNGSASSTYAAAHCSSPECQWRGRDLPVPPFCAGPPSNSCRVSLSYADASSADGILAADTFLLGGAPPVRALFGCVTSYSSATATNSSDSEAATGLLGMNRGSLSFVTQTATLRFAYCIAPGDGPGLLVLGGDGAALAPQLNYTPLIQISRPLPYFDRVAYSVQLEGIRVGAALLPIPKSVLAPDHTGAGQTMVDSGTQFTFLLADAYAPLKGEFLNQTSALLAPLGESDFVFQGAFDACFRASEARVAAASQMLPEVGLVLRGAEVAVGGEKLLYRVPGERRGEGGAEAVWCLTFGNSDMAGMSAYVIGHHHQQNVWVEYDLQNGRVGFAPARCDLATATQRLRARA

SEQ ID NO: 15690 - protein, 129 aa, Lycium parishii
NNSVMINNCVVKPPLRYNKITDARKISELDKRWPQLKYEINCGRNKQYLWKNEFLKHGSCSIKRYQQPAYFDLAMNLKDKFDLLSTLRNHRITPGSTYQLDDIEKAIKTVSIKVPSLKCVEKNPGNVEL

SEQ ID NO: 15691 - protein, 461 aa, Aspergillus nidulans FGSC A4
MAATQAANLVEKAVGHSGTATVTTDISNYNNEHGVETGEKIRATVWQGKNSVGIVEMPKPRVVDAGDVIVRVTGSTVCGSDLHLYHDYLSDRAHAGVIPQLQKGDVLGHECCGVIESVGPESTKYKPGQRVVVSFPIACGTCKRCKAQLYSQCENTNENTITNAMYGKRTAGIFGYSHFTGGFAGGQAEYLRVPYGDVNLLPIPDDVPDEKALFLSDVISTSWHCVVDTGVNKGDIVAVWGAGPIGQMAVDFAFYHGAERVILIDGGDGAWRLEYVKSKLPKVEVIDFTNLPKGESVSSHLRKITDHNLDVCLECVGGEYAKGWIHFFEQMVGAETDTSEIVNEMITAVRPFGRVGLTGVYAGYTNHFNIGSLMQTGVRLIGNGQAPVQKYWGDLMNLIQKGDIDPLRMVSHRFRLEDIDKVYSLFNERNGGVQKVYLETRHSAPAAKEGPQLTNWHMIFI

SEQ ID NO: 15692 - protein, 801 aa, Aspergillus oryzae
MQHIIKRTNTEKSIPLKLLGRASYEAEAGGTDGPPEQGPIRGDAALHRKPSKEKKKGVSFLSRIIGGKKKDQILDDDDDDVSEPDTARMDTAQQIGFFPRFPRPPKYIRVRAHYKKEKTFSRIFVAQELEGADNVSNSSEKDGSSVAGARSSKTTGKAVWALVFSNDGKYLAAAGQDGKVRVWAVITSPEERHESEPEEDGSQDGEELPQLKAPVFKVKPVQVYEGHTGSVLDLSWSKNNFLLSSSMDKTVRLWHVSRPECLCIFQHSDFVTSIQFHPRDDRFFLAGSLDTKLRLWSIPDKSVAFVVTVPDMITSVAFTPDGRHSIAGCLNGMCNIYETDGLKPITQFHVRSARGRNAKGSKITGIDTAIFPKGDPQGEVKLLITSNDSRIRMYNFRDRTLEAKFRGNENTCSQIRASFSDDGKHVICGSEDRRAYLWPTAPIERDSDKRAVEVVEPQSAMVTAAIMAPSKTKQILGFSEDPIYDLCNPPPVTLGSSKENGPHRNSVASKQAQESPGYLARSNHPGGNIIIVADYSGKIKVLRQDCAYLKRRFESWDTHSTISRRLLRRTNSARHSIASSIGKESSHKTPSERIISWRNSVIGHTERKDGNHPGTRTRSPSPQRLANRSQYSSPRRGGSRSGYTISPPPSAYKTSTEYKTSLDSAGSSTEVPGRNGAANAPKTLQPAPSLVANKRQDQDNPLWLQGDHSYAFYKRIARDALAARNRDSPHHLDPNRLSVPGRRQPSVGSVLSSDYASSNGEGEESEDVLRCDNCEGTNFRATKGRNGKQKLICVRCSQPID

SEQ ID NO: 15693 - protein, 261 aa, Candidatus Kuenenia stuttgartiensis
MNSDNQKKRPIILGNWKMNKSLKEGVQYARSLKAAIAGKTWIMCGICPPYVFLKDICAILEGSTICVSAQNMHSEASGAFTGEIAAPMLKEVGCSHVLVGHSERRHIFGEDDFFINDKIKKAISFELVPILCIGETLEEREAGNTKDIVLRQLKNGLRGVGIELIKCIIIAYEPVWAIGTGRTASPEQANEVHSFIRTILSEDYGKDIAKKLSIIYGGSVKADNTEALIHQPEIDGLLVGGASLELESFLTIIEVVQGVDF

SEQ ID NO: 15694 - protein, 538 aa, Xanthomonas campestris
MSQTPWWRGAVIYQIYPRSFLDSNGDGVGDLPGIIAKLDYISGLGVDAIWISPFFKSPMADFGYDISDYRAVDPLFGSLADFDRLLEKAHGLGLKVMIDQVLSHTSIAHAWFQESRQDRSNPKADWYVWADPREDGTPPNNWLSLFGGVAWQWEPRREQYYLHNFLVDQPDLNFHNAEVQQATLDNVRFWLDRGVDGFRLDAINFCFHDAQLRDNPAKPADKRVGRGFSADNPYAYQYHYFNNTQPENLPFLERLRGLLDSYPGAVSLGEISSEDSLATTAEYTAQGRLHMGYSFELLVQDYSAAYIRDTVSRLEATMLEGWPCWAISNHDVVRAVTRWGGAQATPAFARMVVALLCSLRGSICLYQGEELGLSEAEVAFEDLQDPYGITFWPTFKGRDGCRTPMPWTDAPSAGFTSGKPWLPLAASHRAAAVSVQQDDAHSVLRAVRAFLAWRKEMPALREGSIAFYDTAEPVLMFRREHAGQVVLLAFNLSADPAELALPAGEWEQIDVPGVELGAMDGGHLRLAGHAVVAAVGRG

SEQ ID NO: 15695 - protein, 534 aa, Aspergillus oryzae
MKGWLQTFCLTALLAGRALANEVELTQDEAHRQRCSGMYSRKAWGGDVDPFILTKFVRDGDAGDSDPLVSLVIFEWSDEALIGRTVSDDADEKETICDEKSVNDKLCEPGDIGSFILAPNASESEFTIVTQAVHLNNPAAINYPVKKTGFYCVSTYGYSGRDYKAVVEFRNAYGELPAAQIAKLPFYGGLTIVYALIGVFWAFLYVQNRHDILPVQNYITAILVFLIVEQLMTWGFYDYQNRHGLNVGAKVLMVIVAVLNAGRNAFSFFLLLIVCMGYGVVKPSLGRAMIYVRILAIGHFIFAVIYAVASLSITPDSAGPLVLLIVLPLAGTLTAFYVWTLNSLNATMKDLIDRKQKVKALMYKKLWWCILGSIIVIFGFFFINSIAFAGRSEASFVPEHWKSRWFVLDGWLNLVYLFDIGFVAYLWRPTANNRRFAMSDEIAQDDDGFEIRSFNSELDEEDALGGIPESSAHEQRRDLSPVPPKPVPAAPRQRESLDGETIFAVGEDGDKWSDDEDDLSRDSGERKRLTGKDA

SEQ ID NO: 15696 - protein, 251 aa, Thellungiella halophila
MLAVFEKTVANSPEALQSPHSSVPAYALKEGYLANQFVSKNPNSVTLNLGSSGLLAYSLDNHDPLVPRLFAVVDDIFCIFQGHIDNLPFLRQQYGLSKITNEAIMVIEAYRTLRDRGPYPVDKVVRDFHGKFSFILFDGTKSTVFAASDADGSVPFFWGTDAEGHLVLADDTEMVKKGCSKSYSPFPKGCFFTSSGGLRSYEHPKNELKPVPRVDSSGDVCGATFKVDAETKREPTKMPRVDSSQNWAGHI

SEQ ID NO: 15697 - protein, 337 aa, Oryza sativa
MAASDVHHGGATPAAAATAVPCVTLNSGHAMPVLGFGTGSSTPPADLAATIAHAVRLGYRHLDTAAVYGTEGAVGAAVAEAVRCGAVASRGELFVTTKLSMADAHPPRVVAALRESLSRLGLDYVDLFLIHWPVAIGKKDAAGELTWDDLSRGLVPFDMEGVWRGMEECHRLGLARSIGVSNFSAAKMSRLLALAAAPPAVNQVEMNVGWRQEKVREVCGEGGVVVAAYSPLGAHGAHWGSDAVMNSGVLHGVAAARCKTIAQVALRWLYEQGVCMVARSFNEGRMKQNMDIFDWELSDQDKAMIAGVPQRRACHGNYFVSPDGPYKSLHDLWDGEI

SEQ ID NO: 15698 - protein, 229 aa, Listeria monocytogenes str. 1/2a F6854
MKLVLIRHGQSEWNKLNLFTGWHDVDLSQEGVVEAMTAGKRIKEAGLEFDVAFTSVLTRAIKTLNYVLEESDQMWVPVHKSWRLNERHYGALQGLNKQETAEKYGADQVQKWRRSYDTLPPLLEENDERQAKNDRRYQLLDTHAIPSGENLKVTLERVIPYWMDTIAPEIKEGRRVVIAAHGNSLRALVKFLEGISDDEIMDLEIPTGVPLVYELNDDLKPVNKYYLDK

SEQ ID NO: 15699 - protein, 418 aa, Blastopirellula marina DSM 3645
MTVSFKHPCWHQRNEAVMEMAPTSGIVEIDVRTDEMLVNMGPQHPSTHGVLRLVLRTDGEVVSEATPHIGYLHRCAEKIGENLTPRQWIPYTDRMDYLAGMNMNLGWALAVEKLIDYDLPEKARHLRVIIAELNRIASHLVGMGTYGLDLGSFSPFLYAFRERERILDLLEDACGARLTYSYLTPGGATADLPPGWLQKLTGFLDQFEPVILDYHALLTNNAIFIKRTANIGVMSAEMAIDYGCSGPVLRGSGVDYDLRRDGEERYTSLYAGYAFEVIVEKNGSYPRDHEYPPVPSDAVLGDCWHRFYVRMLEVIQAIDLLRQGIEKYSQATGDWGTPIKLATKLPKGEAYLETECPRGQMGFYIVSDGSGSIPLRARARSSCFCNLSVAPELCRDCLIADVPAIIGSLDIVMGEIDR

SEQ ID NO: 15700 - protein, 248 aa, Bacteroides fragilis NCTC 9343
MKKIVLLRHGESAWNKENRFTGWTDVDLTEKGIAEACKAGELLKENGFNFDKAYTSYLKRAVKTLNCVLDRMDQDWIPVEKSWRLNEKHYGDLQGLNKSETAAKYGDEQVLIWRRSYDIAPNALSEDDPRNPRFENRYQEVPDAELPRTESLKDTIERIMPYWKCIIFPNLKTADEILVVAHGNSLRGIIKHLKHISDEEIVKLNLPTAVPYVFEFSDELNLEKDYFLGDPEEIRKLMEAVANQGKKK

SEQ ID NO: 15701 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDTTQVINEVEEVKKEYPDAYVRIIGFDNMRQVQCVSFIAFKPPGCEESGKA

SEQ ID NO: 15702 - protein, 184 aa, Arabidopsis thaliana
  misc_feature (106)..(106): Xaa can be any naturally occurring amino acid
  misc_feature (114)..(114): Xaa can be any naturally occurring amino acid
  misc_feature (138)..(138): Xaa can be any naturally occurring amino acid
  misc_feature (153)..(153): Xaa can be any naturally occurring amino acid
  unsure (1)..(184): unsure at all Xaa locations
MASSMLSSATYWLPLRAQATMVAPFNGLKSSAAFPATRKANNDITSITSNGGRVNCMQVWPPIGKKKFETLSYLPDLTDSELAKEVDYLIRNKWIPCVEFELEHGXFVYREHGXTPPGYYDGRYWTMWKLPLFGCTDXPVKVLKEVEKCKKEXPNAFIRIIGFGNPRQVQGLSFIAYKPPSFPG

SEQ ID NO: 15703 - protein, 379 aa, Oryza sativa
MGAEAEHRMSPSPAPAPAPPTPVGRTDGDAPPMVLGLQLSALIDHVARVDWSLLNRIPGDRGGSQQVCIEELNHILAEVNAQILPCRDDLSSIRTIAGGSVANTIRGLSAGFGISTGIIGACGDDSQGVLFVSNMSFSGVDLTRLRTKKGHTAQCACLVDASGNRTMRPCLSSAVKLQANEFKKEDFKGSKWLVVRYARQNMEQILEAIRIAKQEGLSVSLDLASFEMVRDYRTQLIDLLETGNIDLCFANEDEARELLGGELTFDPEEALAFLAKYCKWAVVTLASKGCIAKHGKQVVQVAATGESNAVDATGAGDLFASGFLYGLVKGLALEECCKVGACSGGSVVRALGGEVRPENWQWMYKQMNASGLLLPDLKN

SEQ ID NO: 15704 - protein, 429 aa, Staphylococcus aureus subsp. aureus MRSA252
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHSNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 15705 - protein, 401 aa, Ustilago maydis 521
MSRVTQSRQQTEANAKILRALVKSADNKVCVDCKKNDPRWASWNLGCFLCIRCSGIHRSMGTHISKVKSIDLDIWTPEQMDSVQKWGNRRCNLYWEAHLKAGHVPADHKIESFIRSKYESRRWAKDGPPPSDPSVLDGGAEAAPSAVAAASTSSLAAARSAASANSASAAKKPVPAIDLLDDPSPSPAPAAPAAPVAPVASTTKQPSAAAATAPTKASVGGGGGIFELDWHEPSASTPATSATTSATTSATTSATTSATTSSSAKDKNDIMSLFAAKPAAASSAPALRVSGNTGFGEFASLASPSIGSAGAGAATGIAGLNSSFGSLDLSSSATRASNSAAFVGTGSNPWSSNTTPSHPPSKNGAGALFDTQDVWGSARTSATLPSKPKDDAFADIWGDFK

SEQ ID NO: 15706 - protein, 469 aa, marine gamma proteobacterium HTCC2207
MLQPVIIAGGSGTRLWPLSRQLYPKQFLPLVGKQTMLQATLARLKGLNCAAPIVVCNEDHRFIAAEKLRIAGSEHNGIILEPCGRNTAPAICLAALLAKDIDQDATLLVLPAHHHMDNPQAFLAAVGAAEKAAISGALITFGIRPSHPATGYGYIKSTEPLIADQPQKIGEFIEKPDLEKAEDLLASGDYLWNSGIFLFRGDAFLTELQKLRPDIYTACQRSWQTNTVDMDFVRPDTNLFSACPAESIDYAVMEKTTNAMVMPMDPQWNDLGSWSSLLDMLPKNDQGNVAIGDTIGIESRNNYVHAEHKLVATLGINDLVIVDTKDALLVAHKDHVEKIKQLVDILKVEQRSEYIHHREVYRPWGKYDSMDQGSRFQVKRITIKPDAKLSVQMHHHRAEHWVVVSGTAKVSIDNVERLICENESIYIPIGAVHSLENPGKIPIELIEIQSGTYLGEDDIVRFEDLYGRV

SEQ ID NO: 15707 - protein, 199 aa, Triticum aestivum
  misc_feature (10)..(10): Xaa can be any naturally occurring amino acid
  misc_feature (33)..(33): Xaa can be any naturally occurring amino acid
  misc_feature (52)..(52): Xaa can be any naturally occurring amino acid
  misc_feature (71)..(71): Xaa can be any naturally occurring amino acid
  misc_feature (79)..(79): Xaa can be any naturally occurring amino acid
  unsure (1)..(199): unsure at all Xaa locations
DKETSSVPNXAPQMTYLVRCTMMLRDIYTELLXDRFVNVSTETSDDDTERIXDLLCTVYARAPYRESVTQXSPLFERIXRLTARHTVRYRSILCSMRDDTTTDFRRRVLLCEMRAARLVYTSADEMSRDALKLESHHISERSLFDCERASAPTTSTGHFKCGRCGHSTTTYYHMQSRSAGETISTFVTCVTCTTHWKFC

SEQ ID NO: 15708 - protein, 390 aa, Zea mays
MASSNVSTVYISVIDDVISKVREDFITYGVGDAVLNELQALWEMKMLHCGAISGNIDRTKVAAASVGGTTGTTPPVHDLNVPYEATSEEYATPTADMLFPPTPLQTPIQTPLPGTDTAMYNIPTGPSDYAPSPISDVRNGMAINGADPTAGHPSPYMPPPSPWMNQRPLGVDVNVAYVEGREDPDRGVQPQPLTQDFLMMSSGKRKRDEYPGQLPSGSFVPQQDGSADQIVEFVVSKENANQLWSSIGNKLETPTKTITPVIPQRDGIQDNYNDQFFFPGVPTEDYNTPGESAEYRAPTPAVGTPKQRNDAGDDDNDDDDDEPPLNEDDDEELDDLEQGEDEPNTQHLVLAQFDKVSRTKNRWKCTLKDGIMHLNGRDVLFNKATGEFDF

SEQ ID NO: 15709 - protein, 321 aa, Zea mays
  misc_feature (161)..(161): Xaa can be any naturally occurring amino acid
  unsure (1)..(321): unsure at all Xaa locations
MGKIKIGINGFGRIGRLVARVALQSEDVELVAVNDPFITTDYMTYMFKYDTVHGQWKHSDIALKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAXTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 15710 - protein, 273 aa, Rubrivivax gelatinosus PM1
MNHLSSPIAFIGGGNMASALIGGLLRSGVHAHEVLVVEPWAEQRERLKQAFGIVATEQATPALADAGLVVWAVKPQIFREAAAPCAPHVGEAAQLSVMAGIRTDAIVAATGNRCVVRAMPNTPALIGQGIAGLYARPEVDAGQRSSVEALLAPTGATLWVDREADLDAVTALSGSGPAYVFLFIEALMDAARDMGLTPEQGRALALGTFSGATALAAQSAEPPSVLRERVTSRGGTTHAALVAMQADGVPAAIVRAVRAAQRRAVELGDEFGG

SEQ ID NO: 15711 - protein, 354 aa, Nostoc punctiforme PCC 73102
MNTLLFPVILAGGKGERFWPLSRKDRPKQFLSLDGSSRSLLQATADRLIKLGDGWDSLWVITSSQIAEGVRQQLPDLPVENLLIESEGRDTAAAVAWTSLEIKQRYGEDAVIGFFPADHWIADEEAFAHTLSAATQLAASTAAIVTLGIKPTFPSTGYGYIEQGEKIGSFNELPAYHVNRFTEKPNRETAETFLSTGRFSWNSGMFVFRAGVVLEELHTHAPEIIEPLEQQGLDIYPQLPKKSIDYALMEKTTLAYVLPVDFGWDDLGDWNAIERLLKTEENPNVELATHVGLDTQGAIIYASNPEDVVVTIGLEDVVIVRDRNVTLVVKKERTQEIKQILKILQSDSRFTDLL

SEQ ID NO: 15712 - protein, 324 aa, Glycine max
IRLEAWSAVGAAWRECFPLQGHDVARWFPGHMAKGLKKMQSSLKLVDCVIEVHDARIPFSGRNPLFQELLGLKPHLLVLNKMDLADLTEQQKIVQHLEEKGLRNVIFTNCIKDENIKQIIPKVTELIGCSYRYHRAENPEYCIMVVGVPNVGKSSLINSLRRQHLRTGKAARVGGEPGITRAVTSRIQVCERPLMFLLDTPGVLAPRIQSVETGLKLALCGTVLDHLVGEETMADYLLYTLNRHGLFGYVQHYALASASDHIEWVLKNVAIKLGKTRKVKVLTGTGNVNVIQPDYAIAARDFLRTFRSGRLGQVMLDRDIIPAC

SEQ ID NO: 15713 - protein, 453 aa, Synechococcus elongatus PCC 7942
MRRLSASLAGDARLVCEEIALVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 15714 - protein, 345 aa, Glycine max
  misc_feature (123)..(123): Xaa can be any naturally occurring amino acid
  unsure (1)..(345): unsure at all Xaa locations
MEISLGKLAFDIDFHPSDNLVAAGLITGHLHLYRYSPHTVPVRLLEVHAHTESCRAARFINGGRALLTGSPDCSILAIDVETGSTIARVDNAHESAVNRLINLTESTVASGDDDGCIKLFFIXVWDTRERSCCNSFNVHEDYISDITFASDAMKLLATSGDGTLSVCNLRRNTVQARSEFSEDELLSVVLMKNGRKVVCGSQTGIILLYSWGCFKDCSDRFTDLSSNSIDAMLKLDEDRIITGSENGIINLVGILPNRVIQPIAEHSEYPVECLAFSHDRKFLGSIAHDQMLKLWDLDNILPGSRNTQTNESGVIDSDDDEMDVDGNKRKNGHAVGGSNNFFADL

SEQ ID NO: 15715 - protein, 105 aa, Piromyces sp. E2
ERVALAYNLIVKGEGKQATDLVEAVQQSYDEDVTDEFIKPIHNADVEGNLEDGDAVIFFNFRNDRAKELTICFTQRDIPEQNLKTIPNLHYCTMTPYDPTFKGLH

SEQ ID NO: 15716 - protein, 129 aa, Lycium parishii
NNSVMLNNCVGYPAVRYIKFRDPRKISELDKRWPQLKYENNFGRNKQYLWKNEFLKHGSCSIKRYQQPAYFDLAMNLKDKFDLLSTLRNHGITPGSTYQLGDIEKAIKTVSIKVPSLKCVEKHPGNVEL

SEQ ID NO: 15717 - protein, 638 aa, Haloarcula marismortui ATCC 43049
MSTVDKQLEDVKATIDEEVPRRISVSDVTYEGPELVIYTRDPKEFAANSDLVRRLASKLRKRITVRPDPDVLAPPAEAEEAIRELIPEEAGVMDLNFHADTGEVVVQAQKPGVVIGRRGSTLREITQEVGWTPEVVRTPPIESSTVENVRNFLKQEREDRRDILERVGRQIHREPMSDDEYVRITTLGCCREVGRAAFILSTPDTRILIDCGNKPGANGEQPYLDIPEAFGAGTNGIDAVVLTHAHLDHSALVPLLFEYGYDGPIYCTEPTRDLMGLLTLDHLDTAADDGRTPPYDSEMVREAIKHTIPLEYGDVTDIAPDIKLTLHNAGHILGSSVCHFHVGDGLYNVAFSGDIHYDDTRLFDGAVNDFPRVETLVLESTYGGRNDYQTDQEDSERKLKQIIQNAYDRNGKVLIPTFAVGRSQELMLVLEEAMRNGDIPEMPVHLDGMIWEATAVHTTYPEYLRDGLQDRIFDEDKNPFLADRFNPIDGGDEEREEIADGDSCIILSTSGMLTGGPVMSWLDQLGPDPDSTLTFVDYQAEGTLGKRIQRGIDEVPVSGSGRNEKVPLEMTVETVDGFSGHADRQGLENFVKTMNPRPEKILCVHGDESATQDLSSSLYHDQNIRTFAPENLETFRFR

SEQ ID NO: 15718 - protein, 536 aa, Oryza sativa
MDRVLLSSQLSSQTVVNTRVQQGSGGINSIGFAVIRKGSLKLRCYAIGGLGGGENLNDPLKESNNGPVLQGFNGSSASFRTVGAKITQETGDFFVSDAEGDPDKPTDGFSSIDEAIGALHEGKFVIAVDDESGDNEGDLVMAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 15719 - protein, 582 aa, Arabidopsis thaliana
MVKRSKKSKSKRVTLKQKHKVLKKVKEHHKKKAKDAKKLGLHRKPRVEKDPGIPNDWPFKEQELKALEVRRARALEEIEQKKEARKERAKKRKLGLVDDEDTKTEGETIEDLPKVVNVRDNSERAFYKELVKVIELSDVILEVLDARDPLGTRCTDMERMVMQAGPNKHLVLLLNKIDLVPREAAEKWLMYLREEFPAVAFKCSTQEQRSNLGWKSSKASKPSNMLQTSDCLGADTLIKLLKNYSRSHELKKSITVGIIGLPNVGKSSLINSLKRAHVVNVGATPGLTRSLQEVHLDKNVKLLDCPGVVMLKSSGNDASIALRNCKRIEKLDDPVSPVKEILKLCPKDMLVTLYKIPSFEAVDDFLYKVATVRGKLKKGGLVDIDAAARIVLHDWNEGKIPYYTMPPKRDQGGHAESKIVTELAKDFNIDEVYSGESSFIGSLKTVNEFNPVIIPSNGPLNFDETMIEDESKTQTEEEAEHESDDDESMGGEEEEEAGKTKEKSETGRQNVKLYAAESMLNTKKQKAEKKKRKKAKKAGADEEDLMDGDYDFKVDYRKNKDGEDEEFQIDAKIPMAGLLPEE

SEQ ID NO: 15720 - protein, 194 aa, Arabidopsis thaliana
  misc_feature (59)..(59): Xaa can be any naturally occurring amino acid
  misc_feature (91)..(91): Xaa can be any naturally occurring amino acid
  misc_feature (106)..(106): Xaa can be any naturally occurring amino acid
  misc_feature (150)..(150): Xaa can be any naturally occurring amino acid
  misc_feature (159)..(159): Xaa can be any naturally occurring amino acid
  unsure (1)..(194): unsure at all Xaa locations
FRNNGFLYALFRYYGCLSGSGALMVAPFNGLKSSAAFPATRKANNDITSITSNGGRVNXCMQVWPPIGKKKFETLSYLPDLTGFRIWLKEXVDYLYPATSGIPLCXNSEFEHGIFCTREQRVTFTRDTYDWTGTWTMWEASLCSGCTDFXKVFKEVEEXKKGYPQAFLRIIGFGNPRQVQGLSFIAYKPPSFPG

SEQ ID NO: 15721 - protein, 337 aa, Yersinia pseudotuberculosis IP 32953
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVAAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 15722 - protein, 255 aa, Glycine max
MASMGSLKMISSLKLSRSSCSISPLQTQKQVGSSLFQSFPTKTLKFSATPQVSTSRRSTNKTTTTAFFFNNQKQHQDSSQPAKVQELFVYEINERDRGSPAYLRLSQKPVNSLGDLVPFSNKIYSGDLQKRLGITAGLCVLIQHEPEKKGDRYEAIYSFYFGNYGHISVQGAYLTFQDTYLAVTGGSGIFEGASGQVKLHQLVFPFKLFYTFYLKGVPDLPPELLGKPVEPSPSVEPSPAAMATEPHACLPNFTN

SEQ ID NO: 15723 - protein, 447 aa, Haloarcula marismortui ATCC 43049
MSNSNSHATGSPYAPQTAAETAAMLDVVGADDLESLFDVPESVAFDGEFGIDARSERATRREVAGLLSRNADLTEFLGRGHYDHYVPSVVDDLASRSEFLTSYTQYQPEVAQGFLQALFEFQSMLVELTGLDVANCSMYDDATALGEAATLSQRVRSVSGDRILVPEHLREGKRAVLSNYAEGPDLTVESYPMTDGVADVPALADEIGDDTAMVYAESPTVRGVIEERLGAIGDLAHDHDALFCLGSDPIALSLLERPANVGADVVVGDAASLGTGTAYGFGLGMFVTREEYLRQVPGRLVGASEDAADRRAYTLTLQTREQHIRKERATSNICTNQAWVALRTAMHAAWLGPDGLVDLAEDCVTRARDLADRLDDIVGVTAPIHGRHHFREFLAHTDQPASAIVADLAADGFAVHAVDDHLVQVCVTETTTDATDEFVAAFREVAK

SEQ ID NO: 15724 - protein, 478 aa, Mycobacterium avium subsp. paratuberculosis K-10
MTETTPDDVFKLAKDEKVEFVDVRFCDLPGIMQHFTIPVSFFDESVFEDGLAFDGSSIRGFQSIHESDMLLLPDPATAQIDLFREAKTLNLNFFVHDPFTLEPYSRDPRNIARKAENYLISTGVADTAYFGAEAEFYIFDSVSFDSRTNGSFYEIDAISGWWNTGSPNELDGSPNRGYKVRPKGGYFPVAPVDHYVDLRDQMLSNLIKAGFSLEKGHHEVGTGGQAEINYKFNTLLHAADDMMLYKYIVKNTAWQNGKTVTFMPKPLFGDNGSGMHTHQSLWKDGSPLMYDETGYAGLSDTARHYIGGLLHHAPSLLAFTNPTTNSYKRLVPGFEAPINLVYSQRNRSACVRIPITGTNPKAKRLEFRCPDSSGNPYLAFSAMLMAGLDGIKNKIEPQAPVDKDLYELPPEEAANIPQAPTQLSAVIDRLEEDHEYLTEGGVFTPDLIETWISFKRETEILPVQVRPHPYEFALYYDV

SEQ ID NO: 15725 - protein, 100 aa, Cryptococcus neoformans var. neoformans JEC21
MSSFAKQIPKAVKEIRLHFCQTSAASAGVRQFVQSSYPAVKSANPDLKFLIREASNISPRAFVRFERGVESEAQLANLSEPDVGKVLTHLVNQQSGAGVA

SEQ ID NO: 15726 - protein, 515 aa, Yarrowia lipolytica
MIYTANSSPSTNLQWLSTLNTDDIPTKNYRKSSIIGTIGPNTNSAEMISKLRQAGLNIVRMNFSHGSYEYHQSVIENARESEQQFQGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLGHTNTLRVLECV

SEQ ID NO: 15727 - protein, 472 aa, Mycobacterium avium subsp. paratuberculosis K-10
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 15728 - protein, 446 aa, Mycobacterium avium subsp. paratuberculosis K-10
MDRQKEFVLRTLEERDIRFVRLWFTDVLGFLKSVAIAPAELEGAFEEGIGFDGSSIEGFSRVSESDTVANPDPSTFQVLPWASPNGHHHSARMFCDITMPDGSPSWADPRHVLRRQLQKANDLGFSCYVHPEIEFFLLKPGPDDGTPPVPVDTAGYFDQAIHDSASNFRRHAIEALEFMGISVEFSHHEGAPGQQEIDLRFADALSMADNVMTFRYVIKEVAIENGARASFMPKPFGQHPGSAMHTHMSLFEGDVNAFHSPDDPLQLSDVGKSFIAGILEHASEISAVTNQWVNSYKRLVGGGEAPTAASWGAANRSALVRVPMYTPHKTSSRRVEVRSPDSACNPYLTFAVLLAAGLRGVEKGYVLGPQAEDNVWDLTPEERIAMGYRELPTSLDSALRAMESSELVAETLGEHVFDFFLRNKRTEWATYRSHVTPYELRTYLSL

SEQ ID NO: 15729 - protein, 256 aa, Synechococcus elongatus PCC 6301
MVCLNLQQQAQQAGIRYRLRTIAVTDSTNAQLWQQADRHEQVLIAAQQRAGRGQQGRSWLSPLGGLYLSLGLDLDLPLSESARLIFGAAWGVAQSLRSQVPVQLKWPNDLVLDDRKLGGILVETRSQGDRLREAVIGLGLNGSNPVPETGIALQSVSTAWADLPDLAIAVLQGLQTGLDQWLADDWETLIPLYDQWLYRRSDRLTWQGQIVTLLGIDPSGGLRLQGRDRPWVIVQPGDLSLWPWQHDPKTDPVTHQ

SEQ ID NO: 15730 - protein, 974 aa, Solanum tuberosum
MATFAVSGLNSISSISSFNNNFRSKNSNILLSRRRILLFSFRRRRRSFSVSSVASDQKQKTKDSSSDEGFTLDVFQPDSTSVLSSIKYHAEFTPSFSPEKFELPKAYYATAESVRDTLIINWNATYEFYEKMNVKQAYYLSMEFLQGRALLNAIGNLGLTGPYADALTKLGYSLEDVARQEPDAALGNGGLGRLASCFLDSMATLNYPAWGYGLRYQYGLFKQLITKDGQEEVAENWLEMGNPWEIVRNDISYPVKFYGKVIEGADGRKEWAGGEDITAVAYDVPIPGYKTKTTINLRLWTTKLAAEAFDLYAFNNGDHAKAYEAQKKAEKICYVLYPGDESLEGKTLRLKQQYTLCSASLQDIIARFEKRSGNAVNWDQFPEKVAVQMNDTHPTLCIPELLRILMDVKGLSWKQAWEITQRTVAYTNHTVLPEALEKWSFTLLGELLPRHVEIIAMIDEELLHTILAEYGTEDLDLLQEKLNQMRILDNVEIPSSVLELLIKAEESAADVEKAADEEQEEEGKDDSKDEETEAVKAETTNEEEETEVKKVEVEDSQAKIKRIFGPHPNKPQVVHMANLCVVSGHAVNGVAEIHSEIVKDEVFNEFYKLWPEKFQNKTNGVTPRRWLSFCNPELSEIITKWTGSDDWLVNTEKLAELRKFADNEELQSEWRKAKGNNKMKIVSLIKEKTGYVVSPDAMFDVQIKRIHEYKRQLLNIFGIVYRYKKMKEMSPEERKEKFVPRVCIFGGKAFATYVQAKRIVKFITDVGETVNHDPEIGDLLKVVFVPDYNVSVAEVLIPGSELSQHISTAGMEASGTSNMKFSMNGCLLIGTLDGANVEIREEVGEDNFFLFGAQAHEIAGLRKERAEGKFVPDPRFEEVKAFIRTGVFGTYNYEELMGSLEGNEGYGRADYFLVGKDFPDYIECQDKVDEAYRDQKKWTKMSILNTAGSFKFSSDRTIHQYARDIWRIEPVELP

SEQ ID NO: 15731 - protein, 371 aa, Aspergillus oryzae
MAARIMVLPQAIQAQPTYGKLQNDTGPNLPDYCSMAAKFIPRQTFPSYTSIPRSYFLGHHRAGLKKMQNMLSSIDYVVECRDYRVPVTSINPMFEEALGKTRRLIVYTKRDLGAESGSSAQQQAEKRIRNFDKNSAVFFVSSSSRPDVSSILKHLRNDAEGPDKLVGCRVMVVGMPNVGKSTLINNLRNQGVHKAKAVQTGGQPGITRKIGTPVKIIERENGSHVYVLDTPGVFMPYVPDAENMLKLALCGCVKDSVISPVTLADYLLYHINLHDTQVYERWSPPTNEIMPLLNDFARHTGLLAKGGIPNTDLAALHFIQKWRAGGLGKFILDDLQAEERHRQEGTKDAVGTSMSQARKAERMARKQPQRL

SEQ ID NO: 15732 - protein, 285 aa, Mycobacterium avium subsp. paratuberculosis K-10
MSEHNVYGAAQPAQPGQPAQPRTRIRTHHLQKMKAEGHKWAMLTAYDYSTARIFDEAGIPVLLVGDSAANVVYGYDTTVPVSIDELIPLVRGVVRGAPHALVVADLPFGSYEAGPAAALAAATRFMKEGGAHAVKLEGGERVAEQIAHLTAAGIPVMAHIGFTPQSVNSLGGFRVQGRGDAAEQTIADAIAVAEAGAFSVVMEMVPAELATQITGKLTIPTIGIGAGPNCDGQVLVWQDMAGMSSGKSARFVKRFADIGGELRRAATQYAHEVAAGVFPADEHCF

SEQ ID NO: 15733 - protein, 569 aa, Xanthomonas oryzae pv. oryzae KACC10331
MHHDTSLIDIIAVGLAVAFILGTLAQKAKLSPLVGYLLAGVCVGPFTPGFVADQTIANQLSELGVMLLMFGVGLHFSLDDLMEVKWIAVPGALAQIVVATLLGWALAWSMSWSLMHGLVFGLALSVASTVVLLRALEERRLLDTQRGRIAVGWLIVEDLVMVLALVLLPALADVLGAGTPAAVHDAQSPSLLAALGVTLLKMVAFVAAMLVIGRRVIPWSLEKVAATGSRELFTLAVLGIALGVAFVSATLFGVSFALGAFFAGMLLKESELSHKAASDSLPLRDAFAVLFFVSVGMLFDPMILVAHPWQVLATFLTITVGKSLAAFVIVRAFGHPTGTALTISTSLAQIGEFSFILAGLGVQLAIMPETGRDLILAGALLSIVANPFLFSWLDRWQATQAAKQAQDAPAAVEPELPPGPPLPADGHAIVIGYGRVGSSLAQLLRSRGVPVLVIDDNGDHVAKAHAAGIPGIRGSAAADRVLTEARPEHAKIAILAIPQPLEAGEALAKLRAINPSLTLLARAHSDAEVKHLLEHGADGAVLAERELAYSLAEMVMSTPPYRALNVPAS

SEQ ID NO: 15734 - protein, 245 aa, Rhodobacter sphaeroides 2.4.1
MRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAALSAA

SEQ ID NO: 15735 - protein, 234 aa, Salinibacter ruber DSM 13855
MSKPDNPRDENPKNPEELRFHYTPTDEPGAEQETENAHAKDTTRVPAVIDALREEFGAAVLDVERYANEDTIYVEKNRIREVCRFLKEEEGFDYFVDLGGIDNFTAEDRYEVFYNLVSTERQKRLRLKVQVDEGDMQVPSVTEVYRAANWNEREAYDMFGFSFVDHPDPRRMYMPEDFDYHPLRKEFPQLGIPGSLPLPPQTPDGDLTMDPFAAAHGSQPVKSYEEPATDPDSE

SEQ ID NO: 15736 - protein, 467 aa, Xylella fastidiosa Ann-1
MNDILPVILSGGSGTRLWPLSREAYPKQFLPLVGHHSMLQATWLRAAPVTTHSPIIVANEEHRFIAAEQLQHLGVYPSAILLEPTGRNTAPAIAVAALEATRTGNDPLLLVLPSDHVIRDETAFQTAVHVAAEAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 15737 - protein, 335 aa, Pleurotus sajor-caju
MVNVGINGFGRIGRIVFRNALEVGGVDVVAINDPFIDLDYMVYMFKYDSVHGRFKGSIEAKDGKLIVEGKPIHIFAEKDPANIPWGSVGADYVVESTGVFTTIDKASAHLKGGEKVVISAPSADAPMFVCGVNLETYDPKYKVISNASSTTNCLTPLAKVIHDKFGIVEGLISTIHATTATQKTVDGPSHKDWRGGRSVNNNIIPSSTGAANWVGKVIPSLNGKLTGLSFRVPTLDVSVVDLVVRLEKPADYKEIVAAIKEASETTHKGILGFTSDSVVSTDFVGSTDSSIFDSTAGIQLNPNFVKLIAWYDNEYGYSRRVVDLLKYVAEKDGAQ

SEQ ID NO: 15738 - protein, 818 aa, Arabidopsis thaliana
MDLKENSFEHMGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 15739 - protein, 228 aa, Malus x domestica
MGITGMIYMVTMVFSLIVLMLSSSAVKFDYFQFTQQYQPAVCNSNPTPCKDPPDKLFTVHGLWPSNVNGSDPKKCKATILNPQTITNLKAQLEIIWPNVLNRRAHVRFWRKQWRKHGACGYPTIADDMHYFSTVIEMYITKKQNVSEILSKAKIKPEGRFRTRDDIVNAISQSIDYKKPKLKCKINNQTTELVEVGLCSDNNLTQFINCPNPFPQGSPYFCPTNNIQY

SEQ ID NO: 15740 - protein, 98 aa, Synechococcus sp. RS9917
MTGCDAGVVPIRVTSPCPESVVIALGARQWPIWGCEVSSFPWHYDQHETCLVIEGEVTVTPDDGEPVHFGAGDLVDFPKGLRCTWTVHKPVRKHYRFT

SEQ ID NO: 15741 - protein, 443 aa, Gloeobacter violaceus PCC 7421
MKAVADRVGSPRPTLGLTDAVALIVGIVVGAGIFETPALVAANTGGPLWTLLAWLLGGGISLIGALCYAELTTAYPHAGGNYYYLLRAFGRDLAFLYAWARLAVVQTGSIALLAFVSGDYASQLWRLGEYSPSIYAALVIALFTALNIAGIRQGARTQNLLAVATVLGLAAVIVGGLLAPAPAQPLAAPAPASTNFGLAMVFVLLTYGGWNEAAYISAELRSVKRNMVRALLVSIGIITALYLLANVAFIHALGTAGMAGSQAVAADLMRRVAGAPGAAFISALIVVCALSSANASIITGGRTNYALGQDFTLFRFLGRWRTGTETPANALAVQGVIALGLVVLGTATRGGFKTMVEYTAPVFWLFFLLTGAALLVLRSRDPQIERPFRVPLYPLTPLLFCLICGYMLQASLAYTGTGALVGVAVLLVGLPLLWIARRTRTDS

SEQ ID NO: 15742 - protein, 226 aa, Oryza sativa
  misc_feature (3)..(3): Xaa can be any naturally occurring amino acid
  misc_feature (12)..(12): Xaa can be any naturally occurring amino acid
  misc_feature (17)..(17): Xaa can be any naturally occurring amino acid
  unsure (1)..(226): unsure at all Xaa locations
TAXEGAKRARGXLVAKXPIEQVPLLQEEIISICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETLTRALDLLQKQGMVKSGEEVALRQSGRQPI

SEQ ID NO: 15743 - protein, 265 aa, Bordetella parapertussis
MSAHQARKRFGQHFLTDESVVESIVRAIGPARDDRVVEIGPGLSALTRPLLDRIDHLTAVEIDRDLAARLRRQYPAERLTVVEADALTVDFAQFGQGLRVVGNLPYNISSPLLFHLMGAAEQVRDQHFMLQREVIDRMVAEPGSGDYSRLSVMLQARYRMEMLFDVAPEAFDPPPRVVSAVVRMAPLPADRLRPASDAAFETVVARAFSQRRKMLRRVLGDWAALTPWDELGIAPTARAEEVGVAQFIGLADALLAAGAPGLARP

SEQ ID NO: 15744 - protein, 378 aa, Dunaliella salina
MAFALRTGVAPSVLPRGQSRRQMVCRAGKFDEELMKTARTIASPGRGILAMDESNATVGKRLDSIGLENSEANRQAYREMLVSTKGLGQYISGAILFEETLYQSGSNGKRMTDMLVENGIVPGIKVDKGLAPLANSNNEQWAMGLDGLDKRCAEYHKAGARFAKWRSVVSIPNGPSPIAVRETAYGLARYAAICQNNGLVPIVEPEILLDGDHDINRCLAVFEDVWAETFKYLADNKVLFEGILLKPSMVTPGAESPARATPQQVAEMTLIGLKRRVPPAVPGIMFLSGGQSELEATLNLQEMNRQPNPWHVSFSYARALQNTVLKTWQGKPENVPKAQEALLKRAKANSDAQRGQYDPATEGSTEAAQSMYQEGYSY

SEQ ID NO: 15745 - protein, 222 aa, Schizosaccharomyces pombe
MSGFLRWFGGNRSKDTTKDTIVRFQEMLALYDKKEEVLERQIAEQTEIARKNATTNKRLALTALKRKKMHENELVKIEGSRNNIEQQLFSIQNANLNFETLQAMRQGAEAMKSIQRGMDADKVDQIMDKIRDQQTISEEISTMISTPVGLNAEIDEDELANELDELQQMELDSKMLGAEKPPVHTPAVPAVPSQVKDLPSISKPQELDEEEELRKLQAEFSL

SEQ ID NO: 15746 - protein, 390 aa, Oenococcus oeni PSU-1
MPELKEGVINSVRSDVRNITTNKIRAVDMEFRKIDGLLRLTLGEPDFNAPELVKKAMIKSIEDNESHYSTARGSIEFLKAAADFLKRNYDLNYDPRTEILSTVGSTEAIFSSLSTILEEGDELLAPSPAYPLYEQLAHVNHTKMVYIPTNDTNFVLTPSKLQNAIEQHPRAKAIVLTYPNNPTGVDYSVEQLKELATVIAKTNLLVVSDEIYSTLNYVGKHVSIASLLPEQTIVLNGVSKSHAMTGDRIGFVAAPRDLISQIVKIHQFAITAVSNPAMAGAVAALNQGDALTEKMRQEYMKRRNYLIPEFKKIGFDVAAPDGAFYLFLKIPADQNQDDFAFARELAHKALVGLIPGSCFGPGGEGYLRLSYAASEETLHEALRRLQNYLA

SEQ ID NO: 15747 - protein, 194 aa, Brassica napus
RYISNIPLLLLQFHKREQWQWEIYLLLLPPPELHVLAVDDSFVDRKVIERLLRISACKVTTVESGTRALQYLGLDGDKGSSGLKDLKVNLIVTDYSMPGLTGYELLKKIKESSAFREIPVVIMSSENIQPRIEQCMTEGAEDFLLKPVKLADVKRLKELIMRGGEAEQEKTSNLIISSPKRILQNNTDSSSSAH

SEQ ID NO: 15748 - protein, 659 aa, Ralstonia solanacearum
MHSPLELTLVLLAAAVIGVVLFRMLQLPPMLAYLVVGVVIGPNATGLESDSAQTRYLAEFGVVFLMFSIGLEFSLAKLRSMRRLVLGLGASQVVLTMLLTVPASLLLSRWYPLSWQASLALGGALAMSSTAIVSKMLAERLQLETEHGRNIISVLLFQDLAVVLLLIVVPSLGKNPTDLVLTLSIAAVKIIVALVLILFLGQKLLSRWFHLVAARRSQELFMLNLLLVTLGMAALTERLGLSMALGAFLAGMLVSETPYRLQVEEDIKPFRDVLLGLFFVTVGMLLDPRVVIGHWGLVIGLVIGPVLFKFALIALLARAFGSGGGTAIRTALGLAQAGEFGFVLLNQIDGMRLIDPLLSQAILAAMLLSMLLAPFLIQYSDAIAMRLSRTDWLMQSLAMTKIAAQSLQTERHVIICGYGRSGQNLAHMLEQEDISYVALDLDPDRVRDAAAAGERVVYGDAARRESLVAAGVHRAAAVAVTYADTASALKVLHHVQALAPTLPVIVRTIDDADLDRLQQAGAAEVVPEIIEGSLMLASHALVLLGVPLRRVVRRAQEMRDARYGLLRGYFHGQDDDEDMLERDAVRLHSVPLIKGSPAIGRPLGTLGLETFKTSVTAIRRQGIRALDPEPNTLLELGDIVVLRGTPDGLQQAEERLSPR

SEQ ID NO: 15749 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 15750 - protein, 839 aa, Candidatus Kuenenia stuttgartiensis
MEKRKELILPYKTLKQSKPVSTLTELPPLGMSAKDIGEEYRRYFSDTLGRDKHCRLLHYSYNALALVLRDRLLERWKKTRYAYHESKCKCTYYLSMEYLPGRTLSNAMVNLGIVDEVSHGMQELGYVLEEVSEAEHDAGLGNGGLGRLAACFLDSCATLQLPVVGYGIRYEYGMFRQCIENGEQVEEPDRWLRYGNPWELERPEYMCRVHFGGRTEFYRGEDGRLFARWVNTQDVLATPYDIAIPGYRNGTVNTLRLWSSSATDEFNLGEFNAGSYPESVAAKSAAEYITMVLYPNDVSENGKVLRLKQQYFLASASLQDVLRHWVRLYGYDFSEFAEKNCFQMNDTHPAIATAELMRLLMDEYRMEWDEAWDITHNVMAYTNHTLLSEALEKWPVRMFRELLPRLLDIIYEINARFISEVARRWPGDIERQMRMSIIGDGNEPYARMAHLAIVCSFSVNGVAALHTKLLTEGLFRDFYELWPEKFNNKTNGVTPRRWLGWANPALSSLITEKIGNGWITDLPQLHLLKNYVNDKEFCLRWREIKMHNKKRLAALIKQGCGIVVDAFALYDVQVKRFHEYKRQLLNILHVVHLYDRVKRGDDANWTPRLILFGGKAASGYFMAKTIIKLINNVAEVINADPKMHEYLKVVFLPNYSVTAMEIIAPGTDLSEQISTAGKEASGTGNMKFMMNGAITIGTLDGANIEIRKEVGDENLFFFGLTAEEVFQLRKNYNPDAIIHTDEDLLRVMQLLTSGHFNQFEYKIFDSIIHSLTSPNDPWMTIADFRSYVNAQKKVAEAYRDQNKWTRMSILNTACSGKFSSDRTIEEYNNEIWKMSPVPV

SEQ ID NO: 15751 - protein, 304 aa, Gigaspora rosea
LVLRAAIEKDTVDVVAINDPFLDLSYMAYLFKHDSTHGRFHGTVDVSSGKLVVSYHGKSTHTITVFTEMKAENIKWGEAGAEYIVESTGVFTTLDKAKAHHMGGAKKVIISAPSADAPMFVMGVNHTSYDPSKHNIVSNASCTTNCLAPVAKVINDNFGIGEGLMTTAHSVTATTQKTGDGPSGKLWRDGRGAFQNIIPASTGAAKADGKVIPALNGKLTGMAFRVPTPDVSVVDLTCRIEKPATYDAIKECVKKASESPEYKGILGYTEEQVVSSDYIGCTISSIFDAGAGISLNPNFVKLIS

SEQ ID NO: 15752 - protein, 1464 aa, Cryptococcus neoformans var. neoformans JEC21
MFTKATSHLRPFIRLPSSHSPASPDHFTANPSLLHHLPQHGTSNSVIVQGQHSAQAGGASGHAGRTGYGGGAGAGGGYTGHARAFLSLPQTASFDPSSTLSDERKKDASSSSSSNTSLLLKHRLSKTPRIVHLNDSVRARRAIEERKGGKDFTVVELEDVPRIHRRDSIAEYTSGRLPLTSTSTRSLSRSHTSFDIFQVGIPQPRSIGLRALSTTSNAPRALEAEDIEAVEELELMTPRAGREVRTIGQPNRVLMDLAGRDLPSTVTAGWQLGGIRRNSTAAVERPSLDLPPADLSSIATHEQKEDKQREEAILQALRQAKQNGNAELVKNLITHYRSPRSLPPFSPDSLPGVPELSKHYPLPSGYSIRIYNACLIAALAIRSPGQSIAPILEIYNELLEKDMIPDSMTYGAVIRALAMRERDVRGSQEIWERQKTWGLWRSEISGNQTWDPEVAAENDANIEAYLAENNVLSAVRLFRAAALTGQAGRFVVSIHGTVLDALSKLEKPDVTVMEQLVEHAESHEVPGIISLYKHLFLAYAKIKDASALSQVWNKYRGLAKTASREDWAAACGQREAYDVRIEGAMREPWDIVISAFIEVGELSKAFEVFGEMAEVAEKKTKAEVPPATHRTCGVLVTALARAGEFDLALEWFNSLQASAIVTQNSPHRLTLEHTIVLAEQLLLKGRWFDAADVVIGLGGIRDELAQPSAQHSLRTVAWKTNFALIHHAARSTPEEAARTLARAQEVLAAVPIQLDLRTVVLHLTLLAQASDYTNMIRVVDLISARKLPANTIQRLNDACDQIAKEDIPFKYRIELIKAFGRHHADLTPFVAEKLIQAYISEKSKPVDERDLSKESLYILLDAFTVVEQKQVNEGEYDEALEQLMQDLAATDVSEDMKNATSNQAIGYLVKNVIFRFGAERARSMLGAVFGEQEATNLVQPVSPTFIQSETVSGSERLSEAASPSQSHASSATSAPALSFSQTLTSSIERFTYRNPTITPLEAYALLRDGLSVSQVPRLEIILSLMDHLARRNDEPKVRELYELAQVVLNSLVRPDVQAQSWYSAENAMLIACCHLGYLEEAGLHRARIVQAGFTPSADAYATMIASSKDTTDDALVARELWEEALGMGVKPHLFLYNTVISKLSKARKAESALDLFMRMKSERIRPSSVTYGAVINACCRVGDALSAETLFEEMTSQPNFRPRVPPYNTMMQFYLQTQPNRERFLYYYGALQRARVPPSAHTYKLLIDAYATLPPIDIPAMELVFAHLIADKSVRVQGTHWASLISAYGIHAGDAKRAKEVFDKIPEKGGDYEAVVWEAWLNVLSQQGTIEQLEEAHTRMLESGVQPTAYVYNVLINGYARAGNIGRAREVFESMGDSITGVAAPNNHPVLLTSSGHAKPSTQAATTGVVYREPSTYESMIRAEITCGDQQRATEVLQRMEERGYPMAVYMRGKAALEGEPPKF

SEQ ID NO: 15753 - protein, 518 aa, Ustilago maydis 521
MNAALSSVRSRAFEAISQLSAGSRSSLPTSSSRSNDKPRRSLDRPRLFKRHGSNVDHIHTQLFDKAVAPPSRSTVLFVLGCLAWYISSSLSSNTSKALLSKGRNHVDSGLPQVRPPAFPYPVTLTLIHFGFVNVCCAICASRRMLGHRALTRLVPPSLSRVAEVGQLAFFNVVGQALSSLAIARVPVSTVHTIKALSPLFTVLSYTYLFNVSYSSKTYMSLFPLTAGVMMACTGFAFNADDMVGFAAALASTLVFVAQNIYSKKLLRKGERSEGEKMDKINILFYSSGCSIVLMIPMALYYDGSSLLFRPSWNASEAYPYDRRTFVLSWLLCNGLVHFAQNILAFNVLSMVSPVTYSIASLLKRVFVIVLAILWFRQSVTRLQWFGIGLTFYGLWMYNDSKTKDDVDKGDKKVERQQGVGNHAILPLTSASTASTASGASGWTDALHNRPHPFAPSTSAYAFAAQQPSAHAAPARLHQPVYPPAPTKGWNDIPDSTLTSYINDPTKSLPSPPDSDKEV

SEQ ID NO: 15754 - protein, 279 aa, Ralstonia metallidurans CH34
MHGSPLARSPSHLHRLSSASAFTPSAVAEGVFLELRPSGHLCHTDDPRRGEGHNPHRHHPDPVHHPVPARPPGGHRGVSGLLNVIATACKVIATAASRGALAGVLGSAEHENVQGEVQKKLDVISNAILVHATERGGHLVALASEEMDTIYPIPAAFPRGKYLLVFDPLDGSSNIDANISVGAIFSVLRSPDPEVPPTLEHFLQAGAGQVCAGYALYGPATMLVLTTGQGTHGFTLDRDVGEFILTHPMLRIPAATQEFAINTSRGLLVFSAISDGTQS

SEQ ID NO: 15755 - protein, 616 aa, Thermoplasma acidophilum
MIDIEIGGDAPFFRKIKVHLGKIDASTAYVEGTFNCQGEGSIVLEGNSESTDEVDGLVPDKYEFRIALDQYRFLRNSQSRSNMFQVSLWLDAVYHDPDLSQFSCILDDRLMDIRIAVPKQVVSVRILTESEVKVVYSRRSSQATYDIVEFVISGVSGYAFEVDQVRYPDHGYYRSTKRINSEGNSKIMYHIFPDRFHRYGEDRPGLIKWGEKPSRDSFFGGNLEGIRQKIQYIKDLRVDHIYLNPLFKSKSNHRYDVDDYYSIDELLGTDQDLKNLVSDAHASGIKIVLDMVFNHTSTDFPAFRDVIEKGRNSPYYRWYIFHRDEFTVFRGRGKRGSYPSYETFMGYGGMPKLDHRNPEVRRYCINVLKYYVQKFDVDGFRYDVAHSIYSKFFEEVFSEIGTGILHIGEAWCLPTYLVNGSAWQSYTNYFLGGSIIDFLKGSITLGEFYDRVQRMLIVNGIEKQQAMMNVLDSHDTPRILRILNGDRKKVKLAYSILYLFDGIATIYYGDEVGLDGGKDPDDRRCFPWDSMDEDMHSFFMNLGDLREKYSLGSAGVITVFEDEASFVIEKVKAGRSISVHMAKNGRMKFPKDSLIAVRENQKEVKPWDFYIYLRTV

SEQ ID NO: 15756 - protein, 209 aa, Bacillus cereus G9241
MKRVGKEFFLQHDIVIMYSILFVFIIILKMQFFTWFGLLACLFGIIFYTLNEYMTHRFLFHLKPPKNVFLLKMLRRLHYDHHVYPDDLKLLFLPVWFSIPSFTIYLLISYAITKSVTITLSFGIGMIIMLLVYEWKHYIAHKPIRPVTKFGRWLKKQHILHHYKNEKFWFGVSNPVFDFIFGTLKDGKDVELSETARNLEKEKKTEVVR

SEQ ID NO: 15757 - protein, 279 aa, Thermoplasma acidophilum
MIKIPQAGRDLETIAVIGAGTIGSAISISLAKAGYHVISTRRRPDLNAGLKAYGITVTSDNVQAVTSADMVILTLKPADLVSEMKKLSQILEGKIVVSMAAAVPIRVIRHILPRSFIVRSMTNIAAEVNAGYTPFCTLEEDEGKISFVSRVLGVFGETERVDEKYMDALTALSGSGPAYILTIIEAMMYGGLKVGLPRSIALKASYQTVMGSAKLLAMSGDHPSAIKEKVITPGGVTIDGIYELENGKIRTSIMKAIESSTLKARKISKDLFPEESDKN

SEQ ID NO: 15758 - protein, 467 aa, Thiomicrospira crunogena XCL-2
MINIILCGGSGTRLWPLSRTMLPKQFVRLFDGYSLFQDTVIRNQSVCRHSFVISNTEQYFLAVDQLSQVSSQPSRFLLEPVGRNTAPAIALACLALDEDDLVFVTTSDHLVKDQGAYENAVIKAKSLAEQGNLVTFGIQPTYPETGFGYIEASGNDVLSFKEKPSAKLARSYLEAGNYYWNSGMFCFKAGVFLAELQKHSPEIYEASLRAMRSVKEECASQDDKVIKIDLDAMQSIPEDSIDYAVMEKSDIVKVVPCDMGWSDLGSFDALYDEVKDDSNENAVLSRLDKSPLPICIDSKNNLLVTRDRQLALVDVEDLLVVDTSDAILISKKGSSQKVKQVVSMIKKQSPELAEIHRLAHRPWGTYEVLIDSEQYKVKRIVVKPGSKLSLQKHFHRNEHWIVVSGTASVTVDKETFLVRANESTYIQMGQVHRLENEGKIDLVMIEVQVGEYTGEDDIVRIEDVYGR

SEQ ID NO: 15759 - protein, 342 aa, Zea mays
MAASEGVLLGMGNPLLDISAVVDDAFLAKYDIKLNNAILAEEKHLPMYDELASNSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAATNNKVFLMNLSAPFICEFFCDAQEKVLPYADFIFGNETEAKIFAKVRGWETENVEEIALKISQLPLASGKQKRTAVITQGADPVVVAEDGKVKTFPVILLPKEKLVDTNGAGDAFVGGFLSRLVQGKSIEDCVTAGCYAANVIIQRPGCTYPEKPDFN

SEQ ID NO: 15760 - protein, 309 aa, Synechococcus sp. RS9917
MGWSAADIPDQRGRLALVTGANSGLGLETTRALLAHGATVLMACRNRERGETARRSLSDQSASKGGSIELLDLDLADLESVDRCAQTVRQRFGRLDLLINNAGVMAPPRQCSRQGYELQFATNHLSHMALTRALLPLMEGQPDARVVTVTSGAQYFGRIAWEDPNGEQRYDRWQAYGQSKLANVMFALELDRKLRDRGSSIRSLAAHPGLARTNLQPASVSANGSRLEALAYRLMDPLFQSAAMGALPQLHAATAASAQSGEHYGPNRLGGLRGYPKRQRVAPAAEDPQQRERLWDLSLKLIEAGPALR

SEQ ID NO: 15761 - protein, 333 aa, Methylobacillus flagellatus KT
MTIKVGINGFGRIGRMAFRAAIKDFTDIEVVAINDLLEPDYLAYMLKYDSVHGRFDGDVSVSGGNLVVNGKTIRLTAERDPANLKWDEVDVDVVVECTGFFLTEETCQKHIDAGAKKVVQSAPSKDDTPMFVYGVNHDTYKGQSIVSAASCTTNGLAPVAKVLQDSFGIKRGLMTTVHAATATQKTVDGPSNKDWRGGRGILENIIPSSTGAAKAVGKVIPELNKKLTGMAFRIPTSDVSVVDLTVELNKETTYEQIVAAMKAASESGPLKGVLGFTDEKVVSTDFRGNAYPSIFDADAGIQLDPTFVKVVAWYDNEYGYTCNMLRLVRHIAS

SEQ ID NO: 15762 - protein, 484 aa, Aspergillus oryzae
MSNNHEDADGIPRKADHLCVLIHGFWGNPSHMDHLAVSLRQRYSEDRLHLLVTERNIGNLTYDGTEVGGERVAHEIEETLNTLADKGCPIRKLSIVGYSFGGLLARYAIGLLDARGWFDKLEPVNFTTFASPHVGVRIPRKGVWGYIWNNVGPRQGSVSAQQLFLVDSFGDSGRPLLSIMADPDSIFVRALAKFKNRSLYGNVVNDRTTIFYTTMLSMVDPFRDLGDAQVNYVKGYEPVVIDPDMYFLPAAELKESLPFGSRVWGQITRLFTTALFWAVVVLFLSIVLPLFFLHSISQWSHSRERVRLHEEGESATLFREYRLPHVMVKEMQSAVEEAYEDVGFHQDPDYLSTTSKSSPADSIRRRNSPGLKAKEAAEHKPSSSSITIQEASSPTPEHDQPNSTREAATDDAISKKRRAYPMLALSPAQIAIIESLNSVGFRKYPVYIHNHRHSHAAIIVRAPKPGFDEGKVVIRHWLDTEFQI

SEQ ID NO: 15763 - protein, 465 aa, Vibrio cholerae O139
MKICPVVLSGGVGSRLWPLSREHFPKQCLNLTDLLSSLLQQTLVRTNHLNVQSPLVVCNDDHRFLIAQQLQDMGVKGAKVMLEPVGRNTAPAVALAAFEVLQSDNEDVLMLVLPADHVIRDTAAFEKAIAQAKVLAEAGGLVTFGITPMRAETGYGYIKAGQDSCVEKFVEKPDLATAQSYLESGDYLWNSGMFLFQASQYLAELKQHRPAMYAAVESAYGNRTEDLDFIRIGTEAFTACPSESIDYAIMEPTQNAKVVPYNGDWSDIGAWDALHDYCEKDSNHNVLVGDVMAESTTNSLVRAESRLVATVGVNNLVVIETADAVLIMDKDQSQDVKKIVSRIKAEGRQEHMHHTTVHRPWGTYQTVDLGDRHQVKRIMVKPGEKLSVQMHHHRAEHWVVVSGTAKVQNGEREILLTENESTYIPVGVVHALENPGKIPLELIEVQSGSYLGEDDIVRFSDRYGR

SEQ ID NO: 15764 - protein, 365 aa, Ralstonia metallidurans CH34
MPLSHRQTLTRYLIEERRRFPEASGELNALILDVALACKALARVVSFGELGDALSDGSAAPTGGGINVQGEVQKPLDVQSNEMFIRMNEWNGQLAGMASEEMEEPYLIPSSYPRGKYLLVFDPLDGSSNIDVNVSIGSIFSILRAPADVVASGRDVTEADFLQPGAAQVAAGYTIYGPTTQLVLTVGNGVAAFTLDPNLGEFLLTRSDIRVPEQTQEFAINSSNSRFWEPPVKRYVDECLAGKTGPRGKDFNMRWVASMVAEAHRILMRGGVFMYPRDTKDPAKPGRLRLLYEANPVAMLMEQAGGRASTGREPILGVSPTALHQRIGLIFGSKDEVERIERYHQEPASNEAAAPLFAERSLFRD

SEQ ID NO: 15765 - protein, 429 aa, Listeria monocytogenes str. 1/2a F6854
MQNYSKSEKAFKEAKKVLPGGVNSPVRAFNSVDASPVFMDHGKGAYITDVDGNEYIDYVLSWGPLILGHADPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAKLAFEKYGEEIAAVIVEPVAGNMGVVPPIEGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTENEIDKTLEAFDTTCKILRG

SEQ ID NO: 15766 - protein, 316 aa, Bacillus licheniformis ATCC 14580
MKVVCTSPSFAKYSDDPVLFLEKKGMSLERLPADITEEQFIEAAEGADAAIVAFNQITPYVLDRLPSLKIVCKHGVGVDNIDLHAAKERNVWVTNAPNANKHAVADFVFGLMLSAARQIPAADRETKLGKWPRIFGSDVYGKTLGIVGLGMIGKEVAKRAQGFNMTVLAYDVFPDRAFAADHHIHFTELDQLLKECDFITLHMPLTAETENMIGEKELAAMKETAYLINASRGGIVSECALYDALASGGIAGAALDVYQTEPLKQHPLFELDRFIAVPHIAGYTRDAVQNLGMICVKNIASVLIDKQKPEFVVNGL

SEQ ID NO: 15767 - protein, 335 aa, Ralstonia metallidurans CH34
MTIRIGINGFGRIGRMVFRAAVQDFKNDIEVVAINDLLEPDYLAYMLRYDSVHGRFKGEVVVDGGTLVVNGRKIRLTAVKDPAALAWGDVGVDVVVESTGLFLTHDTCQKHLDAGARKVIQSAPSKDDTPMFVYGVNHTQYAGEKIVSNASCTTNCLAPVAKVLNDSFGIKRGMMTTVHAATATQKTVDGPSNKDWRGGRGILENIIPSSTGAAKAMGRVIPALNNKLTGMALRVPTSDVSVVDLTVELAQETSYEKICAAMKAASQGAMKGVLGYTQDKVVSTDFRGEACTAVFDAEAGIMLDSTFVKVVAWYDNEWGYSSKVLEMVRVMGASR

SEQ ID NO: 15768 - protein, 217 aa, Mesorhizobium loti MAFF303099
MADITAGMSVLDVGSGVGGPARFLAATYGCRVTGVDLSEPFVDAARYLTERTGQGGQLSFQTVSALELPFEDGHFDIALLQHVAMNIFDRGRLYREIRRVLKSGGRFATFDVVLRDGQPHYPLPWARTPATSFLLTVDATREAIEPAGFRMLAWQDDTETAKAWFAQLRASGPPPSPNLGVVMGPDFAELTANLGRNLMQGRLGILTAVFEAASTNS

SEQ ID NO: 15769 - protein, 124 aa, Brassica napus
MTSGTRTPTWKERENNKRRERRRRAIAAKIFAGLRIHGNFKLPKHCDNNEVLKALCNEAGWTVEEDGTTYRKGCKPMDRMELMNGSTSASPCSSYQPSPRGSYNPSPSSSSFPSPTNIFGDANS

SEQ ID NO: 15770 - protein, 446 aa, Zea mays
MDRQKEFVLRTLEERDIRFVRLWFTDVLGYLKSVAIAPAELEGAFAEGIGFDGSSIEGFSRVSEADTIAKPDPSTFQVLPWTTSQGKHHSARMFCDIAMPDGTPSWADSRHVLRRQLNKAADQGFTCYVHPEIEFFLMKDAPTDGTPPTPADGGGYFDQVVHGSAPNFRRHAIDALESMGISVEFSHHEGAPGQQEIDLRYADALSMADNVMTFRYIVKEVAIGEGVWATFMPKPLSDHAGSAMHTHMSLFEGDTNAFHNPDDPMQLSDTGKQFIAGILQHAPEISAVTNQWVNSYKRLIHGGEAPTAATWGGANRSALIRLPLYTPNKASSRRIEVRSPDSACNPYLTFAVLLAAGLKGIAEKYELPDEAEDDVWALTSAERRTMGYTELPGSLAEALKAMESSELVAEALGEHVFDYFLRNKWTEWNDYRSRVTPFELGRYLSL

SEQ ID NO: 15771 - protein, 559 aa, Wolbachia endosymbiont of Drosophila ananassae
MLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMESNEIFISTTLLIVLGAAFITEQFHLSLALGAFVAGLLVAETEYRHSVEHAVLPFKDLFLGLFFMTVGMSINTELLLNKLPLITLLSIILIVLKTSIIYILCRFFGFKSAPAIQAGLLLSQGGEFAFILFRLADELNVLPSEIAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNYSMLKDLGSDKDE

SEQ ID NO: 15772 - protein, 142 aa, Triticum aestivum
  misc_feature (91)..(91): Xaa can be any naturally occurring amino acid
  misc_feature (99)..(99): Xaa can be any naturally occurring amino acid
  misc_feature (102)..(102): Xaa can be any naturally occurring amino acid
  misc_feature (109)..(109): Xaa can be any naturally occurring amino acid
  misc_feature (114)..(114): Xaa can be any naturally occurring amino acid
  misc_feature (117)..(117): Xaa can be any naturally occurring amino acid
  misc_feature (119)..(119): Xaa can be any naturally occurring amino acid
  misc_feature (121)..(121): Xaa can be any naturally occurring amino acid
  misc_feature (123)..(124): Xaa can be any naturally occurring amino acid
  misc_feature (134)..(134): Xaa can be any naturally occurring amino acid
  misc_feature (136)..(136): Xaa can be any naturally occurring amino acid
  unsure (1)..(142): unsure at all Xaa locations
KNAAYIGTPGKGILAADESTGTIGKRFASINVENVEDNRRALRELLFCTPGALQYLSGVILFEETLVPRATRVAKPFLDNPQREGNVLPGXLRVDKGNXELXGNNGETXNQGFXDLXKXCXKXXKVVPRFCKWXGXLKNGPT

SEQ ID NO: 15773 - protein, 474 aa, Escherichia coli
MSSPLIPVILSGGNGTRLWPLSREEYPKQFLKLTDSISMLQSTISRLDSLNTSSPVVICNELHRFIVAEQLRHLNKLDNNIILEPSGRNTAPAICIAALILKMKHPNENPLMLVLPADHSVKKVKTFCNTIKSAIPFAEAGNLVSFGIKPTHPETGYGYIQKGKVLSDSDIYEVSEVRTFVEKPNLKTAESFIEKDEYYWNSGMYLFSVERYLQELSLYRPDIVKVCQETVKNIHYDMDFIRLDDKIFRNCPQESIDYAVMEKTKDAVVATMDIGWNDVGAWSSLWELGKKDSSGNVITGDIVCHETENSYIYTESGLVATIGIQDLVIIHTKDSLLVSRRDSVQNVKNIVQHLDLSGRKEHKEHREVFKSWGRCDSIDSSEKYHYQVKRITVNPSEKLSLQLHHHRAEHWVVVMGIAKLTVAEEIKILKENESVYIPAGIKHSLENIGTIPLVLIEVWTGSYLADDDILRFED

SEQ ID NO: 15774 - protein, 471 aa, Gloeobacter violaceus PCC 7421
MADLQKEGGLDGGLKRTLGPINLISLGVGAIIGAGIFVITGQAAAQYAGPAITISFILAAFACAFAGLCYAEFAALLPISGSAYTYAYATLGELVAWIIGWDLIIEYALSAATVAVGWSGYVVSFLRDFGIVMPPQFTASFGQPVTLADGTTAAGLLNVPAVLIILALSLLLVVGVSESASVNGIIVVVKVAVIVAFLVFGASYIDTANWTPFIPEPVEPGRYGYFGILRAAGVIFFAYIGFDAVSTAAQEAKNPQRDMPIGILGSLVVCTVLYILVALVLTGIVDYRQLGVPDPIAVGVDAIGLGWLTFIVKIGAIAGLTSVMLVTLYGQTRIFYTMSRDGLLPPLFSAIHPRFKTPYLSTMLLGLFVSVVAGLVPLGILGELVSIGTLFAFIVVSAGVLFLRYRQPDLPRPFRCPLVPWVPLASIVACLALMSGLPADTWLRLFAWLGLGLLVYFVYGRVHSKLQSRRA

SEQ ID NO: 15775 - protein, 158 aa, Triticum aestivum
MTEGAAARDPANPSAPPVLCFKGMASPMVATPIRLSSLRYAPPSPAPRGRFVAARVRASAEAMATEKLGVRVERNPAESRLSELGVRQWPKWGCEKSKFPWTYSAKETCYLLQGKVKVYPDGEEGFVEIAAGDLVVFPKGMSCTWDVAEAVDKHYKFE

SEQ ID NO: 15776 - protein, 453 aa, Staphylococcus aureus subsp. aureus MRSA252
MQAIAKNDIKTGTVVDLTHEGHGVVKIDRFPIFIPQALINEQIEYKIIKVKKNFAIGKLLNINTRSENRVAPPCIYYERCGGCQLQHLSYEAQLEMKKEQVINLFQRKAHFDNSKINDTVGMTDPWRYRNKSQIPVGKNEQNEVIMGFYRQRSHDIIDMGSCLIQDSQHQEVMNEVKSILKDLNVSIYQEQLKKGLMRHLVVRTGYHTDEMMVIFVTNGKNWPQKNAVVEKILDAFPNVTSIKQNINDSHSNVIMGRQSITLYGKDTIIDQLTDSTFKISDQSFYQINSEQTEKLYNKAIEYAQLTGNEVVLDTYCGIGTIGLYMAPHAKHVYGVEVVPSAIEDAQQNATINQCNNTTFVCGKAEEVILQWKAQGIKPDVVMVDPPRKGCDETFIQTLLTLEPKRIVYISCNPSTQQRDALLLAEKYQLEEVTPVDMFPQTTHVETVALFNLK

SEQ ID NO: 15777 - protein, 378 aa, Wolbachia endosymbiont of Tunga penetrans
MSDLAKRMSLIKPSPTIAVTDKANRLKSEGKKICVLAAGEPDFDTPGHVKKAAIQAINEGKTKYTAVDGTLELKEAIINKLKKDNSLKYTPSQICVGAGAKQVLFNLFMATVNPGDEAIIPAPYWVSYVDMVSLFGGLPVVVECKQSFKLTPELLKSKITKKTKWLILNSPNNPAGVIYTYDELKGIAQILLEYPHVNVVTDDIYEHIIYDEKFFTIAQVEPKLYDRIFVVNGVSKAYAMTGWRIGYIAGRSDVIKAISTLQSQSTSNPNSIAQAAAVEALNGDHDFLKERTKIFKSRRDFVVEKLNSVPGLSASTPQGAFYLFVSCEGLLGKSTRSGKVINNDLDFAEYLLEDHLVAVVPGIAFGLKNFVRISYATS

SEQ ID NO: 15778 - protein, 269 aa, Micromonospora echinospora
MDTAPANTHVRPRRGHVLVTGGNRGLGLATATLLVDDGWSVLLGCRDERRGAAAAEALRRRGGRAAHVPLEVTSPASIAAAVDLVADRTGGRLAGLVNNAGVFLDERDADLESVTAEAVHELLAVNAVGPLLVTRAMVPLLRAAAGAAVVNVTADDADPATADGEATGYRMSKAALNIMTVNLAVALREQDVVVNAVDPGWIPTDMGGPEAPDDTAAAARLVAWAVTAAREHGTTGQVLSVRQPPDGLRADPVTVGAPPTVVPPHGQPQ

SEQ ID NO: 15779 - protein, 301 aa, Kluyveromyces lactis NRRL Y-1140
MFYFIFVSSFRVKKKAIYSRQNARASDHLLVDNNPSEISSYCVFIMEKEFMNLTGCTYSVAQEYLRKNGGRVEYALNDYYDNVDTIGGMRQSYNPSLVAIFEKYSNGVSATEWDSSGLIRFIEDLGISIEDPITLCLSQMLCIDDLTKPVSREQFLNAWSDLCCDTLRKMKAYLHTLEERLETDKDYFKSIYSYTFPLNTDEGSRHLPKDVAIEYWNIFFKDNKYALKISKERLNSWLEFINSDDSDPRKQNISNDIWLMFYKFIEQYPNDESLKQNYDEMAAWPLLIDEYYEFLEENDKL

SEQ ID NO: 15780 - protein, 524 aa, Helicobacter pylori J99
MYQVAICDPIHAKGIQILEAQKDIVLHDYSKCPKKELLEKLIPMDALITRSMTPITSDFLKPLTHLKSIVRAGVGVDNIDLESCSQKGIVVMNIPTANTIAAVELTMAHLINAVRSFPCANDQIKHQRLWKREDWYGTELKNKKLGIIGFGNIGSRVGIRAKAFEMEVLAYDPYIPSSKATDLGVIYTKNFEDILQCDMITIHTPKNKETINMIGAKEIERMKKGVILINCARGGLYNEDALYEALETKKVRWLGIDVFSKEPGIHNKLLDLPNVYATPHIGANTLESQEEISKQAAQGVMESLRGSSHPHALNLPMQAFDASAKAYLNLAQKLGYFSSQIHKGVCQKIELSLCGEINQFKDALVAFTLVGVLKPVVGDKINYINAPFVAKERGIEIKVSLKESASPYKNMLSLTLNAANGAISVSGTVFEEDILKLTEIDGFHIDIEPKGKMLLFRNTDIPGVIGSVGNAFARHGINIADFRLGRNTQKEALALIIVDEEVSLEVLEELKNIPACLSVHYVVI

SEQ ID NO: 15781 - protein, 423 aa, Corynebacterium diphtheriae
MNNKKETPQAAPAQRKRTRRIFDQSDKLKNVLYEIRGPVTAEAEAMELDGHRILKLNTGNPAIFGFEAPDVIMRDMIASLPTSQGYSTSKGIIPARRAIVTRYEVIPGFPAFDVDDVYIGNGVSELITMTTQALLNNGDEVLIPMPDYPLWTAATSLAGGKPVHYLCDEEDDWNPSIEDIKSKITERTKAIVVINPNNPTGAVYSKEVLQKIVDVAREHDLLILADEIYDRILYDGAVHTNIAALAPDLLCITFNGLSKAYRVAGYRAGWMIVTGPKNNARGFIEGLDLLSGTRLCANVPGQHAIQVALGGRQSIYDLTGQGGRLLEQRNVTWEKLNAIPGVSCVKPMGALYAFPKLDLEYYDIKDDAQLMLDLLRQEKILMVQGTGFNWDKPDHFRVVTLPWASQLSEAMDRLGNFLASYKQ

SEQ ID NO: 15782 - protein, 476 aa, Triticum aestivum
  misc_feature (348)..(348): Xaa can be any naturally occurring amino acid
  unsure (1)..(476): unsure at all Xaa locations
MSGASGPLPAVLLLVLVAAVSASSAGKGESWRAEQERDRVPRVPGQAFNASFAHYAGYVTVSEERGAALFYWFFEAAHDPASKPLVLWLNGGPGCSSIAFGLGEEVGPFHVNADGKGVHMNPYSWNQVANILFIDSPVGVGYSYSNTSADILSNGDERTAKDSLVFLTKWLERFPQYKEREFYLTGESYAGHYVPQLAQAIKRHHEATGDKTINLKGYMVGNALTDDFHDHYGIFQYMWTTGLISDQTYKLLNIFCDFESFVHSSPQCDKILDIASTEAGNIDSYSIFTPTCHSSFASSRNKVVKRLRSVGKLGEQYDPCTEQHSIVYFNLHEVQKALHVNPVIGKSXKWETCSEVINTNWKDCERSVLHIYHELIQYGLRIWMFSGDTDAVIPVTSTRYSIDALKLPTVIPWHAWYDDDGEVGGWTQGYKGLNFVTVRGAGHEVPLHRPKQALTLIKSFLAGSPMPVLSDLRSDM

SEQ ID NO: 15783 - protein, 362 aa, Rhodococcus erythropolis
MPQQVRGVIARSKGAPVEIVPITIPDPGANEVVVAIAACGVCHTDLTYRDGGINDEYPFLLGHEASGIVESVGPGVTHVEVGDFVVLNWRAVCGQCRACKRGRPQYCFDTFNAEQKMTLEDGTELTPALGIGAFADKTLVHEGQCTKVDASADPAVVGLLGCGVMAGMGAAMNTGNVGRGDSVAVIGCGGVGDAAIMGSRLAGANTIIAIDRDPRKLEWATELGATHTINATEVDDVVEAVQELTGGFGADVVVDAVGRPETWKQAFYARDLAGTVVLVGVPTPDMKLEMPLVDFFSRGGALKSSWYGDCLPERDFPVLVDLYQQGRLPLEKFVSERIKLDEVEKAFETMHRGEVLRSVVVL

SEQ ID NO: 15784 - protein, 401 aa, Carboxydothermus hydrogenoformans Z-2901
MGFNTIEEALEDLKQGKMVIVVDDEDRENEGDLVCAAEKVTPEIINFMAKYGRGLICVPMEGKRLDELEIPIMVTQNTDPHHTAFTVSVDAVDTHTGISAAERAKTILKLIDPQARPQDFRRPGHIFPLRAKEGGVLRRAGHTEAAVDLARLAGLYPAGVICEIMRDDGQMARVPDLLEFAQKHNLKIITIASLIQYRRRNEKLVERGAFAMLPTKYGEFVAVAYESLLDHQTHLAVVKGNVADGEPVLVRVHSECLTGDVFGSLRCDCGDQLQTALKMIEKEGRGVLLYMRQEGRGIGLANKIKAYHLQDMGKDTVEANEALGFPADLRDYGIGAQILADLGIKKIRLMTNNPKKIKGLEGYGLEIVERVPIEIPPKKENKKYLLTKKKKLGHLLNLTEN

SEQ ID NO: 15785 - protein, 1066 aa, Fusarium oxysporum
MAESVPIPEPPGYPLIGNLGEFTSNPLSDLNRLADTYGPIFRLRLGAKAPIFVSSNSLINEVCDEKRFKKTLKSVLSQVREGVHDGLFTAFEDEPNWGKAHRILVPAFGPLSIRGMFPEMHDIATQLCMKFARHGPRTPIDTSDNFTRLALDTLALCAMDFRFYSYYKEELHPFIEAMGDFLTESGNRNRRPPFAPNFLYRAANEKFYGDIALMKSVADEVVAARKASPSDRKDLLAAMLNGVDPQTGEKLSDENITNQLITFLIAGHETTSGTLSFAMYQLLKNPEAYSKVQKEVDEVVGRGPVLVEHLTKLPYISAVLRETLRLNSPITAFGLEAIDDTFLGGKYLVKKGEIVTALLSRGHVDPVVYGNDADKFIPERMLDDEFARLNKEYPNCWKPFGNGKRACIGRPFAWQESLLAMVVLFQNFNFTMTDPNYALEIKQTLTIKPDHFYINATLRHGMTPTELEHVLAGNGATSSSTHNIKAAANLDAKAGSGKPMAIFYGSNSGTCEALANRLASDAPSHGFSATTVGPLDQAKQNLPEDRPVVIVTASYEGQPPSNAAHFIKWMEDLDGNDMEKVSYAVFACGHHDWVETFHRIPKLVDSTLEKRGGTRLVPMGSADAATSDMFSDFEAWEDIVLWPGLKEKYKISDEESGGQKGLLVEVSTPRKTSLRQDVEEALVVAEKTLTKSGPAKKHIEIQLPSAMTYKAGDYLAILPLNPKSTVARVFRRFSLAWDSFLKIQSEGPTTLPTNVAISAFDVFSAYVELSQPATKRNILALAEATEDKDTIQELERLAGDAYQAEISPKRVSVLDLLEKFPAVALPISSYLAMLPPMRVRQYSISSSPFADPSKLTLTYSLLDAPSLSGQGRHVGVATNFLSHLTAGDKLHVSVRASSEAFHLPSDAEKTPIICVAAGTGLAPLRGFIQERAAMLAAGRTLAPALLFFGCRNPEIDDLYAEEFERWEKMGAVDVRRAYSRATDKSEGCKYVQDRVYHDRADVFKVWDQGAKVFICGSREIGKAVEDVCVRLAIEKAQQNGRDVTEEMARAWFERSRNERFATDVFD

SEQ ID NO: 15786 - protein, 512 aa, Aspergillus oryzae
MGQSHSKGNSGPGDSLQSYPSFSRSDTKESLRSLRGSIRSKIRNTDSPRASTSALSTGSQTDRSDAGSIKSTGSRRSSTNLSAQSPGANDSASQLDAPDPPPSPTLSSSLKRGHKDVDAMQQSGEVDHVSDAPPTGAAPTGSSQKVGESILIKRQDQLNPILDFIMNTPLNDTSSSPGMGMGALKSIDLDDMITRLLDAGYSTKVTKTVCLKNAEITAICTAARELFLSQPALLELSAPVKIVGDVHGQYTDLIRLFEMCGFPPSSNYLFLGDYVDRGKQSLETILLLLCYKLKYPENFFLLRGNHECANVTRVYGFYDECKRRCNIKIWKTFIDTFNCLPIASIVAGKIFCVHGGLSPSLSHMDDIRGIARPTDVPDYGLLNDLLWSDPADMEEDWEPNERGVSYCFGKKVIMNFLQRHDFDLVCRAHMVVEDGYEFYQDRILVTVFSAPNYCGEFDNWGAIMSVSDELLCSFELLKPLDSTALKNHIKKGRNKRNSMLNSPPAIVSAQSY

SEQ ID NO: 15787 - protein, 302 aa, Hericium erinaceum
MVAVYSIVVLAVASTVYAGWAPPVPGLPNTFPNIAACVDQPLEYSCENTTTLKNTCCSPTPGGLVLQTQFWDTYTGFEKKGQLLPKDSWTIHGLWPDNCDGSFEQYCDLSRQYDPAPDDKTVPAYHGPGVDTFIKKFGRKDLLDFMNKYWVSQGSPSASFWAHEFSKHATCTSTFDVACYGPGYKKHQDVVDFYDAVVRAFHMFPTWTMLAASGITPSNKTTYSLSQFQTALKAQSGAIPYLGCGHNGTVLQEVWYFNHVSGTEQFGRFKPVDSTTKSSCNATGIHYYERSPKSVREVRDEL

SEQ ID NO: 15788 - protein, 335 aa, Carboxydothermus hydrogenoformans Z-2901
MPVKVGINGFGRIGRNMFRAALNNPEIEIVAVNDLTDAKTLAHLLKYDSVHGIFAADVEAKDDAIVVNGKEVKVYAEKDPANLPWKELGVEIVIESTGKFTKKADAVKHLEAGAKKVIISAPATDEDITIVMGVNEDKYDPANHHVISNASCTTNCLAPVAKVLHEKFGIVKGLMTTVHSYTNDQRILDLPHKDLRRARAAATSIIPTTTGAAKAVALVLPELKGKLNGFAMRVPTPNVSVVDLVVELEKPATKEEINAALKEAAEGELKGILGYTELPLVSVDFNGNPLSSIVDGLSTMVIEDNMAKVIAWYDNEWGYSNRLVDLATYIAKKGL

SEQ ID NO: 15789 - protein, 1154 aa, Burkholderia xenovorans LB400
MKRDDPAQTTSQAHSSAATGGVAKARTHRRGKPAALSDDPLWYKDAIIYQVHIKSFFDANNDGVGDFPGLIAKLDYIAELGVNAIWLLPFYPSPRRDDGYDIADYRNVHPDYGNLSDVKRFIQEAHARGIRVITELVINHTSDQHPWFQRARRAKPGSNHRNYYVWSNTDQKYLETRIIFIDSEPSNWTHDPVAGAYYWHRFYSHQPDLNFDNPAVLREVLQVMRFWLDMGIDGLRLDAVPYLVEREGTNNENLPETHAVLKKIRATIDAEYPNRMLLAEANQWPEDVKEYFGDEDECHMAFHFPLMPRIYMSIASEDRFPITDIMRQTPDLAETNQWAIFLRNHDELTLEMVTDSERDYLWNTYASDRRARLNLGIRRRLAPLMERDRRRIELINSLLLSMPGTPVIYYGDELGMGDNIHLGDRDGVRTPMQWSSDRNGGFSRADPEQLVLPPVMGSLYGFDAVNVEAQSRDPHSLLNWTRRMLATRRAKQTFGRGTIRFLKPENRKILAYLREMPGEPPILCVANLSRAPQAVELDLSEFDGSVPIEMTADSVFPPIGQLTYLLTFPPYGFLWFMLCPGGQRPTWAQAPSEPLPEFVTIVIREGQVGPTPENVRLLESEVLPSWLSRRRWFASKDQKLNAVRLAALTTIPNGGFAFTEIEADVGKHTERYVVPIAITWGGETTFPLFKQLALARVRRGRNVGHLTDAFALPIFAHGVMRKLRERAVVPTVQKSEIRFLPTERFAELEGLGERPEIRWLAAEQSNSSLIIADAAVLKLVRRLVSGIHPEAEISRYLTQLGYANTAPLYGEVVRVDPEGVPHTLCILQGYIDNQGDAWNWSLDYLRRSVDELAIAVDTETQSVPDRSNEAILVEGYSTLAGIIGRRLGELHVALASPTDDPAFAPEPASAEQVKAWVDGTQAMLASALDLLAPRIEQMSDTETRALAQSLIDRRAALVAAVDSLVSANAGALRIRIHGDFHLGQVLVAQGDAYLIDFEGEPARTLEQRRQKSSPLRDVAGLLRSLSYASAAAQSTTEAAPQQTADRKRALFDRFRAHAAEKFLNEYRAAAAEAATPLVAPEAEQALLDLFLIEKAAYEIRYEAANRPTWLSLPVRGLAALTSRLLGDTGAPGHDSSNQAPGAATPPNPAEGDYE

SEQ ID NO: 15790 - protein, 370 aa, Bacillus cereus E33L
MYITDPIYGPISIHNRYILQLIDTKAFQRLADIKQQGHTYFLHENALHTRKEHSIGVYVLINKVIEHLTGIGDIRLSEYERELLSVVALLHDIGHGPYSHCFQQISGEDHGEWTIRIIQEDEEIRTILNQTPGLLDDVMKALTEDGVFLIIDELLFNSLGMDQLDFWNRDLYYSNLELEGLRIEELIASMRFINGKLVIEESGIPLIEQLMKMKEGLYNNGFGHPFVIGKDLLLQSIFRKVMEKNLKFYTPELQNFFYKEDLLVEDFLPLQDEMILHEIQCFAKSEDKQLVALIQLYFSGAKSLSFQKGVEGDFKKENNNLAIITEKKAYSSYVGGIYVYSEGQLEDIVEKSLFIREIVRLPKKEYAYSI

SEQ ID NO: 15791 - protein, 90 aa, Anabaena variabilis ATCC 29413
MEIKIEHQPSPEILQKLGVFQWGIWQKEVSKFPWTYDTQETCYFLEGDVIVTPHGGQPVQMGKGDLVTFPVGMSCIWEIKSGVKKHYSFN

SEQ ID NO: 15792 - protein, 472 aa, Ralstonia metallidurans CH34
MRRNRNAKIVATLGPSSSDKDTIRRLFAAGVDVFRLNFSHGDEAAHRASFAILRELEREAGRPIGILADLQGPKLRVGTFAAGSVMLDESQPFRLELDTAPGDARRVGLPHPEIFAALAPGAELLLDDGKLRLIVERCGADFADTRVVAGGKLSDRKGVNVPGVLLPISALTAKDRRDLALALDLGADWIALSFVQRPEDVVEARKLIGERAAIVAKLEKPSAVEQLEAIAECADAVMVARGDLGVELPAERVPGIQKRILRTCRRLGRPVIVATQMLESMVTSPVPTRAEASDVATAIYDGADAVMLSAESAAGRYPVEAVDMMSRLITEVEGDPQYLQLMNASRPSAPAGAGAADAVCCAVRHAVALMHASAIVCYTSSGHTSLRVARERPEAPVLSLTPHLRVARRMALAWGIHSVHIEDVADVDQMTAKACAVACQEGFAQGGQTLVVIAGVPFGTPGTTNLMRIATV

SEQ ID NO: 15793 - protein, 272 aa, Ralstonia metallidurans CH34
MDPTPLPPHPVRGQRRRLLVAGNWKMNGSLAGVQALAAAIADGAVARLDRVQLVLFPPFTYLPEAQRRLGASGMAWGAQNVSGHEDGAFTGEVSAQMLREFGCACVLVGHSERRTLFGENDAVVARKFLAVRQAGMTPVLCVGESLPEREQGATEDVVARQLQAVLDLAGASAFADAVVAYEPVWAIGTGKTATPAQAQDVHAFIRGRLAEADPAIAASLHVLYGGSMKRANARELLAMPDIDGGLLGGASLNVDEFMAVAITAQRLAQENT

SEQ ID NO: 15794 - protein, 219 aa, Ralstonia metallidurans CH34
MTQDEIKAMVARAALPHVLPGSIIGVGTGSTVNHFIDALSSLREGIAGAVSSSNATTARLRGHGIRVLEAGEVEQLALYVDGADEIDPHGHMIKGGGAALTREKIVADLAQRFLCIADASKKVEVLGRFPLPVEVIDVAATRIARRFAAIGGRAVLRKGVVTDNGHPILDVHGLAIADPPALEAEINQWPGVVTVGLFARHRAHACLLGTPEGVLTLQF

SEQ ID NO: 15795 - protein, 706 aa, Xanthomonas oryzae pv. oryzae KACC10331
MEIVPRALAQVRGRGATLGALAVFGTRLAIQLPWQLRIVQCTRCAASGTSRTPIQQRRSTPHPARIHACLARMRRMSHRVNHALCTMDARPNGPAVRSCPPRRTPAITTQCPQATPGAVPLAGSTSTLSRTRSQRIGMHHDTSLIDIIAVGLAVAFILGTLAQKAKLSPLVGYLLAGVCVGPFTPGFVADQTIANQLSELGVMLLMFGVGLHFSLDDLMEVKWIAVPGALAQIVVATLLGWALAWSMSWSLMHGLVFGLALSVASTVVLLRALEERRLLDTQRGRIAVGWLIVEDLVMVLALVLLPALADVLGAGTPAAVHDAQSPSLLAALGVTLLKMVAFVAAMLVIGRRVIPWSLEKVAATGSRELFTLAVLGIALGVAFVSATLFGVSFALGAFFAGMLLKESELSHKAASDSLPLRDAFAVLFFVSVGMLFDPMILVAHPWQVLATFLTITVGKSLAAFVIVRAFGHPTGTALTISTSLAQIGEFSFILAGLGVQLAIMPETGRDLILAGALLSIVANPFLFSWLDRWQATQAAKQAQDAPAAVEPELPPGPPLPADGHAIVIGYGRVGSSLAQLLRSRGVPVLVIDDNGDHVAKAHAAGIPGIRGSAAADRVLTEARPEHAKIAILAIPQPLEAGEALAKLRAINPSLTLLARAHSDAEVKHLLEHGADGAVLAERELAYSLAEMVMSTPPYRALNVPAS

SEQ ID NO: 15796 - protein, 777 aa, Neurospora crassa
MAQAYDDEELSISLSPSQIRSRNKRSGDGASGFGPSTGNLHEYGQHGQQLHPNINAVMADAPLRDKMRTEQRIGAYNIVKTLGEGSFGKVKLAVHRMTGQQVALKIIARKKLISRDMQGRVEREIEYLQLLRHPHIIKLYTVIKTPTEIIMVLEYAGGELFDYIVQHGKMKEDEARRFFQQMLCAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGSYMVPTWMSPGAASLIKKMLVVNPVQRATIDEIRQDPWFLKDLPAYLHPPVEEFLNTGVDPNKAIKVSDIAPNAPPQEQEKLHNEVTEKISKTMGYGKRDVEEALEADEPSAIKDAYMIVRENKLMQSNLDFATSHPPSASILHLPSGEHRLTQKKSKSLSLRPSSFWSNTNEEYQDTLLKTDEEIPGLTTEESVPSPLHDPNMSSARSIASVSTATSPRPYVSKIGILPSSLPTYHRVFMEREKAKAEGLEPPDAIPTIVEPANQPRSQAEQEETIRRLKPHSRSQLRLDEANKRPQGLTPVHPPKKNKPARWQFGIRSRNAPWEALVCIYKALNKLGAGWIVDEDYERAHRDDDDTDDYDGPSIGSRKKSSSSMDPTKTYRLPADPWHIKIRWTTDKLKKHSVASGLSEAGENTHVSRDGSDSKYQVVAMRMEIQIYEMEHGVYLVDFKVDGYETPDGKLLEDKEVTSPFPFLDMAAKLIMQLADAD

SEQ ID NO: 15797 - protein, 486 aa, Mycobacterium tuberculosis
MAHHHHHHGTEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 15798 - protein, 479 aa, Escherichia coli O157:H7 EDL933
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 15799 - protein, 135 aa, Oryza sativa
  misc_feature (63)..(63): Xaa can be any naturally occurring amino acid
  misc_feature (86)..(87): Xaa can be any naturally occurring amino acid
  unsure (1)..(135): unsure at all Xaa locations
SVCSIRSFLWRDGASPSIMIKPDGVKRALIGDIISRFEKKGFYLRGMKFMNVESHFAQQHYAXLLPGTRADGSEHFPDKPFFHSLXXLHHLSPQSLRSLWEGKYVVATARRSLGNQMETHPAIMPDSQYKHNARS

SEQ ID NO: 15800 - protein, 1635 aa, Nostoc punctiforme PCC 73102
MQTSDNQDPIDGVAIIGMVGRFPGAGNVDEFWRNLCEGLESTTFFQDEELDPSIDPNLCKDPSYVKARGIIPGGETFDAAFFGINPMEAVVMDPQARVFLELVYEALENAGYESESFDGLIGLYAGCGQNTYFANHISGRMEIVDRIGEFQTMLANEKDFLTTRAAYKLNLKGPAVSVNTACSTSLVAIIQACQALSSYQCDMALAGGVSMTTPQNSGYIAQEGSMLSGDGHCRPFDASAQGTMFNNGAGIVVLKRLEDALNEGDRIYAVIRGSGINNDGADKVSFTAPSVDGQAEAIAMAQAYANFHPETISYIEAHGTATPLGDPIEIEALTQAFRVHTDAKQFCAIGSLKSNVGHLVAAAGVAGLIKTVLALHYKKIPPSLNFEAPNPKIDFANSPFYVNTKLAEWSQGETPRRAGVSSFGVGGTNAHIVLEEAPQIQNSGSSRPQQLLLLSAKTSTALEAATANLQQYLQYNAEINLADVAYTLQRGRKALNYRRSVVCHDITDAIAALQSLDPNQINTRHTVIRNLAVAFMFPGQGSQYVDMGLNLYNREPVFQEVVDECAEILKPLLGGDLRRIIYPAPSDRETAAIALKQTCFTQPALFVIEYALAQLWQSWGVKPQAMIGHSIGEFVAACIAGVFTLEDALMLVANRGRFMWELPQGAMLSVRLPAQEVEPRLIPELAIAAINAPSLCVVSGPTEAIAALQKQLESEEVVCRPLHTSHAFHSPMMDDIIAPFAEVVRKVKLSPPQIPFVSTVTGDWITAQQATDPMYWATHLRQTVRFAEGIQTLWQQPERVLLEVGPRITTTTLARQQAKDIKQQIAIASLSDNAENEAEWTALLKAVGQLWLAGVSIDWSNFYQRETRQRISLPTYPFERQRFWIDPLPHPNRAATPKPLNPQLEKTQDMTKSPQQKLIPLLKEIIEETSGLEIASVDDSTTFLEMGLDSLSLTQVGLALKKKFQVKVTLRQLLEIYPNLGTLADFINPALSPETLSALGLTETVAEPIPEVPLPAPATTSPTLVVHEVHTNGSAPQISPQPAASSFFENVINQQLQIMSQQLSLLGNNSQAVTIPVVPAATPQNNGVKPQNAVSIPATQTSKESPASVDTESNGAKKAFGAAARIEKTQTKTLTTQQRTHLDKIIQRYTQRTKKSKEYTQSHRPYLADPRTVSGFNPTMKEMVYPIVASRSSGSKLWDLDGNEYVDLSNGFGLNLFGWSPPFITEAIEAQLKLGMEIGPQTPLVGEVAKLMCELTNFDRAAFCNTGSEAVLGAMRMARTITGRNLIAIFSGAYHGILDEVIVRGTKKLRSIPAAPGIPPEMVENILVVDYDSPESLEILRSRADELAAVMVESVQSRRPEYQPKEFLQQLRDFTEEAGIALIFDEIVTGFRIHPGGAQAHFGIKADIATYGKIVGGGLPIGVIAGKSQYMDALDGGFWQFGDDSVPEVGVTYFAGTFVRHPLALAAAKAVLQHLKQSGPSLQQNLNARTDKFVAELMGYFQKVQAPFTAYNFGSLFIVKSAPEFPYGDLLFYLLRDKGVHTWDHRPCFLTTAHSEADLAFVMAAFKESIAEMQSAGFLSAPPIEVTNSEVTNNSLRNRPPQPNAKLGRDPQGNPAWYIPDTERPGKYLQVASVS

SEQ ID NO: 15801 - protein, 81 aa, Triticum aestivum
  misc_feature (47)..(47): Xaa can be any naturally occurring amino acid
  unsure (1)..(81): unsure at all Xaa locations
MAAAAKASWMVAMSVGAVEALKDQAGLCRWNYALRSVHRAAKAKRSXASRKARKLAPPRRGQRPPPEEGMRTVMFLSCWGP

SEQ ID NO: 15802 - protein, 510 aa, Listeria innocua
MEFWRGSVFYEIYMKSFQDSNGDGLGDFKGLTSRLDYLVDLGVDGIWLTPFYPSPQVDNGYDVSDYCDINPDYGNMADFREFMKAADARGIKVIIDLVLNHSSTEHAWFKESRSSKTNPKRDYYIWREKPNNWESFFGGSAWELDKLTGEYYYHSFAKEQADLNWANPAVRAEIEQVLAFWLNEGVAGFRLDVINNLTLVLEFPDNPVVDNEMEHVYDRNQQGLEQALEQIAAFCRKEREVFLVGEISSDKLPEIAKYSSKTMLDVTFNFNFGSVELLDAQSVFTTLNEMETALQEGQWPTLFFGSHDMSRFTTRLSNGNLSKTKLLAFLMLTAKGIPFIYYGEEVGMPDLTFSSVEEMRDIQGTAAYYQALQAGSDEQSALELAINKTRDKARGPMVFPDGKPFTTGQPWIKMASLNEEDALSMWHFYQALLAFRKGHDFKEKEYASLTLDGETLSYQRGEFLFLLHFGETEVTYPLQEKSELVFGDAEMLEADVKMGAYAGIALRVED

SEQ ID NO: 15803 - protein, 661 aa, Methanosarcina acetivorans C2A
MTSNLLTDLLIIFGLSIPVVYIFFRLKISPLVGFLIAGILAGPYGLGLIQETEHIEVMSEIGVILLLFTIGIEFSLRELLKIKRIVLLGGGLQMSITTVVVSFLLWRLGYSPETAVFMGLIVALSSTAIVLKLLQEKGEIYSAHGRIALGILIFQDIAAVLIIILAPLLAGEAVVGSDLLDLLFRGIGLVLLTLVSARYVVPFVLFHVAKTRNNELFLLSIVVIGLAIAWLTSVAGLSPALGAFLAGLIISESEYAAQALGTVIPFKDMFMSIFFISTGMMLNLGQMSTHLSLILTATVLVLVLKTSVNALTTFFIGFPLHTMLLVGFSLAQVGEFSLVTAQVGFENGIFSETIYQEFLAVTVLSMVLTPFITDLGYYSAVSSQQLSLPGILTTNRYSLQDEGQEKKLENHLIVIGYGVSGRNVGIAAQKASIPYMVIEINPETVRREKLNGIDIIYGDAAQKAVLEHAGIKNARSIVITAGNPVSTWQIIEVAKRLNPDIHIIARTHFLDTIDSFYALGADEVISDEFECSIELFSRVLNKYMVPVKEIETMNTQLRADHYRMLRGPEIQRKSVSATSLDFSDVEIKSIRVEKHSEAAGKTLGDLDLRKKYGVTVLAISRNHRLMYDLRAETELNPDDILLVISPPEQLEEIRELFENGA

SEQ ID NO: 15804 - protein, 137 aa, Frankia sp. CcI3
MSVERTLILVKPDGVSRGLVGEVVGRLERKGLTLVALELRTLERSVAETHYGEHASKPFFGELVDFITSGPLVALVAEGPRAVEASRGLIGATDPVKAAPGSLRGDYALEIGQNLVHGSDSPESAKREIDLFFPGLS

SEQ ID NO: 15805 - protein, 121 aa, Glycine max
MASSMLSSAAVGTSPAQATMVAPFTGLKTSAAFPATRKANNDITSIASNGGRVSCMKVCPPDGKKKFETLSYLPDLTEVELGKEVDYLLRNKCTPCAEFQLEHEFVYRDHRSKPGYYDARY

SEQ ID NO: 15806 - protein, 248 aa, Zea mays
  misc_feature (233)..(233): Xaa can be any naturally occurring amino acid
  unsure (1)..(248): unsure at all Xaa locations
MSSSSPSLLSSRLLSPAILFTKKPASLRSISSATARHGVRVVVAAASAAAASPVSAARVRPSAAEVARTVVELAASGTLSMVGPDGWPLGVGAHFVADSAGAPALCLSAARVAAPDAPASFHVEFRQSGARTPQCTMLGALTKPSDESVLKDGMWVVPSDYTSAEPDPLRNFAEHIVEEFNNKNAEDVRRIYNIYVESDLQVADVKMIWVDRLGFDLHAHSAEGVLAVRVPFXPREVSDEKGVKSSFT

SEQ ID NO: 15807 - protein, 456 aa, Mycobacterium avium subsp. paratuberculosis K-10
MSVAEPKRDIAGLPLAPKNPLSYRERLRAIKEFHTGTNKLRDAGGPVTRVTLGPRWLISPIVLATSPQGIRDIVSVRDGSIDKTSTVATELRRLLGPNLFVLPHTEWLPRRRTLQPVFTRQRVREFGGHMAEAAESVCAGWPEDTEIDLDAQCRTLTLRALGRSVLGLDLDERSDAIAEPLRVATSYAVRRALRPLRAPEWLPTPSRRRARAAAGAIRALADEILQACRADPGREAPLVHALIAATDPETGQALSDKEIRDEMIIFLFAGHDTTATTLTYALWALGRHPEYQARVAAEVAELPDRHLTPDDVARLGFTVRVLQEALRLCPPGPTGTRMATRDVEVAGYRVEAGTMLAFGRMAVQTDPSLWDAPLRFDPDRFDPRRAGDRDRWQYLPFGGGPRSCIGDHFAMLEATLALATIVRRVEIESLSDDFPLAVPFTMVAAAPIRAMVRRRR

SEQ ID NO: 15808 - protein, 402 aa, Physcomitrella patens subsp. patens
MSTCAVAALSSPPTSFTSERVTSGITASVQPSAFLGTKISVCKGASVLSRAVSASISRQPLVAPIRAQGVAAPADTKAPTTTKKTDTKSTVIITGASSGLGLATAKVLADSGEWHVIMACRDFLKAERAARAVGMPKDSYTVIHCDLSSLNSVKQFVDNVRQSGRPLDVLVCNAAVYLPTAKEPRYTADGFELSVGTNHLGHFLLANMLMEDIQHKENDTNRRVIIVGSITGNTNTIAGNVPPKANLGDLRGLAGGLDGVRSSVMIVGGEFDGAKAYKDSKVCNMLTMQEMHRRFHEKTGVTFASLYPGCIATTGLFREHYQLFRTLFPPFQKYITKGYVSEEEAGKRLAQVVSDPTLNKSGVYWSWNNQSNSFENELSQEASDAEKAKKLWEISEKLVNLS

SEQ ID NO: 15809 - protein, 352 aa, Listeria monocytogenes str. 1/2a F6854
MQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEILPAFEKSAAVVVEEGGLTSHAAVVGINLGIPVIVGAKDATSLVKDGEIITVDSRQGVVYNGKTATH

SEQ ID NO: 15810 - protein, 207 aa, Arabidopsis thaliana
  misc_feature (146)..(146): Xaa can be any naturally occurring amino acid
  misc_feature (201)..(201): Xaa can be any naturally occurring amino acid
  unsure (1)..(207): unsure at all Xaa locations
MTEVLHFPSSPSASHSSSSSSSSPSPSSLSYASRSNATLLISSDHNRRNPVARFDQDVDFHASIEEQDLRRRSSTDGGEEDDGGEDQISLLALLVAIFRRSLISCKSNRRELCSMEIGWPTNVRHVAHGTLDRSNGFLGLPVEFQXPKFPEELPAPRRQALGGSSPSPRLSSVACSDCVPTILLLMQNWLYSQGGLQAEGXFRLTAE

SEQ ID NO: 15811 - protein, 559 aa, Methanosarcina mazei Go1
MENNLQGVLKGQKIAYFSMEIGLRNEIPTYSGGLGVLAGDTIRSAADLNIPLVAVTLVSNKGYFRQKLDASGTQTELTEEWTPSNFMTWLPQEVSVKIQGRDVKIQAWHYNCKSLTGGCVPIIFLDTNVEGNSPEDRRITDFLYGGDHTYRLKQEIVLGVGGVRMLNALGFKIRKYHMNEGHSSLLALELLKCNGKECPIVKDLCIFTTHTPVEAGHDKFDYSLVEDMIRDQNDMEILKKYGGEDRFNTSLFALNLSDYVNGVTKRHSRVSSELFPGYSIQAITNGVHSYTWTCPYFRDLFDRYMPGWANEPELLVRIGGIPDDEIWEARRKAKKALIDEVNKRTGAGMEYETFTIGFARRMTAYKRATLLLSDIERLRKVNRRGKIQIIFAGKAHPRDEAGKQLIRDIFKSIETLRNEVKIVFLENYDMDLAAKMVSGVDLWLNTPTRPYEASGTSGMKAAHNGVVNFSILDGWWIEGWIEGVTGWSIGPMPEENLIGEEARVAELNDLYNKLYYIIVPMYYERKDDWLKMMNNSIGMIAYYFNSHRMMRRYVTHAYL

SEQ ID NO: 15812 - protein, 432 aa, Listeria monocytogenes str. 1/2a F6854
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLASFKEALAVWGDQVAAVLVEPIVGNFGMVAPEDGFLEAVNELAHVNGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAAAKHNIAVTVNQIVGALTVYFTEDTVTNYAEAGATNGELFGRFFKGMLEEGINLAPSKYEAWFITSAHSEADILETIQAVDTVFGKMVQDN

SEQ ID NO: 15813 - protein, 281 aa, Saccharophagus degradans 2-40
MLINWYPGHMNKARNKVKEIMPAVDVVIEVLDARLPASSTNPMIETLRGDKPYLKVLSKSDLADPTITKAWQAFFREQRNMDSLAITTDKVSIAKTIPDRIRKLLPNRGTSLKPIRALIMGIPNVGKSTLINTLAGKKIAPVGNEPAVTKAQQKIRISDNFFLIDTPGMTWPGSKNEMINYRLAASGAIRDTALEYDDLAVFAMDYMLQRYPEAIRKRYQFDELCESATAMLEELAMKRGCKKNGLPDLTRIGELFVRELRAGKLGRFSLEEPLVSYRKRE

SEQ ID NO: 15814 - protein, 137 aa, Streptococcus pneumoniae R6
MEQTFFIIKPDGVKRGLVGEVLKRIEQRGFTIEKLEFRSQVSEELIDQHYQDLVGQSFYPPIREFMTSGPVLVGVISGPKVIETWRTMMGATRPEEALPGTIRGDFAKAAGENEIIQNVVHGSDSEESAKREIALWF

SEQ ID NO: 15815 - protein, 288 aa, Zea mays
  misc_feature (213)..(213): Xaa can be any naturally occurring amino acid
  misc_feature (219)..(219): Xaa can be any naturally occurring amino acid
  unsure (1)..(288): unsure at all Xaa locations
MTKSSGALDLARSTGGSLSKDQVKSAVDQYVKYHDLHGGEQESRKSNYADLANKYYDLVTGFYEYGWGDSFHFAGGYPGETSREAIKRHQHFMALQLGLKKGMKVLDVGCGIGGPLIEIARFSSTSITGLTNNDYHVSRGKEHIFSAGLSEQCCSLKGDFMNMPIADNTFDAAYAIQATCYAPEAQGVYSEVYRVLKPGQYFALDEWCLTDRXDPNNTXHLSTKPEIELGDGLPDIRTTRQCVQAMKDAGFEVVFAKDLAQDFPCPWYRAMDPTYFSWAASLSRKLIW

SEQ ID NO: 15816 - protein, 341 aa, Idiomarina baltica OS145
MKALAKLHSKPGIWMTDVEKPEFGYNDVLIKIKKTAICGTDVHIYKWDDWSQKTIPVPMVVGHEYVGEVAAMGDGVRGFEVGDRVSGEGHITCGHCRNCRAGRRHLCRNTYGVGVNRPGAFAEYLVIPADNAFKLPDDVTDDMAAIMDPLGNAVHTALAFDLVGEDVLITGAGPIGIMAAAVARHVGARHVVITDVNEYRLELAKKMGVTRAVNVAEESLKDVMSELGMKEGFDVGLEMSGVPSAFSQMLATMNHGGKVAMLGIPPENVAIDWNEVIFKGLVIKGIYGREMFETWYKMASLLQSGLDISPILTHQMSVDDYEEGFETMVSGQSGKVILNWD

SEQ ID NO: 15817 - protein, 430 aa, Gloeobacter violaceus PCC 7421
MDGRSGRFSMNLFTRKSRTYHDPIHGAISLSGSDPAEALLIGLIDAPEFQRLRRIRQLDVAALTFHGAEGSRFTHSLGVLAIARRVFDRLAPRYPMLAPFRAVALCGALLHDIGHGPYSHASEHIFDYDHERWTRRILSGSTHIARLLEAFDPQLPSQLCAVLDKTHPVAALTQLVSGQLDCDRLDYLLRDSYFTGARYGQLDLDRIIHALDYDPPTQSLVLSGRKQMVAIEHYLVVRHFMYSQVYHHPKNMAARFILQQALALAAHYARRGELEVDEDMKAWLVQEVDRLALPTYLACDDTVLGYHLHRWRTHPDPILGDLCRRFLDRDLFKTVEVTALGELHRQFVLNRLRAAVAATGRPPEHYCALQDTQAKGYTLYEQGIFLRDGAQLRELADASLLVRSLIQPEIRLWLVYPREVQSEVQKLMGS

SEQ ID NO: 15818 - protein, 409 aa, Triticum aestivum
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 15819 - protein, 427 aa, Oceanospirillum sp. MED92
MSRSEELFQAAQVHIPGGVNSPVRAFKGVGGTPVFFKRGEGAYLFDEDDNKYIDYVGSWGPMILGHCNSAVIDAVRNSLDNGLGFGAPTEIEIEMANKVCEIMPSLDMVRMVSSGTEATMSAIRLARGYTKRDKIVKFEGCYHGHSDSLLVKAGSGMLTLGEPSSPGVPASLAEHTITLTHNDIESVRKAFAEMGDQIACIIVEPVAGNMNCIPPVPGFLEGLREVCDEYGTVLIFDEVMTGFRVALGGAQSVYNVQPDLTTLGKVIGGGLPVGAFGGKKEIMEHIAPLGAVYQAGTLSGNPLAMAAGLAMLNAVSEPGFYEQLGAKVELLTEGLQAVAMANGIPFTTSRVGGMFGLFFTEQEKVTSFAETMKCDADRFSKFFHGMLEQGVYLAPSAFEAGFVSAAHTQDDIEATLAAADQVFASLK

SEQ ID NO: 15820 - protein, 164 aa, Musa acuminata
DAGLSEIADGCPLLEKLDLCQCPLITDKVLVAVAKKCPNLTSLTIESCANICNEGLQVIGRSCPKLKSLTIKDCLHVGDQGIVSLVSSASSCLERIKLQALNISGIVLAVIGHYGKNLIDLSLNGLQNVGEKGFWVMGNALGLQKLRSITINCCNGLTDKGLQA

SEQ ID NO: 15821 - protein, 616 aa, Magnetococcus sp. MC-1
MHDYLLLITLTSAISVGLALLLRRFGLPLLVGYVLAGMVVSGALGFHYDQSGLLRDVAEMGVVFLLFTVGLEFSLQRLRQMRHAVFLVGGLQVGLTALIVCFGAISMYTMAMPSALVIGLSVALSSTAIVLKTLYENKDIGKPYGQVTVGVLLFQEISVVPMLLLVGFLGMHTQTHIALLLVETVVGALVAFAIIYVVGRFGVTRLLAAVSEMRSQEAFVASILMVVVSAALLTHALGFSYALGSLLAGMMLAETQYKHQVEADLVPFRDLLLGVFFITVGMQVDLNFAVQNLHWILMATLLLIVFKTAITFAVVRLTGSREVALKSALAIAQGGGFSFAILELALRLQLLEPQVHQFMVTTLVCSMLVAPFMLKGIHKDGGRLAKDAGADDPTGPFKGEAHNRLVVCGYHRCVPITLEKNHVVVCGYGPVGREVVIQLQEAGYPYVCIEHQQSLVGQGVDEGHAIIFGNAAQDHLLKMAHVNDAAAVIITVGDEKSKRLIGKAVARVCDHPVIVTTATHQGEAHMLDDLPIKAMVNYPKETARMLLGHALSCEWQPGFIGSWSLSAAITKPTAAAEDALVPGADMGLAQGVGLAPATGVGVVLSGAPEAPFTKET

SEQ ID NO: 15822 - protein, 192 aa, Glycine max
MSAVNITNVTVLDNPASFLTPFQFEISYECLTALKDDLEWKLIYVGSAEDETYDQLLESVLVGPVNVGNYRFVLQADPPDPSKIREEDIIGVTVLLLTCSYLGQEFIRVGYYVNNDYDDEQLREEPPPKVLIDRVQRNILSDKPRVTKFPINFHPENNENEEQQPPPSEHPSETGEDPLAVVDRDPPDEKDS

SEQ ID NO: 15823 - protein, 987 aa, Synechococcus sp. RS9917
MTLLEQRCVASAEAIEQHRLSPFVERHLGPDPEQQQCMLQALGFASLEDFVRAVVPADILDAEPPLEAMPEGVAEAQALAELRKIAAANRLHRSLIGLGYHDTATPALIQRHVLENPAWYTAYTPYQAEIAQGRLEALLNFQTLISELTGLPIANASLLDESTACAEAMSLSLAVCKRPQACRFLVDAAVLPQTLAVLETRATPLGVSLEVGEPDAFRWDEDVFGVLLQLPGRNGHLWDPSALIAAAHAHGALATVAIDPLAQVLLAPVGSLGADIAVGSAQRFGVPMAGGGPHAAFFATREIYKRQVPGRIVGQSVDAEGRPALRLALQTREQHIRRDKATSNICTAQVLLAVMASFYAIHHGPDGLAVIARRLVGQRIALERGLVALGYPLPQAPRFDGFDVVTPLAPAVHQRASECGFNLRVLPDGAPVEQAEGFGLSLDELSDPGELQALLTVLAEVVDQPVPVLDPLAMAAETVDLEQALPALPLRRGRWLQQPVFQRYRSETELLRYIQRLVSRDLSLVHSMIPLGSCTMKLNAAAELVPVSWRSFSALHPFAPAEQCRGLQHLVHDLEGWLAALTGFAAVSLQPNAGSQGEYAGLLVIRAWHRSRQDAHRDVCLIPTSAHGTNPASAVMAGLRVVPVACDAQGNVDVEDLRAKAEQHSASLAALMVTYPSTHGVFETRIREICDLVHQHGGQVYLDGANLNAQVGLCRPGAYGADVCHLNLHKTFCIPHGGGGPGVGPIGVAAHLQPFLPGHPLVACGGDQGITPVSAAPWGSAGILPISWMYLRLMGPRGLRRASAVALLAANYLAHRLGDHYPVLFRGDAGLVAHECILDLRDLKRSAGLDVDDIAKRLMDYGFHAPTVSWPVAGTVMVEPTESESLPELDRFCDAMIAIRAEAAAIESGDVDRQNNPLKRAPHTLAAVTADHWDRPYSRREAAYPMADQREAKFWPHVARIDNAFGDRNLICTCPSVEELAAAQPAG

SEQ ID NO: 15824 - protein, 425 aa, Pseudomonas putida
MSKTNESLMQRRVAAVPRGVGQIHPIFVDTAKNSTVIDVEGRELIDFAGGIAVLNTGHLHPKVVAAVQEQLTKVSHTCFQVLAYEPYVELCEKINKLVPGDFDKKTLLVTTGSEAVENAVKIARAATGRAGVIAFTGGYHGRTMMTLGLTGKVVPYSAGMGLMPGGIFRALFPSELHGISVDDAIASVERIFKNDAEPRDIAAIILEPVQGEGGFLPAPKELMKRLRALCDQHGILLIADEVQTGAGRTGTFFAMEQMGVAPDLTTFAKSIAGGFPLAGVCGKAEYMDAIAPGGLGGTYAGSPIACAAALAVIEVFEEEKLLDRSKAVGERLTAGLREIQKKYPIIGDVRGLGSMIAVEVFEKGTHTPNAAAVGQVVAKAREKGLILLSCGTYGNVLRILVPLTAEDALLDKGLAIIEECFAEIA

SEQ ID NO: 15825 - protein, 402 aa, Physcomitrella patens subsp. patens
MATCVAAAVSSSLTALTSERATTGITASVQSSAFVGIKVSVCKDASALLKAVNAGTSRQPLVEPVRAQSVAAPASTNASTSSKKTDTKSTVIITGASSGLGLATAKVLADSGEWHVIMACRDFLKAERAAKSVGMPKENYTVMHCDLSSLNSVKQFVDNFRRSGRPLDVLVCNAAVYLPTAKEPRYTADGFELSVGTNHLGHFLLANLLMEDIQHKENNNSRRVIIVGSITGNTNTVAGNVPPKANLGDLRGLAGGLDGVRSSVMIDGGEFDGAKAYKDSKVCNMLTMQEMHRRFHEKTGVTFASLYPGCIATTGLFREHYSLFRTLFPPFQKYITKGYVSEEESGRRLAQVVSDPSMNKSGVYWSWNNQSGSFENELSQEASDAEKAKKLWEVSEKLVGLA

SEQ ID NO: 15826 - protein, 314 aa, Bacillus coagulans
MNILLMVRTPFIEAVPDFVKNLNRLGNVTILDTDNGIEKEKLKQAVREVEVIITAVVQIDKEIIDAAPNLKYIMKFGAGYDNIDFKYAREKGIPVTNTPGQNADAVADLAIGLMLATARNIPAKNEELRNGNWELSMGIEIFQKKLGIIGFGAIGQAIAQRATGFQMEVLAYGTFQDQTIADRLNVEFVDLNKLLNESDIVVVSTTLRKDNYQLINAKTLNEMKKDALFINVSRGALVDEDALYKALTNGKIKGAGLDVFVEEPSHHPLLTLPNTTVTPHIGAATNEAIKRTGSVALENVQRLKNDLPLLYVVN

SEQ ID NO: 15827 - protein, 274 aa, Campylobacter jejuni subsp. jejuni NCTC 11168
MRKSMISFLEKKAKNEKITMVSAYDYHSARILDNSDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSQEHSFDYLDDELLDKLY

SEQ ID NO: 15828 - protein, 466 aa, Streptococcus pneumoniae R6
MYFASESSHQALFLVSCPTILPKRAGFCYNGHMNEKVFRDPVHNYIHVNNQIIYDLINTKEFQRLRRIKQLGTSSYTFHGGEHSRFSHCLGVYEIARRITEIFEEKYPEEWNPAESLLTMTAALLHDLGHGAYSHTFENLFDTDHEAITQEIIQNPETEIHQVLLQVAPDFPEKVASVIDHTYPNKQVVQLISSQIDADRMDYLLRDSYFTGASYGEFDLTRILRVIRPIENGIAFQRNGMHAIEDYVLSRYQMYMQVYFHPATRAMEVLLQNLLKRAKELYPEDKDFFARTSPHLLPFFEKNVTLTDYLALDDGVMNTYFQLWMTSPDKILADLSHRFVNRKVFKSITFSQEDQDQLASMRKLVEDIGFDPDYYTAIHKNFDLPYDIYRPESENPRTQIEILQKNGELAELSSLSPIVQSLAGSRHGDNRFYFPKEMLDQNSIFASITQQFLHLIENDHFTPNKN

SEQ ID NO: 15829 - protein, 206 aa, Bacillus anthracis str. A2012
MGKEFFLQHDIVIMYSILFVFIIILKMQFFTWIGLLSCLFGIIFYTLNEYMTHRFLFHLKPPKNVFLLKMLRRLHYDHHVYPDDLKLLFLPVWFSIPSFTIYLLISYAITKSVTITLSFGIGMIIMLLVYEWKHYIAHKPIRPVTKFGRWLKKQHILHHYKNEKFWFGVSNPVFDFIFGTLKDGKDVELSETARNLEKEKKTKVVR

SEQ ID NO: 15830 - protein, 447 aa, marine gamma proteobacterium HTCC2207
MQSEESVEEFLKENLISEVECLVPDITGNARGKFIPANKFVKEDSRLPEGILAQTVTGEYSDDFWELLGTVDGDMLLEPDPSTMRKVPWANEATVQIIHDCYTKDGKPHPFSSRNVLKRILALYEAEGLKPVIAPEVEFYLIEKNIDPDSALKPPIGRSGRHETARQSYSIDAANEFEDFVETMYSYGDAMGLDLDTLIHESGAAQLEVNFIHGDPLDLADQVFTFKRLAREAALKHNIYATFMAKPMASEPGSAKHIHQSVLSLEDGSNIFATADGEYSDAFYHYLGGLQTYTPFVMSFFAPNVNSYRRFTREVAAPINLHWGFDNRTTGLRVPDAAPKDYRIENRFPGADVNPYLSIAATLACGYLGLKKGIKPSEPFHGNAYNEEMQMPRTLEEALRGLQEDRDIVEIFGSEFIQLYTSIKLVEFEEFNRVISSWEREFLLLTV

SEQ ID NO: 15831 - protein, 254 aa, Catharanthus roseus
MASQCCSSGSAKELHVLAVDDSLVDRKVIERLLKISCCKVTAVESGRRALQYLGLDGEKSTVGFDGLKVNLILTDYSMPGMTGYELLKKIKGSSTLKEIPVVIMSSENILTRIDRCLEEGAEEFLVKPVKLSDVKRIKDFVLKGGDEDGEKKTLGASKVGDENRPKETRKRNLDQSSSMSLSSTLVYSPLVLNKSSSSSLEEPHSPRTLLDNGIDQSAARDSSTLLRSSSAAVLASESEESHSKRSRLDSGAES

SEQ ID NO: 15832 - protein, 147 aa, Glycine max
APPPGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYL

SEQ ID NO: 15833 - protein, 337 aa, Monascus purpureus
MVVPKVGINGFGRIGRIVFRNAIEHEGVDIVAVNDPFIEVHYAAYMLKYDSTHGRFNGTVEFDGNTLIVNGKKIKFYAERDPAQIPWSETGAEYVVESTGVFTKQEKASLHLKGGAKKVIISAPSSDSPMFVMGVNNDQYTKDITVLSNASCTTNCLAPLAKVINDKFGIVEGLMTTVHSYTATQKVVDGPSNKDWRGGRTAAQNIIPSSTGAAKAVGKVIPSLNGKLTGMSMRVPTSNVSVVDLTARLEKAATYDEIKQAVKEASEGPLKGVLGYTEDDVVSSDLNGDPHSSIFDAKAGIALNSNFVKLVSWYDNEWGYSRRVIDLIAYIAQVDAQ

SEQ ID NO: 15834 - protein, 343 aa, Zea mays
MGFLICRVCLLQLLLLLLLAFTSSPASAQPAAPPGSARALDAALQEYAFRALAARPRTGIIYNATIPSSLAGVAASALRLRSGSLRRKGVAGGYFNFAVPPGVATRPRVERVVLVYHDLGNLSDRYYPLPAGYAYVAPVVGLLAYDAANLSAAAAAAGGLPELGLVAASGRPISVALGSPSRAAGTAARCVVFGLDGVPRFRDLEEGGNNVCATYEQGHVSIVVNSSGGSAPGPPPPPPPAGAIAPPIPTEEGGEKKGGSGSAAWKVAVAVGVVAGAAALGLVGALMLCLVRYRRDKKLEAMERNAEAGEALRVARVGRAQARAPVASGTRTQPVIENEYAAS

SEQ ID NO: 15835 - protein, 304 aa, Ashbya gossypii ATCC 10895
MDAKDVVTHVKNLEKNKSDEQTVLRILRILDKELVATEKLLRETKVGVIVNQFKKSSNDEIAKLVKKMIGTWKDAITKEKKKKAAVAAGGSGSGAGTAGGGAHSSHSGNSGPHEPKIQEKYHAKGPRSAKNDGVNTTIYGDKLRDMVIRAFYDALAKESEHPPQSILAIAIDIEKHMWQLNDPGENEKAYKDKYRVIYSNVISKNNRDLKHKITNGDITPEYLVNCDPKELAPEHLRKKLEEIAKQNLFNAQGATLERSVTDRFQCGKCKEKKVSYYQLQTRSADEPLTTFCTCEACGNRWKFS

SEQ ID NO: 15836 - protein, 472 aa, Neisseria meningitidis Z2491
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDTLVPTVCASLEEALAALKADHEFLLRGGVFSKDWIDSYIAFKEEDVRRIRMAPHPLEFEMYYSL

SEQ ID NO: 15837 - protein, 240 aa, Gloeobacter violaceus PCC 7421
MRRKVLAGNWKMYKTRGEARAFLEAFVPLISPGAENREVILCGPFTCLDLLSAQAGPYAVGAQNVHWADHGAYTGEIAPQMLVELGVHYVIVGHSERREYFNETDSTVNRRLNNAQDHDLVPILCVGETESVRKDGITEAHIRSQLDRDLELVDMRRLIIAYEPIWAIGTGKTCEANEANRVCAMIRKHVNFEGVPILYGGSVKPENIDELMAQSDIDGVLVGGASLEAKSFARIVNFEV

SEQ ID NO: 15838 - protein, 369 aa, Vibrio cholerae O1 biovar eltor str. N16961
MPISTPQEIIEDIRQGKMVILMDDEDRENEGDLIMAAEHITPAAINFMATHGRGLICLTLTKERCRRLGLNPMVQDNNAQYTTNFTVSIEAAEGVTTGISAADRARTVQAAVAKEAKAADLVQPGHIFPLAAQDGGVLTRAGHTEAGCDLARLAGLEPASVIVEILNDDGTMARRPDLEVFAEKHGLKLGTIADLIEYRNHTETTIERVAQCKLPTEYGEFELVTYRDIIDKQIHFALRKGDITSAPTLVRVHLQDTFTDLLHSNRAAERSWPLATAMQRIGQEGGVLVILGHEESSELLLHRVKMFELQDKGEAPAMAKKQGTSRRVGVGSQILADLGVKEMRLLSSPNKKYHALGGFGLNVVEYVCE

SEQ ID NO: 15839 - protein, 389 aa, Oceanospirillum sp. MED92
MKMVFRPSQRVAEIESFKVMDLLKRAKQLDAEGFDVIHMEAGEPDFATAAPIAEAAKAAIDKGLTQYTPAAGIPELRTAISQWYKTKYNLEISPERIIVTTGASSALLMVFSLLADAGQSFMMADPGYPCNRQFLQFLDAKSQLVAVNAEQNFQLNAQLIRDNWCPETAGALLASPANPTGAVVHKDELRAISNQIKQLGGHLVVDELYHGLTYGDDAPSVLEVDPDAFVINSFSKYFGMTGWRLGWLVAPEAAAPELEKLAQNLMISPHTVSQYAALAAFKPESLAIFEERKAQFELRRDLLVSGLRELKFDLPISPEGAFYVYAGAQHLTDNTYDYCWSMLEEDHIATTPGLDFGRHRCNEFIRFSYTTGYDRIELMLDRLQKRIHG

SEQ ID NO: 15840 - protein, 586 aa, Sporosarcina psychrophila
MRKTKIVCTIGPASESPELLEQLIEAGMNVARLNFSHGNHAEHKARIDSIRKVAREKGKVVGILLDTKGPEIRTHSMMNGKLELVTGQKIDISMTQVEGNNDVFSVSYDKLIEDVNEGSVILLDDGLIQLEVTGKDVARGLIHTLIINSGSLSNNKGVNIPGVSVQLPGMTEKDAEDILFGIREGVDFIAASFVRRASDVMEIRALLENNNGSNLQIIPKIENQEGVDNIDEILNVSDGLMVARGDLGVEIPPEEVPLVQKNLIEKCNQAGKPVITATQMLDSMQRNPRPTRAEASDVANAIFDGTDAIMLSGETAAGIYPVESVQTMDRIALTTEAAIDYRSVVSTRRREKHGNMTEAIGQAAAYTAINLKVKAVLAPTESGHTAKMIAKYRPGCPVIAVTSSEMCSRKLSLIWGVYPIVGKKASSIDEILQESVEESVKHQYVGHGDVVIITAGVPVGEAGTTNLMKIHVIGDLLARGQGIGKDVAYGRTVVAKNAAEALAYDTEGAILVTNASDRDMMPAIEKCAGLITEEGGLTSHGAIVGLSLGIPIIVGVENATELIQHGKEITMDAESGVIYNGHASVL

SEQ ID NO: 15841 - protein, 565 aa, Haloarcula marismortui ATCC 43049
MTAARAWWKEAVVYQIYPRSFNDSDGDGVGDLQGIIERLDYVADLGVDVIWLNPVYDSPQKDNGYDISDYQTIYDEFGTMADWEALVEEVHNRDMRLVMDLVVNHTSDQHEWFRKSRQRDPEYEDYYIWREGGTDEDGDPVPPNNWESFFGGSAWEYDEERSEYFLHLYDTSQPDLNWRNDSVRTDIFDTIEWWLEKGIDGFRMDVINLLSKVEGLPDGDPDSEWVGAEHFIDGPEMLSYLTALDEEVLSNYDVMTVGEMPQLTVESALEYADTDGPLDMAFHFQHTKLDYADGERWSVGDWSLPELKRIIGRWQDGLAADGWNTLYWENHDQPRSVSRYGDPENYRRESAKLLGTFILTLRGTPYVYQGQELGMTNADWETMDDLRDVDAINHARELLDRDGVEEYDDVKDIVGYRTRDNARTPMQWDDSKNAGFTDGDPWIQVNPNYREINAADQQADVDSVYSYYQRLIQLRADRDVLVYGDYTDLLPDHETVFAFTRSLSADSGTERILVVLHFDDATETLDLPVEYADATLLEGNYDCDDTDPGTVTLAPYEARVYELFD

SEQ ID NO: 15842 - protein, 264 aa, Oceanospirillum sp. MED92
MSNITLHTLSSMKQAGEKFAVLTAYDACFSHLVSSAGTEVILVGDSLGMVLQGNDSTLPVTVEEMAYHTQAVAKGNQGSLIMADLPFMSYSTPEQAMDSAAALMQAGANMVKLEGGAWLADTISMLAERGIPVCAHLGLTPQTVNKLGGYRVQGRDQETAQQMINDAVLLQDAGASIILLECVPAILAKEITLALDVPVIGIGAGADTDAQVLVLHDMLGITPGRSPKFVKNFMADADSIEAAVQLYVAEVKAGTFPAQEHGFA

SEQ ID NO: 15843 - protein, 467 aa, Agrobacterium tumefaciens str. C58
MQTFVENFENSDRLRQRARNIIPGGAHTYAKGDDQYPVLSPGFIERGYGCHVWDVDGNEYIEYGMGNRAVGLGHAYADVVEAARAELYRGCNFTRPSKIEVDCASTFLDTVQTAEMVKFCKNGSDATSAAIRLARAVTGRDLIARCSDHPFFSTDDWFIGTTEMNAGIPEAIQNLVLGFSYNDLASARSLFDRFKGRIAAFILEPSRGDPPRDQFLHKLQKLCHENGALFILDEMITGFRWDAGGAQKTYDIVPDLSCFGKALGNGFSISALAGKREFMERGGIDQTDAPRVFLLSTTHGAETHAMAAAIATMKVYTHEPVVPHLVRQGNSLRAAISQIAIAHGLDSYFGIQGHSACLSYFTLDQTGKPSQAFRSLFLQETIRRGLLAPSLVVSYTHEDEDIAKTLDAIDGALVVYRKALEYGVDKFLTGRPSDVVFRRFNGNAQHQAGHGLVMADMPGLSESIRKP

SEQ ID NO: 15844 - protein, 102 aa, Oryza sativa
MAPTVMASSATSVAPFQGLKSTAGLPVSRRSGNSSFGNVSNGGRIRCMQVWPIEGIKKFETLSYLPPLTVEDLLKQIEYLLRSKWVPCLEFSKVGFVYRVNH

SEQ ID NO: 15845 - protein, 403 aa, Synechococcus elongatus PCC 6301
MLNASVAGGAATTTYGNRLFIYEVIGLRQAEGEPSDSSIRRSGSTFFKVPYSRMNQEMQRILRLGGKIVSIRPAEEAAANNGAAPLQAAAEEPAAAPTPAPAAKKHSAEDVPVNIYRPNKPFVGKVLSNEPLVQEGGIGVVQHLTFDISEGDLRYIEGQSIGIIPDGTDDKGKPHKLRLYSIASTRHGDHVDDKTVSLCVRQLQYQNEAGETINGVCSTFLCGLKPGDDVKITGPVGKEMLLPADTDANVIMMGTGTGIAPFRAYLWRMFKDNERAINSEYQFNGKAWLIFGIPTTANILYKEELEALQAQYPDNFRLTYAISREQKNEAGGRMYIQDRVAEHADEIWNLLKDEKTHVYICGLRGMEDGIDQAMTVAAAKEDVVWSDYQRTLKKAGRWHVETY

SEQ ID NO: 15846 - protein, 393 aa, Oenococcus oeni PSU-1
MSNFILPLNKTVDNLRRDPILDFQAKIRNIDDLIQLTFGEPGFTVDDRIKAVAKVSIDHDRSHYANSQGEINLRRAAVSYFNRHFQLNLKGVNDVLVTQGVSEAINVVFMTILERGDGVIIPEPSYSPYSTSLALAGGVKVPLDTCEHNFKITPELIEKTIDNANIPVKAILINYPANPTGVTYSKEELLAIADTLKKHKIWVISDEIYAALTYSGEHTSLYKIIPEQSILLTGLSKSHAMTGYRIGFIFASSELIEKMLTVHEALAFAVSTLSQDAAFAALTVGEDVPEYALKAYRKRRDRLLKKLTELGFESVNPQGAFYVFTKIPKSFGNNGYKFAVDLANNAKVAVLPGEAFSKNAKNYIRISYASSDSDLDEALRRMTNYIEKGTKYE

SEQ ID NO: 15847 - protein, 295 aa, Streptococcus pneumoniae TIGR4
MAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKENRRGHKMSKFNRIHLVVLDSVGIGAAPDANNFVNAGVPDGASDTLGHISKTVGLNVPNMAKIGLGIFLVKLLLRL

SEQ ID NO: 15848 - protein, 145 aa, marine gamma proteobacterium HTCC2207
MADKSRVQEVKSLVARLEQQGRTEHLSHREVMRPWGSYDPIGQGHRFQVKLIKVNPGESLSLQMHHYRAEHWIVVSGTALVERDGKEQLVSENESVYIQIGQRHRLTNPGCLPLQLIEVQSGCYLGEDDIVRYSDNYNRVAEASG

SEQ ID NO: 15849 - protein, 254 aa, Brassica napus
MARKFFVGGNWKCNGTAEEVKKIVNTLNEAQVPSQDVVEVVVSPPYVFLPLVKSILRPDFHVAAQNCWVKKGGAFTGEVSAEMLVNLDIPWVILGHSERRALLNETNEFVGDKVAYALAQGLKVIACVGETLEQREAGSTMDVVAAQTKAIADRVSNWSDVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 15850 - protein, 373 aa, Archaeoglobus fulgidus DSM 4304
MREAARLSQISTSMIRRMFEIVERAKKEGREIISLTIGEPDFDTPQEVIERACRAMNAGFTHYTSNFGLEELRSAIAERYGVDSSNVMVTAGGSEALLNASLAFIEEGSKVVIPSPNFLSYFTYAKMCGGQIVQLRTHNNGFLPDVEKLNEIIDRNVSVIFLNYPNNPTGAVIDEKDARAVVEIAADNKAIVVSDEIYDQIYYDVKPTSLAGYENVVCVNGFSKSLSMTGWRIGFTIADEKLLDPMLKVHQVNGVCAPAFAQKAVAEVMAERLFDSIVSRMVKEFRQRRDYLYSELSKIYDVVKPEGAFYMFVNVNQDCMEYAENLINLGVAVTPGLPFGDGNETYVRISYANSLENLKKAAEIIREYESQRA

SEQ ID NO: 15851 - protein, 320 aa, Glycine max
PTRPPTRPGNPNNNNLFDGCQGESDHWSELDTDLYHWTKALRPVQWFPGHIAKAEKELKEQLKLMDVVIEVRDGRIPMSTSHPQMDLWLGNRKRILVLNREDMISTADRNAWADYFTRNGTKVVFSNGQLGMGTMKLGRLAKELAADVNVKRRSKGLLPRAVRAGIVGYPNVGKSSLINRLLKRRMCPAAPRPGVTRELRWVRFGKDLELLDSPGILPMRISDQSAAIKLAICDDIGERSYDVADVAAILVQMLSKLPTVGRDALCKRYKIDVDCRDGRIFIEKLAVRVFNGDVHQAAFRVLADFRKGKFGWTALERPPK

SEQ ID NO: 15852 - protein, 475 aa, Helicobacter pylori J99
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 15853 - protein, 253 aa, Streptomyces avermitilis MA-4680
MADAPYKLILLRHGESEWNAKNLFTGWVDVNLNEKGEKEAVRGGELLKDAGLLPDVVHTSLQKRAIRTAQLALESADRHWIPVHRSWRLNERHYGALQGKDKAQTLAEFGEEQFMLWRRSYDTPPPPLADGSEFSQSDDPRYASIPPELRPKTECLKDVVNRMLPYWYDGIVPDLLTGRTVLVAAHGNSLRALVKHLDGISDEDIAGLNIPTGIPLSYELDTDFKPLNPGGTYLDPDAAAAAIEAVKNQGKKK

SEQ ID NO: 15854 - protein, 74 aa, Arabidopsis thaliana
  misc_feature (27)..(27): Xaa can be any naturally occurring amino acid
  unsure (1)..(74): unsure at all Xaa locations
QAGARFAIWRVVLIIGHNEPSEHSIRXNAYCLAIYAVICQENGLVRIVESEMQVDGSHDIHKCAAVTDRVHAAC

SEQ ID NO: 15855 - protein, 472 aa, Gloeobacter violaceus PCC 7421
MAKTPDDVLKMIQDEDVKIVDLKFIDLPGTWQHCSFATNQIDADAFAEGIPFDGSSIRGWKAINESDMLMVPDPSTAFIDPFFKETTLSLTCSIREPRTGEPYGRDPRTIAAKALEYLKGTGIADTAYFGPEAEFFIFDDVRFDQTQNAGYYYLDSVEGNWNTGRNEGPNLGYKPRNKEGYFPVAPTDSMQDIRTEMLLTMGSLGVPIEKHHHEVASGGQAELGVRFLSMVEAADALQIYKYVIKNVARKHGKVATFMPKPIFNDNGTGMHTHQSLWKDGQPLFAGDKYADLSEMALYYIGGLLKHAPAILAFSNPTTNSYKRLVPGFEAPVNLAYSQGNRSASIRIPLSGKSPKAKRLEFRCPDASSNAYIAFAAMLMAGLDGIKNKIDPGEPLDVDIYELSAEELAKVPSTPGSLSEALKALEEDHAFLTEGGVFSEELINVWIEYKLEKEVIPMSLRPHPYEFSLYFDV

SEQ ID NO: 15856 - protein, 141 aa, Bdellovibrio bacteriovorus HD100
MSIEQTFSIIKPNAMKKNAIGDIVSMFEANGLKIAAAKITVLTTAKAEEFYAEHKARPFFGELVSFMTSGPVMLMCLQGEGAVLKNREIMGATDPKKANPGTVRAKFGDNVGENAVHGSDSPESAARELALFFEKHEICNV

SEQ ID NO: 15857 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNQKTHTYICGLRGMEEGIDAALSAAAAKEGVTWSDYQKDLKKAGRWHVETY

SEQ ID NO: 15858 - protein, 601 aa, Schizosaccharomyces pombe
MSGRRNETAIRELVQSVSGNNLCADCSTRGVQWASWNLGIFLCLRCATIHRKLGTHVSKVKSISLDEWSNDQIEKMKHWGNINANRYWNPNPLSHPLPTNALSDEHVMEKYIRDKYERKLFLDENHSTNSKPPSLPPRTKSSSQSSPMASTSTSKSRYADSLSTLHDMGFSDDSVNTHALEETNGDVTRAIEKIVQHGSSKPQKPSTLTSTKSTIKLVSARLKKRNKNLSVHFEDGTKPGDAYEVTGDTRAASPTLNPFEQMMAMTNQGMSVSPGVETTSSPFFTAPVEPNQPLQPLRPSMTGPVPSSMGSEATLNMPSTYGIDSNLYTNSNSSSIVQNPLQPARTGPAAINYNYTTNYSVSSPSVTNPFFDVGSSTQNASLMGSTGYPSSANNVYYENSYQGVGTSMSDNYQLPDMSKLSLNEQPAAPSNSNSQYMNTSMPTLDSTNMYGQSNQDPYSMSNGVYGSNYSAQPSTMQMQATGIAPPQPNMSMQMPMSMQSTGYQMPMENTWVDYNGMSQQGNGMQPATMNYSNSMGYDTNVPADNGYYQQGYGNVMMPPDASYTGTGSYVQPMNQPSGGMGAPADSSKADSYIQRIMQGKQ

SEQ ID NO: 15859 - protein, 262 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGDDAHKTNGSAKPGAGGDDAE

SEQ ID NO: 15860 - protein, 326 aa, Zea mays
VDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 15861 - protein, 594 aa, Novosphingobium aromaticivorans DSM 12444
MAGNLEPTTALSDALVILGAAGIIIPAFARFRITPIIGFILVGLVVGPFGLGSLVPQYPWLYHVTISDPAAITPFAEFGIILLLFEIGLELSFNRLWDMRRLVFGLGAMELGVSAFLLSAVLLGTGLNISGAFGLGLALALSSTALVLPIAGTHGPVGRAALSMLLFEDIALVPIIFILGAMGPVAAHSDGPSLGETLLYGGIVVAVLLVGGRLLLPRLFAQAAQTKSPELFLAATMLVVIAAALSTSLVGLSPIMGALLAGLLIAETEYHTEVESITKPFKGLALGVFLITIGMGIDLRVVWEQIGPLALAVTGVVVLKALVTMFALRAMGKERATALEAGILMASPSETTLIVLATAAEASLIDRETAQFWQIVTAIGLTITPLLAKVGETWGRRVAKGGADAGQAVAVEEPEGERVVVMGFGRVGRLVADMLSVHGASWLGIDTDPAIVKRARNDGLPVLFGNVDSETAIERLGLDNARAMILTMDEPVLVVRMVKKLRSGHPDLPIIVRARDTAHAAELYKAGATHAVPETLESSLQLSEAVLVDLGFPMGLVIASIHEKRDEFREQIMEEGGLTEKPRLKSASLRERSA

SEQ ID NO: 15862 - protein, 427 aa, Mycobacterium avium subsp. paratuberculosis K-10
MRYRPGEALLALYRRRGPVIDAGAGRHGYTLLLGAEANKFVFANADAFSWRATFENLALVDGPTALIVSDGDDHRRRRSVVAPGLRHRQIQDYVTTMVSCIDRVIDGWRPGQRLDVYQHCRAAVRRSTAESLFGPRLAVHSDALGEHLQPLLDLTHQPPQLVGLQRRINAPAWRRAMAARQRINNLVDTLIADARAAPNPNDHMLTMLIDGRGDEGYTLSDNEIRDAIVSLVTAGYETTSGALAWAVYLLLSQPGAWATAAGEVRRVLAGLPPAAADLSGLTYLNGVVHETLRLYPPGVISARRVMRDLRFKGRRIRSGRLLIFSPYVTHRLHEIWPEPRRFAPERWNPDAPGYRRAAPHEFIPFSAGLHRCVGAAMATTEMTVMLARLLARTRLRLPAQRLRAANVAALRPTPGLTVEVIDSVPAQ

SEQ ID NO: 15863 - protein, 144 aa, Zea mays
RSFRRSYLHCELSLKMILVQLRDVPVMDGFICLSHTCSLHAEKFHEIYNFAFAWAREKGQKSLALETAIGMWQLLFAERSWPLIDYWCQFLQVRHNKAISRDTWAQLLEFVKTIDPQLTNYDEEGAWPYLIDEFVDYLKENGLA

SEQ ID NO: 15864 - protein, 348 aa, Ustilago maydis 521
MGAEDYSPPATDIITLTRHVLTEGFKLRTESAASGDLTILLSSLQTTCKFIESNVRKASLINLIGAAGNTNVQGEDQKKLDVLSNEIMINALRASGKTAVLVSEEDDEAIFVGEKEEGGTFESTKGKYCVVFDPLDGSSNIDAGVNIGTIFGIYLVKEGSKGTLEDVLRPGREMVAAGYCMYGSSANLVLTTGNGVNGYTLDNQIGEFILTHPNIRLPSRGKIYSVNEGNSMYYYEPVLKYLDSIKYPKGEGAKPYSARYIGSMVADVHRTLLYGGIFIYASDKKSKDGKLRMLYEAFPMAFITEQAGGLATTGTQRILDIQPTSIHQRCPVFLGSKDDVEDLMKCFQ

SEQ ID NO: 15865 - protein, 207 aa, Zea mays
  misc_feature (54)..(54): Xaa can be any naturally occurring amino acid
  misc_feature (72)..(72): Xaa can be any naturally occurring amino acid
  misc_feature (121)..(121): Xaa can be any naturally occurring amino acid
  misc_feature (126)..(126): Xaa can be any naturally occurring amino acid
  unsure (1)..(207): unsure at all Xaa locations
MITMIDNAAYPRPAHQAIPAAEVLTGTTEQRLSSIRVHKADDNRRGLPDLLFCXHGDLKQIPGEIHFDQSLXHKTNQVNPFEDVSRRQKPPSTQAEKQPLTGAAADHETTTSGHDDIAMRXSKYYXTPARCAIRRRVLKIGPNESSQLAIDLNAQGLSRYAIICQENGLMPIVEPEILADGPHDIDRCAYVTETVLAACYKALNEHH

SEQ ID NO: 15866 - protein, 374 aa, Chlamydomonas reinhardtii
MALMMKSSASLKAVSLAALAAPSLCAPGKYDEELIKTAGTVASKGRGILAMDESNATCGKRLDSIGVENTEENRRAYRELLVTAPGLGQYISGAILFEETLYQSTASGKKFVDVMKEQNIVPGIKVDKGLVPCPTPTMSWCMGLDGWTSAAEYYKAGARFAKWRSVVSIPHGPSIMLPRLAYGLARYAAIAQNAGLVPIVEPEVLLDGEHDIDRCLEVQEAIWAETFKYMADNKVMLQGILLKPAMVTPGADCKNKAGPAKVAEYTLKMLAARAPPVPGIMFLSGGQSELESTLNLNAMNQSPNPWHVSFSYARALTNTVLKTWQASPRTVQAPRLAAQARKANSDAQQGKYDATTEGKEAAQGMYEKGKGYVY

SEQ ID NO: 15867 - protein, 263 aa, Neisseria meningitidis MC58
MITVNTLQKMKAAGEKIAMLTAYESSFAALMDDAGVEMLLVGDSLGMAVQGRKSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDDAGAAVVLMECVLAELAKKVTETVSCPTIGIGAGADCDGQVLVMHDMLGIFPGKTAKFVKNFMQGHDSVQAAVRAYVAEVKAKTFPAAEHIFAD

SEQ ID NO: 15868 - protein, 154 aa, Neurospora crassa
MSNQEQTFIAVKPDGVQRGLVGNIISRFENRGFKLVAMKLTQPGQVHLELEKHYEDLNTKPFFAGLIKYMNSGPICAMVWEGKDAVKTGRTILGATNPLASAPGTIRGDFALDMGRNVCHGSDSVENAKKEIALWFKPEELNQWNHHSAAWIFE

SEQ ID NO: 15869 - protein, 97 aa, Brassica napus
MTEVLHFPSSPSASSSSSPSPSNATLLITSDHRRRSPVPPGFPQDVDFHRFNRTTTASRGRLELWPAPHMKNLPIPRPRFLLPLPPPLTKSPLVAHP

SEQ ID NO: 15870 - protein, 290 aa, Streptococcus pneumoniae R6
MRIADYSVTKAVLERHGFTFKKSFGQNFLTDTNILQKIVDTAEIDDQVNVIEIGPGIGALTEFLAERAAQVMAFEIDHRLVPILADTLRDFDNVTVVNEDILKVDLAQHIQNFKNPNLPIKVVANLPYYITTPILMHLIESGIPFSEFVVMMQKEVADRISAQPNTKAYGSLSIAVQYYMTAKVAFIVPRTVFVPAPNVDSAILKMVRRPEPAVAVEDENFFFKVSKASFTHRRKTLWNNLTGYFGKTEEVKDKLTKALDQAGLSPSVRGEALSLAEFAGLADALKGQGL

SEQ ID NO: 15871 - protein, 484 aa, Staphylococcus aureus subsp. aureus MRSA252
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 15872 - protein, 177 aa, Triticum aestivum
MAAAVPNGHPSADGDDSPPSPPPSSSSSSLVFLGTGCSSAVPNARCLIQPSDPPCAVCSQSLSVPPEVNPNYRCNTSLLIDYCQDEGAHKYIIIDVGKTFREQVLRWFVCHKIPCVDSIILTHEHADAILGLDDIRVVQPFSPTNDIDPTPIYLSQYAMDSISQKFPYLVKKKLKEG

SEQ ID NO: 15873 - protein, 339 aa, Psychrobacter arcticus 273-4
MYDVMAIGNALVDHEYLLSDAALEETDLTKGHMTLAGIEEQQQLLAYFKLAEIEPSKQAGGGSAANAMVAFSSLGGKPFYACRVGDDKQGEFYLKDLHEAGVTTSPQSIHAGGVTGSCVVAVTEDGERTMQTFLGTSSDITADNVDFNALTQAEWLYLEGYLAMSAGIQPAMDQLRQQAGVNGAKIAVSFADPAVVKFAKDGLLNMLGNKVAMIFCNSEEARLFTDETQYKSAARALLQHCQTAVVTDGANGAVIAHQPNDESDIEIYDIPTPAVDNVIDTNGAGDNYAGAFLYALSQQYSLPECGHLASAVAAQVIQQFGPRLASKDYQDIAKRVLSA

SEQ ID NO: 15874 - protein, 442 aa, Moorella thermoacetica ATCC 39073
MVDSREAILQKATDLGVKFIRLQFTDIFGVLKNVAITLDQLPKALNNELMFDGSSIEGFVRIEESDMYLRPDPSTFTIFPWKPNGDAVARLICDVYNADGTPFIGCPRGTLKRVIAEAEALGYTMNVGPEAEFFLFHTDATGRPTLETHDRAGYFDLTPVDLGEDARRDMVLTLQQMGFEIEASHHEVAPGQHEIDFKYADALRTADNIATFKFVVRTIAQRHGLHATFMPKPIYGIAGSGMHCNISLFRAGQNAFYDPDDDLQLSQVAYYFIGGLIAHARGMTAITNPTVNSYKRLVPGYEAPVYIAWSPQNRSPLIRIPAKRGLSTRLEVRHPDPSTNPYLAIAVMLKAGLDGIKNRIQPPAPINANIFDMEATRLRAEGIDLLPGTLDEALDALEKDPVIREALGPHIYQRFMEAKRIECEEYRTRVHQWEIEHYLTKF

SEQ ID NO: 15875 - protein, 206 aa, Oryza sativa
  misc_feature (31)..(31): Xaa can be any naturally occurring amino acid
  misc_feature (118)..(118): Xaa can be any naturally occurring amino acid
  misc_feature (186)..(186): Xaa can be any naturally occurring amino acid
  unsure (1)..(206): unsure at all Xaa locations
WNQKNLFCGWYDADLSEKGNEEAKQAGKWLXEKGYTFDIAFTSVLKRAIKTLYNIQQELDLHWIPVQRHWRLNERMYGALQGKNKSETAAKYGEDQVKIWRRAYDIPPPELEESSEYXPRTDSKYKNLDPRVLPLTECLKDTVDRALPYWHDAIVPAIRSGQKVLIAAHGNSLRALIKYLDKVPDXEIVETHLPTGIPLVYELDAI

SEQ ID NO: 15876 - protein, 151 aa, Synechococcus sp. RS9917
MAERTFIAIKPDGVQRGLVGEILGRFERKGFKLVGLKQLTPSRELAEQHYGVHKERPFFAGLVDFITSGPVVAMVWEGDGVIASARKLIGATKPLEAEPGTIRGDLAINIGRNVIHGSDAPETALFEIGLWFQPSELSDWSPSDQGWRTEG

SEQ ID NO: 15877 - protein, 308 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 15878 - protein, 739 aa, Nicotiana tabacum
MSSKNLFSFLFLLVLPFSSSSDATAWIKSGFWYAGSEFPVPEIPSTMFTHIHFAFAYINASSFELYVSHSDEPYISTFSNTVKQKNPSVITLLSIWGGRDESPNFFAMTSQFSRRKSFITTSIKTARQYGFQGLDLIGVNPNTDANMTNMRSFIEEWRTAINSESKSSGTRTLILTMGAYYSPMLDSMSYPIDTIIRNFDWVHLKAYAALYDPTSKLNTDYGIKEWIKRGLPANKIVLGLAYHGYAWTLVNPKHNTVRTPARGLAITQDGSISYRYIKQYMKSYGVTPVYNSTFVVNYVTIGSFWIGYDDVEAIRTKVSYAKDKGLLGFAAFQIPSDDVNWELSKTAQDEEEEDQSGSNRRLLAILLPTLTLTILLLSTIVFILKKKTLRSEGIRELNERAIGHNLKVFKFDKIKAATDNFSIKNKLGEGGFGPVYKGRLSDGQEIAIKRLSAYSKQGVEEFQNEVTLASKLQHVNVLQLQGCCTEREEKILIYEYMPNKSLDFYLYDPVQSLQLDWETRVRIIEGVTQGLLYLQEYSAFTVIHRDLKASNILLDDEMKPKISDFGIAKLFQKDEKEANTGRIVGTYGCVPPEYVKRGLYSRKYDVYSFGVLLLQILGEKKNSSEYGIKNDLNLLEYAYELWEKGNGVDFLDLSLQDDSRIGKQLRYMQAALLCVQEKWEDRPSMLEVYSMLKNETEVLPNPKVPAFSKNKDNDTQETLVTPDLTCSDNSLTISQLIAR

SEQ ID NO: 15879 - protein, 652 aa, Vibrio parahaemolyticus RIMD 2210633
MTGIFLQAFVYLVAAVIAVPLAKRLGLGSVLGYLIAGVVIGPIIGLVGEETTTIQHFAEFGVVMMLFLVGLELEPKMLWAMRNRLMGLGGLQVGGTVAAIMGIALYFEQPWTIALAIGLIFALSSTAIVLQTFSEKGLTKTEGGKNAFSVLLFQDIAVIPMLAFIPLLALPELVEQAQNAVQTAAQHHDDLNLVADLPGWAYGIVITASIAIVVVGGHFLSRPLLKYVASSGLREIFTATALMLVIGIAALMSLVGLSPALGTFLAGVVLANSEFRHELESNIEPFKGLLLGLFFITVGAGINFSVLFGDFWLIMALTIGVMVLKALVLFILALIFRVKGSNRWLFTLSLAQAGEFGFVLLSFSVQNHVIPFELSQTLALVVAISMFLTPGLFILFDRVILPRFETQSNERESDTIEETGTVIIAGIGRFGQIVNRLLVSNGVTTVVLDHQANQVDNMRQIGTRAYFGDATRPDMLHTAGIEHAAALVVAIDNQESSVELVKYVKHTYPKVKIIARAFDRGHGYLLRQAGADVIESETYHSALEMGGHAMKALGIHPFFVEQQKDTYKRVEARKSEMLYQAWEDDSEGERFDNNFRELFIQLEEKMAEEMRKDRHDKLSRSERGWTPPPKGYAENFDGENVQDITPPKEEAI

SEQ ID NO: 15880 - protein, 149 aa, Desulfitobacterium hafniense Y51
MEKTFIMLKPDAVQRGLVGQIIARFETKGCKLVGMKLMSVDQALAEQHYAEHKGKSFFEPTVQYIMSSPVVAMVWEGKNVVALARELMGATNPANANPGSIRGSFGMDISRNVIHGSDSVASAEREIALYFRPEELCDYRKAGEEWLSE

SEQ ID NO: 15881 - protein, 178 aa, Glycine max
MASSMISSPAVTTVNRAGAGMVAPFTGLKSMAGFPTRKTNNDTISIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 15882 - protein, 156 aa, Triticum aestivum
  misc_feature (110)..(110): Xaa can be any naturally occurring amino acid
  unsure (1)..(156): unsure at all Xaa locations
MEASGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLXGVTIAHGGVIPKINPVLLPKRTAEKEGKEPKSPKKATKSPKKTTKA

SEQ ID NO: 15883 - protein, 220 aa, Bacillus cereus E33L
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIIDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 15884 - protein, 237 aa, Methanocaldococcus jannaschii DSM 2661
MEIIHLSEIDSTNDYAKELAKEGKRNFIVLADKQNNGKGRWGRVWYSDEGGLYFSMVLDSKLYNPKVINLLVPICIIEVLKNYVDKELGLKFPNDIMVKVNDNYKKLGGILTELTDDYMIIGIGINVNNQIRNEIREIAISLKEITGKELDKVEILSNFLKTFESYLEKLKNKEIDDYEILKKYKKYSITIGKQVKILLSNNEIITGKVYDIDFDGIVLGTEKGIERIPSGICIHVR

SEQ ID NO: 15885 - protein, 746 aa, Triticum aestivum
  misc_feature (241)..(241): Xaa can be any naturally occurring amino acid
  misc_feature (432)..(432): Xaa can be any naturally occurring amino acid
  misc_feature (434)..(434): Xaa can be any naturally occurring amino acid
  misc_feature (481)..(481): Xaa can be any naturally occurring amino acid
  misc_feature (509)..(509): Xaa can be any naturally occurring amino acid
  unsure (1)..(746): unsure at all Xaa locations
MEVLCIGTADTKLEELLFLATRLRSSLAASAPKVKVSIVDVSTTKTVPTQDSKDIAVIARDTVLSCYPDSSQQDLPDDRGEAIALMSKALQSFLKNRYEAGTLVAAVGLGGSGGTALIAPALRSLPLGVPKLIVSTVASGNTAPYVGTSDLVLFPSVVDICGINSVSRVILSNAASAVAGMVYGILMASNESDETDTKLTVGITMFGVTTQCANAVKDRLNKEGYETLVFHATGVGGKAMXEELVRGGFIQGVLDITTTEVADYIVGGIMACDETRFDAVIDKKIPLVLSVGALDMVNFGAHDTIPAAFSDRKIHIHNEQISLMRTTVEENKKFAQFIADKLNKSLSTVTVCLPQKGISAIDAPGMPFYDPEATSALLDELNTRLVKTENRQLKLLPYHINDPEFANALVDAFLSMDIKASSAITQKNNMVXQXQDTNEKESSSGQKTSDSSIIWRPPVDFPDARPETLQKTKSILHKVKXKSGEGIPVIWSRVLGTGHIRRRSEEPGXGVILIVLYNSGRFRMAGRGSLAGLLPFADANAIVLEMANEVLPVVKEVPVLAGVCATDPFRRMDYFLKQLEAIGFCGVQNFPTVGLFDGNFRQNLEETGMGYSMEVEMISRAHSMGFLTTPYAFNPEEGAAMAKAGAHIVVAHMGLTTAGSIGAKTAATLDDSVARVQAIADAAVGVNPDIIVLCHGGPISGPREAEFVLKNTNRVHGFYGASSMERLPVEQAITNTMREYKRMSLK

SEQ ID NO: 15886 - protein, 272 aa, Pseudomonas fluorescens Pf-5
MNTTRIAFIGAGNMAASLIGGLRAKGLEASQIRASDPGEQTRAKVAAEHGIQVFADNAEAIEGVDVIVLAVKPQAMKAVCQALRPSLKPQQLVVSIAAGITCSSMNSWLGAQPIVRCMPNTPALLRQGVSGLYATAEVSAQQRQQAEELLSAVGIALWLDQEQQLDAVTAVSGSGPAYFFLLIEAMTAAGEKLGLPRETAAQLTLQTALGAAHMAVSSDVDAAELRRRVTSPAGTTEAAIKSFQAGGFEALVEKALGAAAHRSAEMAEQLGQ

SEQ ID NO: 15887 - protein, 324 aa, Burkholderia vietnamiensis G4
MKTMKPRIVAYKPLPDDVLVYLREHAEVIRADGADALADALGEADGAIGASLKITPQMLDRAPRLKAWSTISVGYDNFDVADLTRRGIVLAHTPDVLTESTADTVFSLILASARRVVELAEWVKAGHWQRSIGPELYGTNVQGKTLGIVGLGRIGGAVARRAALGFRMQVLYTNRSAHAEAEQQYGARRVTLDELLAQADFVCLQVPLSPQTHHLIGAAEFAKMKRGAILINASRGPVVDEAALIDALRAGTIRGAGLDVFEKEPLSADSPLLRMSNVVALPHIGSATHETRHAMARCAAQNLVGALAGTLRTNLVNPDALAHA

SEQ ID NO: 15888 - protein, 268 aa, Olea europaea
RATMIMRMKAKIQGLEEQMNSINEKSSKYGQIAAEEVPKSLYCLGIRLSTEWYKNSNLQRKLRGRREAAIKLKDNNLYHFCVFSDNILATSVVVNSTALSSQNPNKVVFHLVTDEVNYAAMKAWFAMNNFKGVTVDVQKIEEFTWLNASYVPVLKQLQDSDTRNYYFSGSTGDSRTPIKFRNPKYLSMLNHLRFYIPEVYPELKKVVFLDDDVVVQKDLSGLFSIDLNGNVNGAVETCMETFHRYHKYLNYSHPLIREHLDPDACGCA

SEQ ID NO: 15889 - protein, 122 aa, Photobacterium profundum SS9
MYYYLILNVIYRTLHTIVIPLFIRNIRLSIMASTAAALHILVKHQEKAEDIIEQLKKGAKFQTLAKKYSNCPSGKSGGDLGEFRKGQMVPQFDKVCFTGELLTPHLVKTKFGWHIVKVLYRT

SEQ ID NO: 15890 - protein, 440 aa, Listeria monocytogenes str. 4b F2365
MSYLTEKLREEKVFKDPVHGYVHVSDKIIWDLIATKEFQRLRRIHQLGTTSLTFHGAEHSRFNHSLGVYEIVRQIIDVTFANEPQLDPEERMVALCAALLHDLGHGPFSHAFEKVFGTDHESYTQEIIIGDTEVNKILMRAGEEFPLKVAAIIKKNYPNQTLVKLISSQIDADRMDYLLRDAYYTGVSYGKFDLERILRVLRPSPDGNGVIVKYSGMHAVEDYIMSRYQMYQQVYFHPVSRSGEVLLWKILERAKKLYCAGYEFQATPIQVLPFFLNEVSLKDYIVLDDIVLMYYFSIWQEEEDPILSDLCSRFLNRRLLRYINYDPKEDAELYAELKGLLEKADIDPSYYLVIDSSSDLPYDYYLPGVGSGKDPIKLLMGNGELRELSTESPVVEAIGRERRTDIKLYYPLDFIESGHVEEAITERMIALIHAHSLKEK

SEQ ID NO: 15891 - protein, 404 aa, Streptococcus pneumoniae R6
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDIDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 15892 - protein, 387 aa, Bacillus anthracis str. 'Ames Ancestor'
MEQFINPRVKDIQISGIRQFSNMIQNYDNLISLTIGQSDFPTPSLVKEAAKRAITENYTSYTHNAGLLELRKAACNFVKDNYDLHYSPETETIVTIGASEAIDVAFRTILEPGTEVILPAPIYPGYEPIIRLCGATPIFIDVRETGFRLTAEALENAITEKTRCVVLPYPSNPTGVTLSKKELQDIADVLKDKNIFVLSDEIYSELVYEQTHTSIAHFPEMREKTIVINGLSKSHSMTGWRIGLLFAPSYLAGHILKVHQYNVTCATSIAQYAAIEALTAAKDAPKMMRHQYKKRRDYVYNRLIQMGLTVEKPTGAFYLFPYVGHLTSSSFDFALDLVKEAGLAVVPGTAFSEYGEGYLRLSYAYSIETLKEGCDRLEAFLQQKAKS

SEQ ID NO: 15893 - protein, 394 aa, Nicotiana sylvestris
MTTKNRQIKNFTLNFGPQHPAAHGVLRLVLEMNGEVVERAEPHIGLLHRGTEKLIEYKTYLQALPYFDRLDYVSMMAQEHAYSLAVERLLNCEVPLRAQYIRVLFCEITRILNHLLALTTHAMDVGALTPFLWAFEEREKLLEFYERVSGARMHASFIRPGGVAQDLPLGLCIDIDSFTQQFASRIDELEEMLTGNRIWKQRLVDIGTVTAQQAKDWGFSGVMLRGSGVCWDLRKAAPYDVYDQLDFDIPVGTRGDCYDRYCIRIEEMRQSVRIIVQCLNQMPSGMIKADDRKLCPPSRSRMKLSMESLIHHFELYTEGFSVPALSTYTAVEAPKGEFGVFLVSNGSNRPYRCKIRAPGFAHLQGLDFMSKHHMLADVVTIIGTQDIVFGEVDR

SEQ ID NO: 15894 - protein, 236 aa, Bacillus cereus G9241
MKKYAFITGANKGIGYELVRQLAEKDYHVFLGARNKQLGQQAVESLHVSNVSYIQVDISSSQSIQEAMKKIHETTDHLDLLINNAGIALDFNTLPSELNIETLRQGFEVNFFGTFQMMQAFLPLLKKSSKSKIINVTTDMASLTMFANGETHPINALGYNSSKTAINALTLAFSKEFSTSGPEIFGVTPGFTTTDLNGNSPGGHTTNESAKIIIKYALSETNYNGKILNKDGIITW

SEQ ID NO: 15895 - protein, 141 aa, Photorhabdus luminescens subsp. laumondii TTO1
MTVERTFSIIKPNAVKKNAIGAIYARFESAGFKIIAAKMLHLTREQAEGFYAEHKGRPFFDGLVEFMTSGPIVVQVLEGENAVQRHRDLMGATNPDNALAGTLRADYADSFTENAVHGSDAVESANREIAYFFTEDEICPR

SEQ ID NO: 15896 - protein, 572 aa, Streptomyces coelicolor A3(2)
MTVNEPVPDTFEDTPAGDRHPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRKNPDGPYGDYYVWADDDTRYADARIIFVDTEASNWTHDPVRGQYYWHRFFSHQPDLNYENPAVQEEMLAALKFWLDLGVDGYRLDAVPYLYAEEGTNCENLPASHAFLKRVRREIDAQYPDTVLLAEANQWPEDVVDYFGDYSTGGDECHMAFHFPVMPRIFMAVRRESRYPVSEILAKTPAIPSGCQWGIFLRNHDELTLEMVTDEERDYMYAEYAKDPRMRANIGIRRRLATLLDNDRDQIELFTALLLALPGSPILYYGDEIGMGDNIWLGDRDAVRTPMQWTPDRNAGFSTCDPGRLYLPAIMDPVYGYQVTNVEASMASPSSLLHWTRRMIEIRKQNPAFGLGTYTELPSSNPAVLAFLREYEDDLVLCVNNFARFAQPTELDLREFAGRHPVELFGGVRFPAIGELPYLLTLGGHGFYWFRLTRVASRIGRRA

SEQ ID NO: 15897 - protein, 416 aa, Helicobacter pylori J99
MENSTLYIVIAGLWLAVGFGIFLKKLDMPVIIGYICTGTVLAAFFKINDFNLLSDIGEFGIVFLMFMIGIEFNFDKLKSIKQEVLVFGLLQVVLCALIAFLLGYFVLGLSPIFSLVLGMGLSLSSTAIVLKFFEDSKQLSTPMGKSAVGILIFQDIAAIPMLLILTILGSKDSHVNLLILKTLISAGIILILLLLPGKKGANLILEQAKDTRLPEIFIGTVLVIVCSAAGLSHFFGFSMSLGAFIVGMAISKSRYKINVQEEFAQLKNLFLALFFITIGMQINVSFFMEKFFVVIFLLILVMSFKTFIIYALLRFFRDAKTAIKTALSLAQIGEFSFVIFLNSGSHQLFNLQEKKGILGFLHQKNILNIAQNDIHQLLILMVVFSMLATPFILKYLESIAQFILHQKSQENEPAKK

SEQ ID NO: 15898 - protein, 465 aa, Mesorhizobium loti MAFF303099
MHLPNAWTGALPARSLATPKELDVAGAQAFLEQADVRYVLAQFVDLYGVAKSKAVPVQHLDCLLTEGAGFAGGAPCGLGLLPHEAEYMVVCELDTLTVTPWAPGYARMLGVGTVKGAPHPVDTRNVLKTQVASLAERDWTLNTGLEPEFLLLRREPDGKLSPFDRTDTLTKPAYDYRGLMRGRNVLERVTECLQAVGIDVYQIDHEDANGQYEINFKYADALKTADQIVFFKMAVSEIAHDLGAICSFMPKPRSSSTGNGMHIHCSIADGDGRNLFHDDADPNGMGLSKLAYHFLGGVLAHAKGLTALLAPTVNSYKRLVVGGTVSGATWAPACIVYGYNNRTAMVRIPYGRLEIRTGDSSMNPYLATAALIAAGLDGIEQKLEPGAPRNVNFYGLTLEAIKEMGVDLLPQTLTEALDALEADQLFAGTLGKPVIEQFLSLKRSEWLEYHCHVSDWEVERYLNFF

SEQ ID NO: 15899 - protein, 294 aa, Oryza sativa
MAMVAGDEAMSVPWHDVGVVVDPEAAGTAPFDAGAGYVPSYGQCQYYYYYDDHHHHPCSTELIHAGDAGSAVAVAYDGVDGWVHAAAAATSPSSSSALTFDGHGAEEHSAVSWMDMDMDAHGAAPPLIGYGPTAATSSPSSCFSSGGSGDSGMVMVTTTTPRSAAASGSQRRARPPPSPLQGSELHEYSKKQRANNKETQSSAAKSRRERISERLRALQELVPSGGKVDMVTMLDRAISYVKFMQMQLRVLETDAFWPASDGATPDISRVKDALDAIILSSSSPSQKASPPRSG

SEQ ID NO: 15900 - protein, 1002 aa, Arabidopsis thaliana
MKLLLLLLLLLLLHISHSFTVAKPITELHALLSLKSSFTIDEHSPLLTSWNLSTTFCSWTGVTCDVSLRHVTSLDLSGLNLSGTLSSDVAHLPLLQNLSLAANQISGPIPPQISNLYELRHLNLSNNVFNGSFPDELSSGLVNLRVLDLYNNNLTGDLPVSLTNLTQLRHLHLGGNYFSGKIPATYGTWPVLEYLAVSGNELTGKIPPEIGNLTTLRELYIGYYNAFENGLPPEIGNLSELVRFDAANCGLTGEIPPEIGKLQKLDTLFLQVNAFTGTITQELGLISSLKSMDLSNNMFTGEIPTSFSQLKNLTLLNLFRNKLYGAIPEFIGEMPELEVLQLWENNFTGSIPQKLGENGRLVILDLSSNKLTGTLPPNMCSGNRLMTLITLGNFLFGSIPDSLGKCESLTRIRMGENFLNGSIPKELFGLPKLSQVELQDNYLTGELPISGGGVSGDLGQISLSNNQLSGSLPAAIGNLSGVQKLLLDGNKFSGSIPPEIGRLQQLSKLDFSHNLFSGRIAPEISRCKLLTFVDLSRNELSGDIPNELTGMKILNYLNLSRNHLVGSIPVTIASMQSLTSVDFSYNNLSGLVPSTGQFSYFNYTSFVGNSHLCGPYLGPCGKGTHQSHVKPLSATTKLLLVLGLLFCSMVFAIVAIIKARSLRNASEAKAWRLTAFQRLDFTCDDVLDSLKEDNIIGKGGAGIVYKGTMPKGDLVAVKRLATMSHGSSHDHGFNAEIQTLGRIRHRHIVRLLGFCSNHETNLLVYEYMPNGSLGEVLHGKKGGHLHWNTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELITGKKPVGEFGDGVDIVQWVRSMTDSNKDCVLKVIDLRLSSVPVHEVTHVFYVALLCVEEQAVERPTMREVVQILTEIPKIPLSKQQAAESDVTEKAPAINESSPDSGSPPDLLSN

SEQ ID NO: 15901 - protein, 294 aa, Escherichia vulneris
IVFRAAQERSDIEIVGINDLLDADYMAYMLKYDSTHGRFNGTVEVKDGHLVVNGKTIRVTAEKDPANLKWDEIGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGDMKGVLGYTEDDVVSTDFNGEICTSVFDAKAGIALNDNFVKLV

SEQ ID NO: 15902 - protein, 936 aa, Candida glabrata CBS 138
MTSFLFRRLTRRKKNKDPKEKNKEKSNRGNLRISKVPPPAEKYPTPPRAKNQYVIPTITDDPAVLNSPSTSVRIPRAPMFADIDYDNITERKAKRLSRTDRSVRYSHRHSSRRISMLISKLEEDKKKTVSLDSSDINVRYSFRDSALSRLQEVLDEANESPWGRTRLMSSPLPRYRHIASTYATPDNRIFVMGGLHGELVYGDTWMLTANSDSTNFTTQVIDLTVNTPPPRVGHAATLCGNALVIFGGDTHKLNSEGLLDDDLYLFNVDSHRWTIPTPIGTRPLGRYGHQVSVIATTPKKAKLYLFGGQLDDNYFNDLAMYDLSDFRNPHSRWQFLKSKAFTPPPLTNHTMVAYDYKLWVFGGSSRGELQNQLYVYIPDLNEWRCLETEGDKPQPIQEHSATIYKNLMCVFGGKNKDDEYQNTMYFLNLQTLKWYRLDTSHCNEPLPRSGQSMSLMQNDKILIMGGDKNDYCVNGANLNDIDEYDRGYGVASYTLDLKNLNDYCPGVFSIERPANLTHVAKNPEARYSMASPGPNILTPYLQQVRQLNRLLSTASMSPKTPSPMISKALPESSEKEDISKDQAENTSGSTQSPPAGLLGTSEAPQSGRSENESVFEDAFPASHLSESSSPQQSEISIVENKKQNNPFITNPLGTINSSIIELNKANTSQLPIEGTRSVILSQDTVEQLQQDLEELRIMEESNETVSDNKLKQLKMEIDNLRNKDVVEDTTKSTLDDLNEKFKRLEQGKDALRSKMSKLDSMFENNEHHKATEHTGYALLNLNSKASRNKDTDLDDSNQHLVSIDAEKVADELLLIGDKREDSSASDKSESFTLTESNQPETSNGDFIYNDANKNGKTSLERKTVPRKMPVDKKRVKRRTILFHSQKHKEMMEELTKQLDMLTYDSQEMASSEIDSNSSYKLENQMPVMPGNFPQTM

SEQ ID NO: 15903 - protein, 285 aa, Haloarcula marismortui ATCC 43049
MTTTETGTRDPDALVRRAGKRADTRQDQHFLVDDRVLDRIPEYATDADIDLSHVLEIGAGPGALTDRLLATAERVTAVERDPDFAAHLREEFTEEVAADRLTIVEGDALEVDLPDFTASISNLPYGASSEIAFRLLPEQRPLLLMFQQEFAERMAADPATDDYGRLSVTAGHYADVEVVETVPPEAFDPQPRVTSALVRTMPRTPDYTVPSDDFFMDFLKAVFTQRRKTMRNAVRNTAHISGLGDPDAVVEAADEGLMSARAGKLTPADFATLATLAYEVGQPEA

SEQ ID NO: 15904 - protein, 329 aa, Chlorobium tepidum TLS
MRRRPATIKRSTLMGFLSKIFGKKEVELKRPQVREDAALIKTLVGHEDRVLGVRFSPDGKKLVSGSFDEKVKLWDVETGNAIHTMSGHTTWVKCVDYSPKGDKVASGSIDSTVRIWDVATGQCLHVCKGHDTEVRMIAFSPDGKTVASCSRDTTIKFWDTETGNEVKTLFGHKSYIECIAFSADGKKLVSCGEEPVVKIWDLETGKNIANYPTGDTLSHFVSFSPDGSQIALCGRDAKVKVLDAATGQMLKVLEGHEDGVRALCYNPAGTLIASAANDESVRLWDVAKGALVHTYRGHTHEVQSVAFSPDGKVIASGSDDFKIKLWGVV

SEQ ID NO: 15905 - protein, 442 aa, Triticum aestivum
MPLNLASASSSSLRRSLFASLRKKISPMASAPASASAALSTAAPADNGAAKPAEQRPVQVAKRLEKFKTTIFTQMSMLAVKHGAINLGQGFPNFDGPDFVKEAAIEAIKAGKNQYARGYGVPELNSAVAERFLKDSGLQIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFVMVDHTPFGFDNDIEFCEYLIREVGVVAIPPSVFYLNPEDGKNLVRFTFCKDDDTLRAAVDRMKAKLRKK

SEQ ID NO: 15906 - protein, 472 aa, Bacillus cereus E33L
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKEAEMKDHPFKMPFAPVTNYLTIAFLIMVLIGMWFNDDTRISLVVGIIFLVIVTISFYAFGIGKRTPLDVQNDQEISSK

SEQ ID NO: 15907 - protein, 271 aa, Sulfitobacter sp. EE-36
MKDTRIAKDGLVLLGCGKMGSAMLAGWLARGLPTSSVYVIDPKPSDWLKEQGVQLNVDLPKEPAVVLVAVKPQMMGDALPTLQAMGNGKTVFVSVAAGTTIATFEKTLGEQTPIVRAMPNTPAAISQGITAIVGNNHVDAKGMDEAEELLSAVGDVVRLEEESQIDAVTGVSGSGPAYVFHMIETMAAGGIAQGLSPELALKLATATVAGAGALAKSADEGPDQLRVNVTSPNGTTQAALDVLMNEQDGFPVLLKRAVAAAADRSRELSNG

SEQ ID NO: 15908 - protein, 397 aa, Streptococcus pyogenes M49 591
MPKLSKRVLEMKESVTLAAGARAKALKAQGRDVLNLTLGEPDFFTPKHIQDKAIESIQNGTASFYTNASGLTELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 15909 - protein, 560 aa, Eschscholzia californica
MEKPILLQLQAGILGLLALICFLYYVIKVSLSTRNCNQLVKHPPEAAGSWPIVGHLPQLVGSGKPLFRVLGDMADKFGPIFMVRFGVYPTLVVSTWEMAKECFTSNDKFLASRPPSAASSYMTYDHAMFGFSFYGPYWREIRKISTLHLLSHRRLELLKHVPHTEIHNFIKGLFGIWKDHQKQQQPTGREDRDSVMLEMSQLFGYLTLNVVLSLVVGKRVCNYHADGHLDDGEEAGQGQKLHQTITDFFKLSGVSVASDALPLLGLFDLGGKKESMKRVAKEMDFFAERWLQDKKLSLSLSSETNNKQNDAGEGDGDDFMDVLMSILPDDDDSLFTKYSRDTVIKATSLSMVVAASDTTSVSLTWALSLLLNNIQVLRKAQDELDTKVGRDRHVEEKDIDNLVYLQAIVKETLRMYPAGPLSVPHEAIEDCNVGGYHIKTGTRLLVNIWKLQRDPRVWSNPSEFRPERFLDNQSNGTLLDFRGQHFEYIPFGSGRRMCPGVNFATLILHMTLARLLQAFDLSTPSSSPVDMTEGSGLTMPKVTPLKVLLTPRLPLPLYDY

SEQ ID NO: 15910 - protein, 312 aa, Zea mays
MQGGSSGIVYGGLKYQARCIADVRADASSTTFLAGTLSLKEENEVHLIRLSPAESELVCDGVFYHPNEIWDLKSCPFDHRVFSTVYTSGEGFGASVWKIPELNGQSNSPRLEQLFELSGHTGKIRRVIWWPLGKHDKLISIDDRNIFLWNVDMSNKSAKVISQGSADMLPNLSGGAWDPHNHNSIASISDSSLHLWDLRSMEKSSAIEHAHIRDVDYNPKKQHVIATTEDDFGIRLWDLRMLKLPLKDLPGHSHCPSGSPNRQEEPLLNSYTDYEDSIYGIAWSSHDPSLFASLSYDGRVVLESVKPYLQRK

SEQ ID NO: 15911 - protein, 260 aa, Haloarcula marismortui ATCC 43049
MAGEEPITMLTAYDAVTASIVDDTGVDVILVGDSMGNAVLGHDDTLPVTLDEMASRVGAVARGADDALVVADMPFLSFGAHESESIQNCGRMLKEEGANAIKLESGPHTVELTERLTELGIPTMAHLGLTPQSVNQTGYTRQATGREEAEEILDLAREHEAAGAFALVLEHIPANLAAKVTEAVDIPTIGIGAGGDCDGQVLVFTDVVGLSESSPPFAEQFGDVRGEVADAVDEYIDAVESGEFPRESHSHTEDELDDLY

SEQ ID NO: 15912 - protein, 349 aa, Gibberella zeae PH-1
MSPLWVRRLCIRVVDSLYGSFLYLPLAILFLKRSVTGFGTGEWDESQIPKLDGKVAVVTGGNAGIGYYTVKHLASRGAKVYLGARSESRAKAAIKRLLEENPLIPQENVVWLRLDLANQSQVVDAAVELQSKEQRLDILVNNAGIDPYDYIRTADGFEMTMAVKYTNPAAAAQEESDVRVITVSSSGEAYSSPTNQFTSPKDLDDPCASPGWENSCLGQAMRYGTTKLANVLFASELQRRMDEEDANIISLSLNPGTVRTDGAANVMPFMVRPLVRFLFTAPERGADTSLFAATAEEIKENSERWKGRYLDGPGRIKVPSLRARDAVAGRNLWNITEAAVRGTGALDRL

SEQ ID NO: 15913 - protein, 340 aa, Bacillus licheniformis ATCC 14580
MKVKVAINGFGRIGRMVFRKAMLDEQIDIAAINASYPPETLAHLIKYDTNHGRYELDVKAGEDCLFVNGKKVMLTNQRDPKLLPWAQYGIDIAVEATGKFNSKEKAEAHIEAGAKKVILTAPGKNEDITIVMGVNERDFDAERHTIISNASCTTNCLAPVAKVLDDAFGIENGLVTTVHAFTNDQKNIDNPHKDLRRARACGSSIIPTTTGAAKALSLVMPHLKGRMHGLALRVPVSNVSLVDLVADLKSDVTAEDINEAFRMAAAGSMSGIIDVCDEPLVSSDFNTNPYSAVIDSLSTMVLENRKVKVLAWYDNEWGYSCRVVDLIRYAASRMKHPSAV

SEQ ID NO: 15914 - protein, 455 aa, Photobacterium profundum SS9
MNARDVKTIDDAKKIITERKITHVKVGLFDNDGVMRGKYMSKSKFFSSLEHGFAFCDVVLGWDVKDQLYDNAQYTGWHTGYPDAPVRIIPESCRDVLDEDGMLLFIAEFTEDAEKVCPRATLRRVLQLADKMGFNVQAAFEYEFFLFNETPHSAREKGFSNLETITPDWFGYSMIRNSTYSGLYKSILAMGEKMDFPIESIHSETGPGVIEAAITVDQAINAADKAALFKTYMKVLAQKNDLLATFMAKWSNDYPGQSGHIHISLQNKDGSSAFFEANNDLNMSDIQRHFLAGQQRLMPEILCMIAPTINSYSRMIPGFWAPTEATWGVENRTTALRLIKGSEKSQRVEYRIGAADANPYLALAAALASGLYGIAQQWEPFEQVIGNAYDQQHPQELQLPHTLWEAAQRFKASNAAREMFGNEFVDHFAASREWEEREFRKHVTDWELNRYFEII

SEQ ID NO: 15915 - protein, 87 aa, Arabidopsis thaliana
  misc_feature (21)..(21): Xaa can be any naturally occurring amino acid
  unsure (1)..(87): unsure at all Xaa locations
AVVTSPDQATRGAPFSGLKSXSAAFPVTRKASKDITSITSNRGRVSCMNVWAPIGKKKFETRSKLPDLTDVELAKGVDYLLRNMWIP

SEQ ID NO: 15916 - protein, 410 aa, Triticum aestivum
  misc_feature (166)..(166): Xaa can be any naturally occurring amino acid
  misc_feature (251)..(251): Xaa can be any naturally occurring amino acid
  misc_feature (269)..(269): Xaa can be any naturally occurring amino acid
  misc_feature (287)..(287): Xaa can be any naturally occurring amino acid
  misc_feature (312)..(312): Xaa can be any naturally occurring amino acid
  misc_feature (319)..(319): Xaa can be any naturally occurring amino acid
  misc_feature (344)..(344): Xaa can be any naturally occurring amino acid
  misc_feature (347)..(347): Xaa can be any naturally occurring amino acid
  misc_feature (370)..(370): Xaa can be any naturally occurring amino acid
  misc_feature (373)..(373): Xaa can be any naturally occurring amino acid
  misc_feature (377)..(377): Xaa can be any naturally occurring amino acid
  misc_feature (401)..(402): Xaa can be any naturally occurring amino acid
  unsure (1)..(410): unsure at all Xaa locations
MAAAAKLTRSFSRQLSSGAARVWRQLSLEPHTPRRGAPVAAAAGPTRFGLARQSSLDPTPAPDDGAVLAMPENLDATMRLLYAACQGDAAGVEELLGEGVDVDSIDFDGRTALHIAACEGRGEVVRLLLGWKANINARDRWGSTPAADAKHYGHFEVYNLLRARGXKLPKTKKTPMTVSNPKEVPEYELNPLELEFRRGEEVTKGYYVAKWYGSKVFVKILDKDSFSDGDSIEAFKHELTLREKARHPNLXVQFVGAVTQNVPLMIVSXEYHQKGDLASYLETKGRXQSYKAIRFALDIARGLNYLHECKPXEPTIHGXLSPKNIVPDDEGKLKVAGFGSLGSXQIXPKINYRWSTSVKFDSVYIAPEMXKNXIDRXVGTLRSGLNPYEMIEGPCIQPKPXXEQDDCSEG

SEQ ID NO: 15917 - protein, 469 aa, Bartonella quintana str. Toulouse
MITASDILKKITDNDIRFVDLRFTDPRGKLHHVTIDNAEISEDTFNDGVLFDGSSISGWKTINESDMVLMPDPETAHIDPFFAQSTLVIFCDVLDPVSGEFYRRDPRSIAKRAEVYMKSLGIGDTINVGPEAEFFIFDDVRYKTDPYNTGFKLDSGEFPSNDDTEYETGNFGHRPRIKGGYLPVPPVDSCQDIRSEMLTALKDMGVRVEKHHHEVAAGQHELGIRFDTLVREADKIQIFKYVVHQIAKSYGKTATFMPKPVFGDNGSGMHVHMSIWKDGKPIFAGNEYAGLSETCLFFIGGIIKHAKAINAFTNPSTNSYKRLVPGYEAPVLLAYSARNRSASCRIPMGFSPNSKRVEVRFPDPTANPYFAFAALLMAGLDGIKNKIHPGHAMDKDLYDLPPKELKEIPTVSGSLREALEELDKDRRFLKAGDVFDDDQINSFIQVKMQEVLRYETTPHPIEFDMYYSV

SEQ ID NO: 15918 - protein, 584 aa, Cucumis melo
MRKPVGALLHDRRAVRVPISGRNHLYKVSISLVFILWGLIFLFSLWISRGDGCQEGSILLPDGVSTTNESKLENNKDSDVLCEPPNGESHCTIHLNNSCSINASSPGSDNEILSSEESSSHIQATTRLPEDESSSTRVKPESKPPKGDISSDTVLLGLEEFKSRAFVSRGKSETGQAGNTIHRLEPGGAEYNYASASKGAKVLAFNKEAKGASNILGKDKDKYLRNPCSAEEKFVVIELSEETLVVTIEIANFEHHSSNLKEFEVHGSLVYPTDVWFKLGNFTAPNAKHAHRFVLKDPKWVRYLKLNFLTHYGSEFYCTLSTVEVYGMDAVEMMLEDLISAQHKPSISDEATPDKRVIPSQPGPIDEVSHGRELQSLANEEGGDGVDLELSKSNTPDPVEESHHQQPGRMPGDTVLKILTQKVRSLDLSLSVLERYLEDLTSKYGNIFKEFDKDIGNNNLLIEKTQEDIRNILKIQDNTDKDLRDLISWKSMVSLQLDGLQRHNSILRSEIERVQKNQTSLENKGIVVFLVCLIFSSFAIFRLFLHIVLRVYERTNNSRKFCCISPSWYLLLLSCCIILFVQSL

SEQ ID NO: 15919 - protein, 394 aa, Thiomicrospira crunogena XCL-2
MSRLSNRVNRVKPSLTLVISAKAAELKRAGKDIISLGAGEPDFDTPDHIKAAGISAIQNGQTRYTAVDGTPELKSAIIEKFKRDNNLTYEMDQILVSSGGKQSFYNLCQGLLNDGDEVVIPAPYWVSYPDMALLAGGKPIIIEADIEQGFKITPEQLKAAITPKTKMVVINSPSNPTGAVYTASELKALGEVLQQHPDIVIASDDMYEHILLDDTPFTNILEVCPELTDRTVVMNGVSKAYSMTGWRIGYAGGPKDLIAAMRKVQSQSTSNPCSISQAASTEALNGPQDCIDTMLTEFKKRHEFVVERINEIPGFKCIPAAGAFYAFMDVKAAMKQKGYQTDTDFATAILEEVEVAAVPGSGFGAEGHLRISFATSMVNLINALDRIDSFMKDA

SEQ ID NO: 15920 - protein, 469 aa, Saccharomyces cerevisiae
MSYSAADNLQDSFQRAMNFSGSPGAVSTSPTQSFMNTLPRRVSITKQPKALKPFSTGDMNILLLENVNATAIKIFKDQGYQVEFHKSSLPEDELIEKIKDVHAIGIRSKTRLTEKILQHARNLVCIGCFCIGTNQVDLKYAASKGIAVFNSPFSNSRSVAELVIGEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVSLKSLDYDQENTVRVLYIHRNVPGVLKTVNDILSDHNIEKQFSDSHGEIAYLMADISSVNQSEIKDIYEKLNQTSAKVSIRLLY

SEQ ID NO: 15921 - protein, 337 aa, Magnetospirillum magnetotacticum MS-1
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 15922 - protein, 232 aa, Rhodopseudomonas palustris CGA009
MDKEELKRRAAARALEEVRGGMKLGLGTGSTAKHFVELLGERVRLGLEIIGVPTSEVTRADAERCGIRLTSLDEIDRLDITIDGADEVDHHLDLIKGGGGALLREKIVAAASDRMIVIADESKLVDTLGRFPLPIEVIPFGLGATRRALQNAFTAAGCDGELKLRPGKDGHAFVTDGGHWILDAQLGRIPDAPRLAQLLSVIPGVVEHGLFVGMASTVVLAGADGIRTIERA

SEQ ID NO: 15923 - protein, 92 aa, Thiomicrospira crunogena XCL-2
MDQDVIIESTPNEDRLNSLGTREWPIWEKEVSNFPWHYDEQEVCYVLEGEVTVTVEDGTQYHIKPGDLVTFRQGLNCYWSVETPIKKHYKFG

SEQ ID NO: 15924 - protein, 326 aa, Desulfitobacterium hafniense Y51
MRNKILDVLKNQQGEFVSGESLSQALSITRAAVWKQIQGLKEAGYEIEGQTRKGYRLVGTPCALDLWALQQELRTQALGRQLFFFAELSSTNDLLKDMVRQGREHGTVVIARRQTTGHGRMQRAWESPEGGLWLSLLLKPRLSLGDAAKLTLSTGVALAQTLQDLYGLAAGIKWPNDVVVQGRKIAGILGEVAGEWTTVQTLILGIGVNANFSGQTFSSKLPATTLQDILGYEVNLNHLAAQLLFNLEKEVQSLEQGDVQGLIQRWTSFAVGINQPVRIERAGTVYAGIFKGIREDGELILDLEGQEMTFSSGEVSLRAGDQYSPE

SEQ ID NO: 15925 - protein, 223 aa, Zea mays
MERELLETFDAAKKAADATAGQGDSPEAGRCLDALHRLRDIRVNTDILVSTQDSDLAWRERKRGKQLFCRLRILWNLVVITLEGYAWRGSEKQKMQGVGKRLRPLTKHPHSGIQAVASDLFGYWKKVVLEETGKKNGSSENEKSMDSSGKVEKVRPMKVEKNSASASMKVEKRDVDDRGQKPDNVKVEKTASNGSRTQSVKVERVSKEVNRTDAKKPASVPNG

SEQ ID NO: 15926 - protein, 488 aa, Listeria innocua
MSIKETSLPKVQTKLFINGKWIDGDNKETKDIVNPANGEVIAKIAQAGPKETKQAIKAAKDAFPDWAKMELADRVKLLHNIADLMEERADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFADANLEAAVDDLITAKFRNNGQVCVSPNRIFVAKEIKEKFTKTLVAKVEKLKVGNGLDDVNVGPLIREDAIDKIDKQLKNATDKGAKVLTGGERLTGSDYDKGNFYKPTVLDNVTREMDIFYEETFGPVIPLIVFENEDEAIEMANDSEFGLASYFYTKDLARVEKVGAALEYGMVGANEIAISNPETPFGGVKHSGFGRENGHYGMEEYIQVKFINLKYRD

SEQ ID NO: 15927 - protein, 323 aa, Aspergillus nidulans FGSC A4
MADQDVDLDSIIDRLLEVRGSRPGKQVQLLESEIRYLCTKAREIFISQPILLELEAPIKICGDIHGQYYDLLRLFEYGGFPPEANYLFLGDYVDRGKQSLETICLLLAYKIKYPENFFVLRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKYVYGAMSSGRPITPPRKQKK

SEQ ID NO: 15928 - protein, 317 aa, Magnaporthe grisea 70-15
MSSGRKIKLNSGHEIPQSNPNEVAKAVEHALRNGYRHIDGALVYGNEHEVGEGIRASGVPRSDIFLTSKLWNTFHHPDDVEAGIDLTLRDLGTHYVDLYLIHWPVSFAPRENPRELFPIDPATGATHVVDIPDADTWRAMERLVESGKARSIGVSNFTRGRLEKLLQTARIRPAVNQIEAHPYLQQRELLEWHRQQGIVVQAYSPTGNNIYGRPKPLDDPVVLEVAARVGRTPAQVLVQWAAQRGTVVLPKSVTPSRIDENFVDFELPADEVEKLNALERHARYNFPARLGVDIFGEATEEELKAAVQAFIEQRRQA

SEQ ID NO: 15929 - protein, 201 aa, Triticum aestivum
  misc_feature (123)..(123): Xaa can be any naturally occurring amino acid
  unsure (1)..(201): unsure at all Xaa locations
MSGAVLVAIAASIGNLLQGWDNATIAGAVLYIKKEFSLETQPLIEGLIVAMSLIGATVITTFSGAVADAAGRRPLLIASSVLYFVSGLVMLWAPNVYVLLLGRLIDGFGIGLAVTLVPLYISXETAPTDIRGLLNTLPQFSGSGGMFLSYCMVVTMSLMPQPDWRIMLGVLSIPSLMYLALTGFLLPPSPTWLVSNGNNRP

SEQ ID NO: 15930 - protein, 152 aa, Brassica napus
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTTVESRREASSLASRLTRAPLRLLALIRRPPPKAMTLAS

SEQ ID NO: 15931 - protein, 181 aa, Halobacterium salinarum
MGSSHHHHHHSSGLVPRGSHMTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 15932 - protein, 274 aa, Exiguobacterium sibiricum 255-15
MEFVTLNNGLVMPQLGYGVFKVPEQEVYEAVREALRVGYRSIDTAMIYENEAGVGRALKDSGIPREDIFLTTKVWNKDQGYERTLAAFETSLQKLGVDYVDLYLIHWPMPDEDLYMDTWRALEQLYRDGKAKAIGVSNFHIPHLTRVLEEGTVVPAVNQIELHPFLSQEAIRAFCQKNGIVVEAWSPLMKGRDALTDPVITDIAARHGKTPAQVVLRWHLQHDIIAIPKSVTPSRIQENLDIFDFVLSPDDMRQIDQLNRNERTGSNPDEMHKK

SEQ ID NO: 15933 - protein, 203 aa, Zea mays
RPTRPLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 15934 - protein, 754 aa, Bacteroides fragilis YCH46
MSHLPTLIADLALILMSASIITLLFKWLKQPLVLGYIVAGLLAGPYVRIFPTVGDMENINTWAEIGVVFLLFALGLEFSFKKLMNVGSAAFITATTEVISMLLIGFMVGHLLGWSTMNSVFLGGMLSMSSTTIIIKAFDDLGLRSQRFTGIVFGTLVVEDLIAILMMVILSTMAVSKDFVGEELLMSVLKVAFFLILWFLVGIFILPFFLKKAKRLMNNETLLIVSLGLCLAMVVLATRTGFSAALGAFIMGSILAETVEAEHIEHIIQPVKDLFGAIFFVSVGMLVNPSVLLQYAWPVVIITLVTLVGKSIFSSLGVLLSGEPLKVSVKSGFSLAQIGEFAFIIAGLGASLKVLDPFVPPIIVAVSVITTFTTPYFIRLANPFSEWLYKVLSPRTREFLDRYASGKKTVNHDSDWKRLLKTIVGRVIIYSVLLTAIWLLSVQTVYPTINGMFDSPGRWLSVVMCLLTLLLMTPFLWALVSDKYNSPDVFLKLWNDDNYNHGRLVALILFRVSVAVFFIAGVVISYFSLNYGIGIVIAVAVLGLILLLRENLTQYSHLENHFLTNLNGREEAARNRYPLKSRFNSEFSDKDIELTSVWVSPYSSYIGKSLEELPFRREFGVNVVGIVRGERRIYIPQSDECIYPQDKLIVVGTDGQLQKFRSELDIRQDFPDEKNVRQEVTLHSFTVDEESPLLNKSIAQSRLGKQYDSLIVAIEREDELISMNQSTVFRLGDLVWIVGDREKIRQLLMRKKHV

SEQ ID NO: 15935 - protein, 257 aa, Vibrio cholerae
MRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 15936 - protein, 165 aa, Brassica napus
  misc_feature (152)..(152): Xaa can be any naturally occurring amino acid
  misc_feature (154)..(154): Xaa can be any naturally occurring amino acid
  unsure (1)..(165): unsure at all Xaa locations
ISAQARMQGGSSGIGYGLKYQARCISDVKADTDYTSFLTGTLSLKEENEVHLLRLSSGGSELICEGLFSHPNEIWDLASCPFDQRIFSTVFSTGESFGAAIWQIPELYGQLNSPQLERVASLDAHVGKINCVLWWPSGRCDKLISMDEQNIXLXWSLDCSNKSAE

SEQ ID NO: 15937 - protein, 96 aa, Glycine max
NHQRTPRLMVKTIESNRRALRELLFTAPGVLQYLSGVILFEETFYQSTVEGKPFVNALKEAGVLPGIKVDKGPAKLAGTKGETTSQGLNGLGQRGP

SEQ ID NO: 15938 - protein, 301 aa, Schizosaccharomyces pombe
MTKGTSKLLFMGTGCSSGIPNVCCLTLEKPTCRTCLASLTPEGRKNNRFNTSVLLQVDDGSGDRPKNILIDCGKHFYVSALKHFVEHKIRYLDAVILTHDHADAINGMDDLREWTLGFLQPSVKIYLTERTYKVIERSFPYMVNAKNATGGGSVPTFDFHVFSPDKPFKLDDIDISVTPLPVHHGVYFIEGKESQTYFCMGFRVGDMSYISDCNYVPPTTKKLMEGSNVVVVDALKHEPYPSHFSFKQAEEFIASLEHVPSRVLYTGFSHKVEHNETVKELSVLKVPTEPAYDGQIVEFHV

SEQ ID NO: 15939 - protein, 140 aa, Chlorobium tepidum TLS
MERTLTILKPDCVRKQLIGAVTNMIERAGFRIVAMKKTRLTKETAGAFYAVHKERPFYGELVEFMSSGPCVPMILEKENAVADFRTLIGATDPAQADEGTIRKLYADSKGENIIHGSDSAENAAIESAFFFAAEEVVRVD

SEQ ID NO: 15940 - protein, 484 aa, Agrobacterium tumefaciens str. C58
MHLNDPTLFCEKVPVAGRWIGCDDRETATIRNPATGKIVGQVPELGATETQAAITAAVIAQKAWARRTAGERAAILKAWHRLVMENRDDLGMILTLEQGKPLAEAKGEIAYGASFIEWFAEEARRINGETVPGHQADKRILVLRQPVGVVAAITPWNFPNAMITRKVGPALAAGCAVVLKPAPQTPFSAIALAILAERAGLPLELFSIVTGPAAEIGGVLTASPDIRLLTFTGSTRTGEHLYRQCAPTIKKLGLELGGNAPFIVFNDADLDAAVEGALIAKFRNNGQTCVCANRLYVQSGVYDAFAEKFARAVSGLKVGNGLEEGSILGPLIDGNAVAKVEAHIADALSKGAQIAAGGSRYALGGNFFEPTILRNVTADMQVAREETFGPLAPLFRFEDEEDVIAQANNTDFGLASYFYARDLSRVFRVAEALEYGMVGVNTGAISTAEAPFGGVKMSGLGREGSRHGIEEYTELKYVCIGNIL

SEQ ID NO: 15941 - protein, 510 aa, Vibrio vulnificus
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 15942 - protein, 164 aa, Halobacterium salinarum
GSHMTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 15943 - protein, 585 aa, Bacillus licheniformis ATCC 14580
MRKTKIVCTIGPASESVEKLTQLMEAGMNVARLNFSHGDFEEHGARIKNIREAAGKLGKDIGILLDTKGPEIRTHTMENGSIELAAGSQLIVSMDEVIGTPDKISVTYDGLIHDVSVGSTILLDDGLVGLEVTDINKDKREIVTKVMNSGTLKNKKGVNVPGVSVNLPGITEKDANDIVFGIEQGVDFIAASFVRRPSDVLEIRELLEEHNAADIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGNYPVEAVQTMHNIASRSEEALNHKKILSARSKQVSMSITDAIGQSVAHTAINLDVNAIVTPTESGHTARMISKYRPQAPIVAVTVNDAVSRKLSLVFGVFATSGQNHSSTDEMLEKAVQKSLDTGIVRHGDLIVITAGAVGEAGTTNLMKVYVVGDVVAKGQGIGRKSAFGEVVIAQNAQEAAKKMKDGAVLVTKSTDRDMMASLEKAGCADYGRRRLNKPRAVVGLSLGIPVIVGMENATSILKEGEDITVDSARGAVYKGRASVL

SEQ ID NO: 15944 - protein, 515 aa, Zea mays
MANIDMAKILADLDRGASGGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENTIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 15945 - protein, 296 aa, Oryza sativa (japonica cultivar-group)
MAGLSLQHPWAFAFGLLGNLISFTTYLAPIPTFYRIYKSKSTEGFQSVPYVVALFSAMLWIFYALIKSNEALLITINAAGCVIETIYIVMYLAYAPKKAKVFTTKILLLLNVGVFGVILLLTLLLSHGEQRVVSLGWVCVAFSVSVFVAPLSIIKRVIQSRSVEYMPFSLSLTLTLSAVVWFLYGLLIKDKYVALPNILGFTFGVVQMGLYVFYMNATPVAGEGKEGKGKLAAAEELPVVVNVGKLAAATPDRSTGAVHVHPVPRSCAAEAAAAEPEVLVDIPPPPPPRAVEVAAV

SEQ ID NO: 15946 - protein, 254 aa, Methanosarcina mazei Go1
MTSYKALVKDVINKADVLLEVVDARFPDETRNSEVEKEIIRLKKPFIIVINKCDLVSKEKLDKTKSRLSRIAPTVFISSKDRSGTTMLRHQILASACIKGRDILVGTLGYPNVGKSSVINGVTGRHRASTSPVSGHTKGVQHVDAGSHIMFMDTPGVIPFDENDEYVQGLLGIKDSTHLKDPVGVALMIIDKMLAENRTALESFYNVTLESPDSYSVLEQIGRKCNFLQKKGEIDEMRTATKIIGDWQNGLLLV

SEQ ID NO: 15947 - protein, 283 aa, Listeria monocytogenes str. 4b F2365
MKTVKLNNGVEVPILGFGTYQITDAAEAEQAVKDAIKTGYRHIDTAQSYMNEEAVGRGIAASGVDRKELFITTKIWVENVSYKGVMSSFDRSLKRLGLDYIDLLLIHQPFNDVYGAWIAMEELQASGKIRAIGVSNFSPDRVIDLAAFNEVTPQVNQIEVNPFQQQAANLAVLRKEGVTIEAWAPFAEGKNDIFNNPVLTKIGAKYGKSAAQVILRWLVEQDIIVLAKSVKPERMAQNLAIFDFELTEADKGEIASLDQGESQFFSHADPEMVKWMASRKLNV

SEQ ID NO: 15948 - protein, 295 aa, Acidobacteria bacterium Ellin345
MSIATGDFRSKVTSSTLLDKKSKHDPITCLTAYDYSTARLVDEAGIDMILVGDSLAQTMLGYENTLPVTMDEMLHHTRAVRRAVRHAFLIADMPYASYHVGGRESVRNAARFIKEGGAEAVKIEGGENRAALIDRLLDAEVPVVGHIGLTPQSVHRMGGYKVQGKTIRDIEQLMRDATALDRAGVVALVLEGIPREVAAMITAEVETPTIGIGAGPDCDGQVLVFHDILNLTFAPPAKFVRRYADAAELITGAVKAFRDDVKTGSYPSDDESYHLPKEAQATLEMVQNRKHAMRK

SEQ ID NO: 15949 - protein, 539 aa, Zea mays
MGVISTVLGFSGFGFGFSAGIVIGYFLFIYVQPTDVKDVKVRPLVEYDSKSLEGILPEIPLWVKNPDYDRIDWLNRFLELMWPYLNKAICRTAQDIAKPIIAENTAKYKIDSVEFESLTLGSLPPTFQGMKVYVTEEQELIMEPSLKWAANPNITVAVKAYGLKATIQIVDLQVFASPRITLKPLVPTFPCFAKILVSLMEKPHVDFGLKLLGADVMAIPGLYRFVQETIKKQVASMYLWPKTLEVPIMDPSKASKRPVGILLVKVVRAQNLRKKDLLGKSDPYVKLKMSDDKLPSKKTTVKRSNLNPEWGEDFKFVVTDPENQALEVNVFDWEQVGKHEKMGMNMIPLRELLPEGTKVTTLNLLKTMDPNDVQNEKSRGELTLELTYKPFKEEDIEKEDTQGADVIEKAPDGTPAGGGLLYVVVHEAQDLEGKHHTNPYAKIIFKGEEKKTKVIKKNRDPRWEDEFEFVCEEPPVNDKLHVEVISKAPKAGLIHGKETLGYIDISLADVISNKRINEKYHLIDSKNGQIQIELQWRTS

SEQ ID NO: 15950 - protein, 228 aa, Neurospora crassa
MSGIWGWFGGGSAAQKRKDSPKNAILGLRTQLDMLQKRERHLQNQIDEQDAIARKNVSTNKTAAKQALRRKKVAESTLETTLGQITTLEQQINAIESANINRETLAAMQAAREAMGKIHGKLTPEKVDEEMAKLQEANDLSNEIATAITSANIGQPIDEGELEDELEKLQQEEVDSKLHETGGSIPVHDKISLPAAGTGALKGKEKAKAVVEDDEEEELRKLQAEMAM

SEQ ID NO: 15951 - protein, 460 aa, Pseudomonas aeruginosa
MNEENNKQVLKLQEFIEKHNIDTVRLGAVDIDGVWRGKQVGAEYFLNKAALDGTQISNILFGWDVADHLVDGLAFTGWDSGYPDIALIPDLLTLSLVPWQAKTASVLCDIQHLNGQSLNLSPRNLLRKATEKAEQLGYKCHAAYEFEFYLLNDSIGSIAADQWRSINPVEKSGHCYSMLHHSSSSDIIGEVRKYMRDAGIVLEATNSEHGPGQYEINIKYDDALKAADDAIFVKNGIKEIAAKHGMTATFMAKPNAEWSGSSGHVHISLSNLITGAPAFANPENPAALSEVGYNFLAGMVELAREFSAIYLPNINSYKRTAGASWAGGNSSWGFDNRTVSHRAITSAGAAARVENRIPGADTNPYLVIAASLLSGLYGIENKLKPKDPILGNAYKVSPELARPLAASLEEATNIFRESEMARVLFPKEFVEHYSQMKVWEIKQANGFVNNWELARYLDII

SEQ ID NO: 15952 - protein, 192 aa, Solanum demissum
MLCYEQAVDTAVRVLKEGGMDAIKLEGGAPSRITAAKAIVEAGIAVIGHDGLTPQAISVLGGLRPQGRNVDSAVKVVEPAMALQEAGCFSVVLECVPAPVAAATTSALRIPTIGIGAGPFCSGQALVYHDLLGMMQHPHHAKVTPKFCKQFGQVGDVINKALLEYKEEVTNGSFLALLTAHTRLVQPIWMVS

SEQ ID NO: 15953 - protein, 480 aa, Salmonella enterica subsp. enterica serovar Paratyphi A str.
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHSIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 15954 - protein, 490 aa, Gibberella zeae PH-1
MASPKLSDPSLIKNACYVNGQWVAAKSGKDFSVENPASLEKLGSCPEFDANDTEAAIAAADAAYKTYRKTPARQRARYLRRWYDLMMENADDIARLITLENGKVWSDAKTEAVYAANFFEWFSEEAPRIYGETIEASNPSCRLSTIKQPVGVCGLIAPWNFPAAMITRKAGPALAAGCTVVIKAPAEAPLTALALAELAHRAGIPAGVVNIITALDNTAEVGKVLTTHPKIKKVSFTGSTGVGRLLMNQSSSTVKKLSFELGGNAPFIVFEDADLEKAVKGIITSKFRNSGQTCVCANRIFVHRSIYDKFVQMVLDVVKTFVIGDGFGEKTTHGPLIHGRAVAKTAEHVEDAISKGAKLIHGGERLADLGPNFFGLTMLTDMTPDMKIFSEETFGPVAAFFAFDTEEEVIELANDSEVGLGGYFFSENVNRCYRVAEALEVGMIGVNCGVLSDPAAPFGGIKQSGFGREGSKYGIDEFTVTKMVMTNIDP

SEQ ID NO: 15955 - protein, 181 aa, Zea mays
  misc_feature (101)..(101): Xaa can be any naturally occurring amino acid
  unsure (1)..(181): unsure at all Xaa locations
MASVRLSSATMTSSLAHATMVAPFIGLKSSAAFPVTCKANTEITSITSNGGRINCMKVWPPVGKKKFETLSYLPGLTDVEIAQEIDYLIRNKWTPCIEFEXEHGFVYREHGNIPGYYDGRYWTMWNLPLFGCTDPPQVLKEVQQCKREYPNAFIRIIGSDNNRQAQCISFIPYKPPSFTDA

SEQ ID NO: 15956 - protein, 492 aa, Mycobacterium sp. MCS
MAGHGGAPVGGDLPIGDDEFTSGKTAIRIASVAALGGLLFGYDSAVINGAVDSIQEDFGIGNASLGFAVASALLGAAAGAMTAGRIADKIGRIAVMKIAAVLFLISAFGTGFAHEVWAVVLFRIVGGIGVGVASVIAPAYIAETSPPSIRGRLGSLQQLAIVSGIFLSFVVNWLLQWAADGPNKPLWFGVDAWRWMFLAMAVPAVVYGALAFTIPESPRYLVASHKIPEARRVLSTLLGKKNLEITITRIRETLEREDKPSWRDLRKPTGGLFGIVWVGLGLSIFQQFVGINVIFYYSNVLWQAVGFSADESAVYTVITSVINVLTTLIAIALIDKIGRKPLLLIGSSGMAVTLITMAVIFANATLDADGNPSLPGASGVIALIAANLFVVAFGMSWGPVVWVLLGEMFPNRIRAAALGLAAAGQWAANWLITVTFPGLREHLGLAYGFYGMCAILSGLFVWRWVRETKGVSLEDMHGEILKHDLPTGAKEG

SEQ ID NO: 15957 - protein, 601 aa, Legionella pneumophila subsp. pneumophila str. Philadelphia 1
MNGHLLLNVFIFLAAASIMVPLASRFRLGSVIGYLTVGMLIGPFGLKLIGNAEQIMHFAEFGVVMMLFLIGLELEPIMLWKLRKLIVGLGGLQVLLTTIALSSAAVMMGYNLRASVAVSMALALSSTALVLQMLQEKNLLKTAEGETSFAVLLFQDIAVIPILVILPLLGNHHGINVAINPHTAASIAQLPKWLHAIVVAGIIGSIVLAGHYLSRYLFLIIAKTNIREVFTAFSLSLVVGITLLMETIGVSPALGAFIAGMVLANSQYKRTVEADIQPFKGLLLGLFFISVGMGINFNLLFSQMAVIIPIVLGLITIKALILFTLGKIFQLTKIQALGFALGLSQGGEFAFVLFQYSSTLKVISPEINSFFTLVVALSMLATPFLMLLYHRFMIPKLISKLPEREYDSIHEKNNIIIAGYGRFGQIIGRFLSGENIKVTVLEKNPEQVELLRKFGYTGYFGDANRLDLLKSAGAAHAQLLIVTVGNPDTNLEIVKLAKEEFPQLKIFARARNRRHAYELHKAGVHYFKRELFDSSLTMTKEILKFLGYKPEEIEKKANAFQKHDEETLIKSFDFFEEEANLINFSRQAKGELERILQNNNP

SEQ ID NO: 15958 - protein, 809 aa, Escherichia coli
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFYKVRFGGRIQQEGKKTRWIETEEILGVAYDQIIPGYDTDATNTLRLWSAQASSEINLGKFNQGDYFAAVEDKNHSENVSRVLYPDDSTYSGRDVRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLLADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGTGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 15959 - protein, 480 aa, Arabidopsis thaliana
MASISLFEASIAIFCFIILHFFLGNWPVLGMLPGLLLEFHRIYDFSVEVLENSDLTFPFKGPWFTGMDMLFTVDPTNIHHIMSSNFSNYTKGPDFKQVFDVFGDGILTTDDSELWKNLKKASLVMLNHQGFQKNGTVVDLQDVFKRFMFDTTLVTVTGSADPRSLSIEMPEVEFAKALDHVGEGIMHRHVRPRLLWKLQKCVGFGQEKKFSKADATLNQACAKYILEKREETRSQGFDYHSNGSESEDILTYHIKIDTTKYELLNPSDDKFLRDTILAFVLAGRDTTASALTWFFWLLLENPQVVTKIRQEINTSNGGQEKPSCEPMEYLNNLVYLHGALYEAMRLYPPVPFERMSPIKPDVLPSGHKVDSSMKILIFIYALGRMRAVWGEDASEFKPERWLSETTSLRHEPSFKFLAFNAGPRSCIGKQLAMTLMKIVVVEILQNYDIKVVKGQKKIEPAPGPILRMKHGLRVTLTKKC

SEQ ID NO: 15960 - protein, 383 aa, Escherichia coli
MNAPFTYSSPTLSVEALKHSIAYKLMFTIGKDPVVANKHEWLNATLFAVRDRLVERWLRPNRAQLSQETRQVYYLSMEFLIGRTLSNAMLSLGTHEDVQGALEAMGLNLEELIDEENDPGLGNGGLGRLAACFLDSLATLGWPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFDQGDYFAAVEDKNHSENVSRVLYPDDSTYSGRGLRLRQEYFLVSSTIQDILSRHYQLHKTYDNLADKIAIHLNDTHSVLSIPEMMRLLIDEHQFSWDDAFEVCCQVFSYTNHTLMSEALETWPVDMLGKSLPRHLQ

SEQ ID NO: 15961 - protein, 212 aa, Oenococcus oeni PSU-1
MNSSSVVKAVEALKKGKLIIVVNNSDRENEGDLLGLGAKMTPENMNFMVTNARGLVCVPITSALAKRLGLKAMVEKNTETYETAFTISLDGTNEIGGITTGVSAYDRTATINKLSDPNCEARDFVHPGHMFPLIAKDGGVLERNGHTEAAVDLAKLCGVTPVGTIVEVLRPDGHMARRDYLSQMSNEYQLPMLSIDELSEFIRENGLDPIDL

SEQ ID NO: 15962 - protein, 323 aa, Arabidopsis thaliana
MESSIPSENGSVTSDRDRSALIFLGTGCSSAVPNAMCLIQRSDNPCYVCSQSLSIPPEKNPNYRGNTSLLIDYCQSDGKHKYIQIDVGKTFREQVLRWFTLHKIPQVDSIILTHEHADAVLGLDDIRSVQPFSPTNDIDPTPIFVSQYAMESLAVKFPYLVQKKLKEGQEVRRVAQLDWRVIEEDCEKPFVASGLSFTPLPVMHGEDYVCLGFLFGEKSRVAYISDVSRFPPNTEYAISKSGGGQLDLLILDTLYKTGSHNTHLCFPQTLDTIKRLSPKRALLIGMTHEFDHHKDNEFLEEWSKREGISVKLAHDGLRVPIDL

SEQ ID NO: 15963 - protein, 375 aa, Methanocaldococcus jannaschii DSM 2661
MISSRCKNIKPSAIREIFNLATSDCINLGIGEPDFDTPKHIIEAAKRALDEGKTHYSPNNGIPELREEISNKLKDDYNLDVDKDNIIVTCGASEALMLSIMTLIDRGDEVLIPNPSFVSYFSLTEFAEGKIKNIDLDENFNIDLEKVKESITKKTKLIIFNSPSNPTGKVYDKETIKGLAEIAEDYNLIIVSDEVYDKIIYDKKHYSPMQFTDRCILINGFSKTYAMTGWRIGYLAVSDELNKELDLINNMIKIHQYSFACATTFAQYGALAALRGSQKCVEDMVREFKMRRDLIYNGLKDIFKVNKPDGAFYIFPDVSEYGDGVEVAKKLIENKVLCVPGVAFGENGANYIRFSYATKYEDIEKALGIIKEIFE

SEQ ID NO: 15964 - protein, 223 aa, Prunus avium
MAILKSTLAFLVLAFAFFICYVMSSGSYDYFQFVQQWPPTNCRVRNKPCTKPRPLQNFTIHGLWPSNYSNPRMPSKCTGSLFNFRKVYPQLRSDLKISWPDVESGNDTRFWESEWNKHGRCSEASLNQMQYFERSHAMWISYNITEILKNASIVPSATKNWTYSDIVSPIKRATKRTPLLRCKYDKSTQLLHEVVFCYEYDALKQIDCNGTAGCPNQKVISFQ

SEQ ID NO: 15965 - protein, 752 aa, Streptococcus pneumoniae TIGR4
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIDLDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAVVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGEENIYIFGEDSETVIDLYAKAAYKSSEFYAREAIKPLVDFIVSDAVLAAGNKERLERFYNELINKDWFMTLLDLEDYIKVKEQMLADYEDRDAWLDKVIVNISKAGFFSSDRTIAQYNEDIWHLN

SEQ ID NO: 15966 - protein, 266 aa, Aspergillus nidulans FGSC A4
MTSERENKTFLARLCEQAERYDEMVTYMKIGGELTVDERNLLSVAYKNVVGTRRASWRIISSIEQKEESKGSEQHVSIIREYRQKIETELEKVCQDVLDVLDESLIPKAETGESKVFYYKMKGDYHRYLAEFASGNKRKLAATAAHEAYKNATDVAQTELTPTHPIRLGLALNFSVFYYEILNSPDRACHLAKQAFDDAIAELDSLSEESYRDSTLIMQLLRDNLTLWTSSDGNEPENVSAPKEEKPEEDAAAPEEKPEEAKAPES

SEQ ID NO: 15967 - protein, 363 aa, Burkholderia pseudomallei K96243
MTNRNDETQQMTAIVCHAPEDYRVERVAKPRANARELVIRIGACGICASDCKCHAGAKMFWGGPSPWVKAPVIPGHEFFGYVEALGEGAAEHFGVALGDRVIAEQIVPCGTCRYCKSGQYWMCEVHHIFGFQREVADGGMAEYMRIPSGAIVHPVPLGISLEDAAIIEPLACAIHTVNRGDIQLDDVVVIAGAGPLGLMMTQVAKLKTPRRLVVVDPVEARRALARAYGADVTIDPAREDAPAIVRALTGGYGCDVYIETTGVPAGVTQGMALIRKLGRFVEFSVFGKDTALDWSIIGDRKELDVRGAHLGPYCYPVAIDLLARGLVTSKGIVTHGFSLDEWDEAIRVANSLDSIKVLMKPRG

SEQ ID NO: 15968 - protein, 228 aa, Photobacterium profundum SS9
MNQSLLTPYGTAFERVEAGLTAIREGRGVLVVDDEDRENEGDIIFAAETLTSEQMALMIRECSGIVCLCLTDERVKQLELPMMVENNTSANETGFTVTIEAAKGVTTGVSAADRVTTIKTAIADGAVPADLNHPGHVFPLKANADGVLGRRGHTEATIDLMRLSGLKPYGVLCELTNIDGTMARLPEVIVFGKKFNMPVLTIEDLAAYRLAKESNTVTNTTEEVAVIA

SEQ ID NO: 15969 - protein, 298 aa, Saccharomyces cerevisiae
MSTSVPVKKALSALLRDPGNSHCADCKAQLHPRWASWSLGVFICIKCAGIHRSLGTHISKVKSVDLDTWKEEHLVKLIQFKNNLRANSYYEATLADELKQRKITDTSSLQNFIKNKYEYKKWIGDLSSIEGLNDSTEPVLHKPSANHSLPASNARLDQSSNSLQKTQTQPPSHLLSTSRSNTSLLNLQVSSLSKTTSNTSVTSSATSIGAANTKTGNRVGEFGQRNDLKKSILSLYSKPSAQTQSQNSFFTSTTPQPCNTPSPFVNTGITATNNNSMNSNSSSNISLDDNELFKNVWS

SEQ ID NO: 15970 - protein, 836 aa, Methylococcus capsulatus str. Bath
MLTRKFKTSNPTALLTEMPGLGMGAKNLSADIRRHFNCTLGRDRDCRSVHYAYSALALTVRDRLMERWRNTEYAYDQADCRRTYYLSLEFLLGRALSNAMLNLGIEEPIQQALNELGLELEELADSEFDAGLGNGGLGRLAACFIDSCATLQLPVMGYGIRYEYGMFRQMIVNGYQVEEPDHWLRNGHVWEQERPELTVRVKFGGRTEFSNDVSRPGQVVWLDTDDVLAVPFDIPVPGYRNGTVNTLRLWKSAATDEFKLGEFNAGDYAESVRAKNLAENISMVLYPNDASENGKELRLRQQYFLASASLQDVLRRWLADHGEDFSEFAEKNCFQLNDTHPTIAVAELMRLLIDVHGLAWNEAWAITNRTMAYTNHTLLPEALEKWPVRLFRQMLPRLLEIIFEINARFLGEVAARWPGDIDRLARMSLIEEGHEQQVRMAYLAIVGSFSVNGVAALHSDLLKHGLFKDFHELWPERFNNKTNGITPRRWLAACNPELAGLISEAIGDKWTADLTRLAELRPFAEDAAFRERWMAIKRRNKEKLLDFKNRELGLTLVNPDLMFDVQVKRIHEYKRQLLNVLHVIHLFDRIKRGDVQDWTPRCVLFGGKAAPGYVMAKRIIKLINNVAGTINGDPEMNDRLSVLFLPNYRVTAMEVICPGTDLSEQISTAGKEASGTGNMKFMMNGALTIGTLDGANIEIREEVGAENFFLFGLTAEEVERRRGGYDPGAVIEANEDLKRVMGLLESGFFNRFEPGIFDPIIESIRSPHDPWMTAADFPGYVEAQRAAAAAFRDKDRWARMSILNTAASGKFSTDRTIAEYNREIWKLTPIPALPVK

SEQ ID NO: 15971 - protein, 319 aa, Aspergillus nidulans FGSC A4
MSPPTVKLNSGYDMPLVGFGLWKVNNDTCADQVYEAIKAGYRLFDGACDYGNEVEAGQGVARAIKEGIVKRSDLFIVSKLWNSFHDGERVEPIARKQLSDWGIDYFDLYIVHFPVSLKYVDPEVRYPPGWENAEGKVELGKATIQETWTAMESLVDKGLARSIGISNFSAQLLLDLLRYARIRPATLQIEHHPYLTQERLVTFAQREGIAVTAYSSFGPLSFLELSVKQAEGAPPLFEHPVIKDIAEKHGKTPAQVLLRWATQRGIAVIPKSNNPARLLQNLDVVGFDLEDGELKAISDLDKGLRFNDPPNYGLPITIF

SEQ ID NO: 15972 - protein, 797 aa, Escherichia coli
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRELHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLVKLADDAKFRDLYRVIKQANKVRLAEFVKVRTGIDINPQAIFDIQIKRLHEYKRQHLNLLRILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVKQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 15973 - protein, 469 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRSDILEPGTLQGYDRDPRSMSKRAEDYLRSTGIADTVLFGPEPEFFLFDDIRFGSSISGSHVAIDDIEGAWNSSTQYEGGNKGHRPAVKGGYFPVPPVDSAQDIRSEMSLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 15974 - protein, 309 aa, Glycine max
MAATSTSLASQLYIGLRRPCLKLDSFNSQSFSVFDPNLRLSLSPPRPSRAIVAMAGTGKFFVGGNWKCNGTKDSISKLVADLNSAKLEPDVDVVVAPPFLYIDQVKNSLTERIEISAQNSWVGKGGAFTGEISAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 15975 - protein, 305 aa, Myxococcus xanthus DK 1622
MKDKVTIHTLKRFKQIGQKICMVTAYDATFAHILEEAGADVLLIGDSLGMVIQGHDSTLPVTMDQMVYHTAAVARGARRAHVVADLPFMSYQVSNQEAVRNAGRLVAEGGAGSIKLEGGAEFADTVRAIVRASIPVMGHLGLTPQSVHKMGGYVVQGRGEDQARQILDDALALEQAGAYALVLEGVPMDLARTVTQRLSIPTIGIGAGVDCDGQVLVCYDLLGMNPDFKPKFVKRYANLHGSITEAAGAYFAEVRKGAFPDEEHSFKATKNIRLAPGAPAPAARVEPSAPAEAGEKLGPVYGRPA

SEQ ID NO: 15976 - protein, 264 aa, Vibrio angustum S14
MKKITINDLMKWKQEGRKFASVTAYDASFAQLFEQQEMPVLLVGDSLGMVLQGREDTLPVTVEEIAYHTRSVRAGSPNALLMADMPFMSYATPEQACENAAKLMRAGANMVKLEGGAWLADTISMLAERAVPVCAHLGLTPQSVNIFGGYKVQGRDIDKADEMVKDAILLKNAGAQIIVLECVPASLAERITKAVEIPVIGIGAGNSTDGQILVMHDMFGISANYMPKFSKNFLAETGDMRAAVTKYIKDVETGEFPGSQHTFE

SEQ ID NO: 15977 - protein, 244 aa, Streptomyces sp. CH7
IPGDTEVRELDLASLASVRAFAAKLTADHPSVDVLVNNAGLVHLGPRRTTADGFELHVGTNMLGPYALTGLLLDALTAGSGGRVVSLSSITHKNAHLDFGDLMSEHGYRASSAYGRSKLATTLFGLELDRRLRAAGLPVVSALAHPGLTRTNLTPRAWEHRGRFGRLIAAGGLLATQSVEQGALPQLRAATDPEVRGGQFFGPARLWETRGPVTEARLGEEAADPAVARRLWAVAEDLTGVRYP

SEQ ID NO: 15978 - protein, 416 aa, Magnetospirillum magnetotacticum MS-1
MRYLPLTESDRRAMLDVIGAKSVDDLFRDVPPSARLAGPLPLPSHQGEMEVERAFTRMAGKNLSAGCAPFFIGAGVYRHHIPAAVDQLLLRGEFLTAYTPYQPEVAQGTLQMLFEFQSQVAAITGMDVANASMYDGATATAEAAVMACRITKRAKVIVSGGVHPHYAETVETSLRYTEMEADVLPPDPLGMEDMIGRVDSQTACVIVQNPGFFGTVRDLRPLAALCHEVGALLVVMVAEPTSLGLIESPGAMGADIVVCEGQSLGMGMNFGGPGLGLFATRDKYVRQMPGRLVGQTADVDGRRGWVLTLSTREQHIRREKATSNICTNSGLCALAFSIHLTMLGGSGFGRLAELNHVAATRLEQKLRAVKGVRVLPQSYYNEFAIHLGDDADAAAVVDALADKGILAGVPASRFYP

SEQ ID NO: 15979 - protein, 494 aa, Rhodospirillum rubrum ATCC 11170
MASQSASAPITPVILSGGSGSRLWPLSRALYPKQFLPLVSELTMIQETALRASGERFTAPLVICNDEHRFIVAEQLRAAACQPTAIILEPVGRNTAPAVAVAALKLLESASDPIMLVMPSDHVIQNADAFLAAIDQAAPAARAGALVTFGITPNAPETGYGYIKAGGSFAPFTGVLRVERFVEKPNLQTAESYLAEGSYLWNSGIFLFSAKAYLAELGRTNSKIIEACSQALAQGQRDLSFCRLDAAAFAASPADSIDYAVMEKTANAAVFPVEMGWSDLGAWSALWEIGPKDAQDNVALGDVLLQDVEGSYIRSDHRLVAVAGLCNVVVVATDDAVLVIDRGKVQDVKQIVERLKKANRDEHALHSTVHRPWGHYRGIDRGERFQVKRIVVQPGERLSLQMHHHRAEHWIVVTGTALVTRGAETFLLHENESTYIRAGQTHRLENPGKVPLHLIEVQSGGYLGEDDIVRFEDGYGRTLPQKEPPLISLENKTE

SEQ ID NO: 15980 - protein, 97 aa, Arabidopsis thaliana
  misc_feature (89)..(89): Xaa can be any naturally occurring amino acid
  misc_feature (91)..(91): Xaa can be any naturally occurring amino acid
  misc_feature (96)..(96): Xaa can be any naturally occurring amino acid
  unsure (1)..(97): unsure at all Xaa locations
MASSMLSSTAVVTSPAQATMVAPFTGLKSSASFPVTRKANNDITSITSNGGRGSCMKVWPPIGKKKFETLSYLPDLSDVELAKEVDYLXRXNKWIXL

SEQ ID NO: 15981 - protein, 816 aa, Saccharophagus degradans 2-40
MNSKLPLPKLSNDEKQVSQDLHRHYNFTLGRFDSDADKGYLLEALAYTVRDRLMERWRLTVEKENLAKSKKVFYLSLEFLLGRSLSNAMLNLDMEESVKKSLMEFGADLEELEGEEKDAGLGNGGLGRLAACFMDSCASLQLPVMGYGIRYEYGMFHQSLREGRQVEQPDHWLRDGNPWEIERPDHVRHIKFYGHTEFYKNDNGKECARWVNTRDVLAVPFDMPIPGYQNDTVNTLRLWKAEATDEFNLQEFNEGDYADAVAEKNKAEQITMVLYPNDSSENGKELRLRQQYFLASASLQDVIADWVKENGEDFTNFAKQRCFQLNDTHPTLAVAELMRILMDDYWLEWDEAWAITTQTMAYTNHTLLPEALEKWSVRLVGELLPRLLDIIYEINARFMAEVAHRWPGDTARQRRMSIIEDGHESYVRMAYLAIVGSFSVNGVAALHSQLLVDGLFNDFYQLWPHKFNNKTNGVTPRRWLAHCNKDLATLISGSIGDKWVTDLSDIVKLEKFAEDKLFRDKWHAVKQANKVKLASLVKQKCDVDFNPEWLFDVQVKRIHEYKRQLLNILHVIHLYDKITRGDGDDVDPRCVLIGGKAAPGYVLAKLIIKLTNNVAKVVNADERVAKKLKLAFIPNYRVSSMEIICPATDLSEQISTAGKEASGTGNMKFMMNGALTIGTYDGANIEIMDAVGPEHFFLFGLRVEDIPQYRLHHSPCSIIEQDEDLARVIKLIECGHFSMFEPNIFDPILHSIRNANDPWMVAADFRSYIDAQAAAARAYQDRDSWVTSSIMNTARSGRFSSDRTISEYAKEIWKVK

SEQ ID NO: 15982 - protein, 113 aa, Brassica napus
KFVGGCRFPKDGFPAKALKFVGSLVPHVHRPLFYGGIFLSPVAKKSPNGKLRVLFEVFPRAFLMDQAGGQALTGKKRALDLVPKKIHERSPIFFGGFDHVKEIKALFAAGENN

SEQ ID NO: 15983 - protein, 620 aa, Salmonella enterica subsp. enterica serovar Paratyphi A str.
MDSHTLLQALIYLGSAALIVPIAVRLGLGSVLGYLIAGCIIGPWGLRLVTDAESILHFAEIGVVLMLFVIGLELDPQRLWKLRASVFGGGALQMVVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARPLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKSHFPHLQIIARARDVDHYIRLRQAGVAMPERETFEGALKSGRQALEALGLGRYEARERADLFRHFNTRMVEEMAKGENDPLSRAAAYKRTSAMLSEIITEDREHLSLIQRHGWQGTAEGKHSGEAADEPEVKPSI

SEQ ID NO: 15984 - protein, 270 aa, Chlamydia muridarum Nigg
MLTDKKSSPTWSSLLPSETSQYFVFGNWKMNKTFSEAQTFLKDFVSCEILSNPKIITGIIPPFTLLSSCQQIIKNTPIRLGAQTLHEVDSGAFTGEISAPMLKDIGVDFVLIGHSERRHIFHEQNHSLAEKLLAAIRNGIVPVLCIGETLEEQEAGATQDILLEQLTVGLSRLPEHAPFILAYEPVWAIGTGKVANPDLVQEIHAFCRNVVKDLISKDAAERTPILYGGSVKADNTRALTLCPDVNGLLVGGASLSVESFLAIIQQIAVS

SEQ ID NO: 15985 - protein, 205 aa, Zea mays
  misc_feature (175)..(175): Xaa can be any naturally occurring amino acid
  unsure (1)..(205): unsure at all Xaa locations
MSAFTANSADELIGYAAYLGSAGKGILAAHDSTGTVGERLASIIVDNVQTNRGALHELLFTAPGALPCLNGVILIYETLYQKSSDGKLFDDILKDGRVLQRIRVNKGTVELGGSKGETTTRGVDGLGERRKNYYEAGAGFAQWRAALMIGENAAAELSVGINAYGLATYAVICTXNGLVHIIDAEILVDGCHDIHDCAAVTERVL

SEQ ID NO: 15986 - protein, 479 aa, Salmonella enterica subsp. enterica serovar Paratyphi A str.
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTASDYFKSGKYYWNSGMFLFRASSYLNELKYLSPEIYKACEKAIGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFRPWGKYNVIDSGKNYLVRCITVKPGEKFVAQMHHHRAEHWIVLSGTARVTKGEQIYMVSENESTFIPPDTIHALENPGMIPLQLIEIQSGTYLGEDDIIRLEQRSGFSKEWTNERS

SEQ ID NO: 15987 - protein, 481 aa, Chlamydia muridarum Nigg
MIARTKIICTIGPATNTPEMLEKLLDAGMNVARLNFSHGTHESHGRTIAILKELREKRQVPLAIMLDTKGPEIRLGQVESPIKVKPGDRLTLTSKEILGSKEAGVTLYPSCVFPFVRERAPVLIDDGYIQAVVVNAQEHLIEIEFQNSGEIKSNKSLSIKDIDVALPFMTEKDITDLKFGVEQELDLIAASFVRCNEDIDSMRKVLENFGRPNMPIIAKIENHLGVQNFQEIAKASDGIMIARGDLGIELSIVEVPALQKFMARVSRETGRFCITATQMLESMIRNPLPTRAEVSDVANAIHDGTSAVMLSGETASGTYPIEAVKTMRSIIQETEKSFDYQAFFQLNDKNSALKVSPYLEAIGASGIQIAEKASAKAIIVYTQTGGSPMFLSKYRPYLPIIAVTPNRNVYYRLAVEWGVYPMLTSESNRTVWRHQACVYGVEKGILSNYDKILVFSRGAGMQDTNNLTLTTVNDVLSPSLE

SEQ ID NO: 15988 - protein, 489 aa, Clostridium acetobutylicum ATCC 824
MSAELEKDKNGELKRSLKTRHMNMIAIGGSIGTGLFFTSGNTISTAGPGGAIAAYAIMGVLVYFLMTSLGEMATMIPNAGSFETYASKFVDPALGFALGWNYWFNWAITVAAELVAGGLVVKFWLPNTGTTIWSIGFLVILFGLNLLSAKAYGEGEYWFSSIKVVTIIVFLIMGVLIIFGIMGGHGVGFSNWVLKDGKGNSAPFVGGGMAILMSFLTAGFSFAGTEVVGLAAGEAENPEKDVPKAINSVFWRILIFYIGAIIVIGFIIPFNDSNLLKNGVSDIAYSPFTIVFKRSGIALAASIMNAVILTSVLSCGNSGLYAGSRMMYAMAKEGKAPKIFGKLNKSGVPLNALIFTSVIASTAFFASLIGDGKIYSILYNLSGITTFITWLGIAICHYRFRKAYIAQGNKIEDLKYKALLYPFGPIFAMILCTVVLFGANIWVFQAKTFSWFDFTTNYGSIPLFLCFYFIYKKVHKTRIVSLMECDLNK

SEQ ID NO: 15989 - protein, 401 aa, Agrobacterium tumefaciens str. C58
MPSTADRLKNVSISASAAMTQRARELAAKGIKVVSLSSGEPDFPTPAHAIEAAHAAALNGETKYPPMDGTVAMKAAISRKFKRDNNLTYDASQIVVSAGGKQVIFNAMLATCNPGDEVVIPAPSWVSYADIVKFAGGVPVPVPCFEQAGFKLRAEDLEAAITPRTKWLFLNFPSNPTGAACSRKEMAAIAEVMLRHPHVWILTDDIYEHLVYDGFEFGTIADVEPRLYDRVLTMNGVSKAYAMTGWRLGYCASGSKELITAISNVNGQNGGGITTVTQAAAIAALDGPQDLLKERAAIYRERRDFVLGQLAEIDGLRCHKPEGAFYIYPNISGLIGKTTKGGRKIESDVDFVMALVDEHHVATVQGAAYGMSPYFRLSYATSMEMLGEGCARIAQFCRDIR

SEQ ID NO: 15990 - protein, 352 aa, Oenococcus oeni PSU-1
MGVALGPGILGWIEPNQFIKTFSEFGVVLLMFLAGLGSDLKGLKKFFKPSITIAFSGTIFPLIMTYFVARAFRFNFSQAAFLGVIFSATSVSITVEILREMNLLASNEGITILGSSVADDIISVFVLSLLISFTGSQSNENAMNIVYKILGLVAYFVFAFVVIHWLINYIMFYTKKLFSPMSETVVSIVLCFSMASLSELCGLSDVIGAFFAGLAISTTDSKSEIVKNINPIGYAVFIPFFFVSIGLNVSFEGFTNDFLLILSLTVIGILSKIIGAGFASKFCGFDYPHSYLIGSGMVARGEMALIVAQIGFSANLLTAGRYTAVIMAIILVTLSAPFLVKHAAGRLTKQAS

SEQ ID NO: 15991 - protein, 140 aa, Silicibacter pomeroyi DSS-3
MALERTFSIIKPDATRRNLTGKINAKFEEAGLRIVAQKRIHMTKEQAGVFYGVHAERPFYDELCEFMSSAPVVVQVLEGENAIAKNREVMGATNPADAAPGTIRAEFAESVGENSVHGSDAPETAAVEIAYFFSGIELVG

SEQ ID NO: 15992 - protein, 388 aa, marine gamma proteobacterium HTCC2207
MEHHLIQIFFLIFTGAAVVASLALFGRQPLLVVYILLGAAMGPHGLAWVTDVQLIAEIASIGIIFLLFLLGLDMQPQALLRVFRQVTHVTLISSVIFALAGYGIGYLFGFSATENLIIGTSMMFSSTIIGIKLLPTTVLHHRHSGELMVGMLLMQDFLAIFVLLMLISAASGGDSYMRFAVSLISLPLLIAGSVLMVRYILQPLFARFDRIGEYVFLLAIGWCLGIAELAEYGGLSREIGAFIAGISIATSPIAPYIALNLKPLRDFFLILFFFALGGGFDLSLIPHIALPAIILAIIMLSLKPVVYHWLLRNQSESHGLAWDIGLRLGQNSEFSLLIAYVAFNTSLIGNNASHLIQAAAIITFLISSYIVVFNLTNPIALKDTLRRD

SEQ ID NO: 15993 - protein, 471 aa, Ralstonia eutropha JMP134
MAQSVADVMKLVKENDVKFVDFRFTDTKGKEQHVSVPTSHFDDDKFESGHAFDGSSIAGWKGIEASDMLLMPDSNTAFIDPFYEEPTLVLTCDVVEPSDGKGYDRDPRSIAKRAEAYLKSTGLGDTAFFGPEPEFFIFDGVTWNVDMQGCFVKVHSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLMNPYLGFSALLMAGLDGVMNKIHPGEAADKNLYDLPPEEDAKIPTVCNSLDQSLEYLDNDREFLTRGGVFSNSMLDAYIELKMEEVTRFRMTTHPVEFEMYYSL

SEQ ID NO: 15994 - protein, 348 aa, Pisum sativum
SYADELVKTAKTIASPGRGILAMDESNATCGKRLDSIGLENTEANRQAWRTLLVTVPTLGEYISGAILFEETLYQSTVDGRKIVDVLVEQNIIPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYIGDGESEEAKKDCCQGYSY

SEQ ID NO: 15995 - protein, 631 aa, Oryza sativa (japonica cultivar-group)
MADQKVILAEPLLPGKEADFADDDDVEAQLTSYHTGASFSRTCLNLTNAVSGIGVLSMPYAVSQGGWLSLLLFVLVGAVCYYTGTLIERCMRADGSIASYPDIGQYAFGATGRRAVAFFMYVELYLVAISFLVLEGDNLDKLFPGATMEILGYQLHGKQLFIVLAAAVILPTTWLKNLGMLAYVSAAGLIASVALTASLIWAGVAETGFHRNSNTLNLAGIPTSLGLYFVCFTGHAVFPTIYSSMKNSKHFSKVLLISSVLCSLNYGLTAVLGYMIYGDDVQSQVTLNLPSGKLYTKIAIVMTLVNPLAKYALLVAPITAAVEERLSLTRGSAPARVAISTAILASTVVVASTVPFFGYLMSFIGSFLSVMATVLFPCLCYLKIYKADGIHRTEMVAIAGILLLGVFVAVTGTKRGSHKRSGVTGFSSVETTSTAAVAMAGSQTQSQRLPTPTRQVAGERGWSRWRGGGQWESAVAAAQAAGERQQAAVRGRSRWKGGVGGCRRRKAAVWSRGLEEKETRAPGPRRVGSWSRNAATSSGLKRNLRWCTSSSPGRSLSLASSDAGSYSGWSYAGRGGWRASRGSLAHTGQTLCAFRELTDGLQELRDPRRVDEVVADLGAEHEAATPQSRHL

SEQ ID NO: 15996 - protein, 319 aa, Bdellovibrio bacteriovorus HD100
MKNTLLFSFLPPASVLERALSQFKATISAKELSVEEMLDQVHKIQPAAIVVVPRQKITAEVIKALPDSVKIIATSSVGFDHLDIAAAKERGILLSNTPDVLTECTADLGMMLLLNACRRGREYLSIMQEGWRKTYSQTDMLGLQVSGRTLGILGMGRIGRALADRARGFGMKIIYCNNKRLPPELEKDAVYFKNFHDMLPHCQIISLNAPNTPETKGIMNSKSFSLLPKNAVLVNVARGTLVDEDALIKALESGHLFAAGLDVFCHEPDYNLRLRDFPNVFLTPHMGSATVETRSAMGHRALDNVTAALEGQRPGDFLY

SEQ ID NO: 15997 - protein, 379 aa, Exiguobacterium sibiricum 255-15
MRAVTYQGTKNVEVKDVQDPSIEKNDDIIVKITSTAICGSDLHIYQGNMPAKKDYVIGHEPMGIVEEVGPDVTKVKRGDRVVLPFNVACGHCFFCEHDMESQCDNSNGNPHVDTGGYFGFTEEFGGHPGGQAEYLKVPFGNFMPLVVPESCELEDEALLFLSDVIPTAYWSVINSGVKKGDTVVILGSGPVGLMTQKFAWMQGAKRVIAVDQQVYRLNHAKMTNRVETVNLQDHKETGQYLKELTQGGADVVIDCVGLDGKMSAVEKVEQKVGLQGGTLSAINIAKDAVRKFGTVQLTGVYAKKYNQFPLGDFFTRNITLKMGQAPVVHLMPELFQKIINQEFDPTDIITHKIDLEQAAHAYQTFNDHEDGCIKVILKP

SEQ ID NO: 15998 - protein, 458 aa, Arabidopsis thaliana
MSGNNELNALKGPQSSLPWPFGMASASFAPSHMAPPNFQPQFQLSQDQGISAPGRRFPHKPPIGGPPAVPPSMELTPASRKKKHKLPDKSSLQERVAAVLPESALYTQLLEFESRVDAALFRKKVDIQDSLKNPPSIQKTLRIYVFNTFSNQIPGPDPPTWTLRIFGRVLDPDHTGGLVQNSNPLYPKFSSFFKTLKISLDQSLYPENHLIEWKRDRSPAPLEGFEIKRIGCQEFAATILLEMNYVPEKFKTSPALMQVLGIEVDTRPRIIAAIWHYVKVRKLQNPNDPSFFNCDAALHSVFGEEKMKFTMLSHKISQHLSPPPPIQLVHKIKLSGNNPAISACYDVLVDIPAPVQTELSNLLANPEKNKEIEACDEAICGAIRKIHEHRRRRAFFLGFSQSPVEFTNALMESQTKDLKLVAGEASRNAEKEGRSEFFNQPWVEDAAIRYLNRKPAGG

SEQ ID NO: 15999 - protein, 169 aa, Streptococcus pneumoniae TIGR4
MKIGFIGLGNMGASLAKSVLQTRTSDEILLANRSQAKVDAFIADFGGQASSNEEMFAEADVIFLGVKPAQFSELLSQYQTILEKRESLLLISMAAGLTLEKLASLIPSQHRIIRMMPNTPASIGQGVISYALSPNCRAEDSELFYQLLAKAGLLVELGESLIDAATGLA

SEQ ID NO: 16000 - protein, 417 aa, Onion yellows phytoplasma OY-M
MQTTNPSFKKFLRSEVFRDPIYGYIYLEYELIEKLINTSVFQRLRRIKQLSGANIVFHGAEHSRFTHSLGVYELARRFLKITNIKKHFSETQKLILLVSSLLHDIGHGAYSHSFETLFDVNHETQSARIIKNNKEIGALLDQISPDFKNDVASVIEKTKKFPLIEQILTSQIDIDRLDYLERDSYFTGATYGHIDLERLMRSMIIEPHPSKNNEKCIAFRQSGVFAIENYLINRYHMFWQVYYHPKVRAYSTILEKICKRLCDLLQNNYPVDPYIQPFYNFVNNQTDLDKYLAIDDYYMNGLILHLKNSKDTILKNLCNDFLNRRIWHILDDKDQNQEQIEHIKQQYHSQNPDYIKYYTSSNAAFQNAYSESKPKFETKILIKSQGGLKSLKEESPIIKSLIKSSPKQDNKFFYRLL

SEQ ID NO: 16001 - protein, 322 aa, Magnaporthe grisea 70-15
MAPMIDDGAAFDSHKPTVYVIDTFHPKAIEHARTIFNVVLNTDKEFAGWQQKARAVLIRSSYLRADDIAKCPKLVAIGKHGVGIDKIDKAACDARGIRILNTPGANAQAVAEIVVALAMAVARNIPSIYARQLSGPVPKETCTGQTLFGKTVGVIGMGNIGRKVARMLQRGFDAQIVAFDPYLPADAWADVPHRRVPAYRDLLAESDLLTLHVPLTDETRDMIAYEELKTMKSTAIVINASRGGIVNEADLQRALEEGLIWGAGLDAHEQEPPTAERYGSLWKLPNVVSTPHIGAATDDAQYMSALGAVNNLYDYLKTLGSN

SEQ ID NO: 16002 - protein, 146 aa, Zea mays
  misc_feature (134)..(134): Xaa can be any naturally occurring amino acid
  unsure (1)..(146): unsure at all Xaa locations
RFSPPITPRSSSRELRSRAPLRRPPPPHNRGSCFPLHWTRPASISRSPPSTSHGRYHLSSTSHGRRPLQGLHTASRARLFKEYKEVQREKSADPDIQLICDDSNIFKWTALIKGPSETPYEGGVFQLAFAIPEXYPLLPPQVRFLT

SEQ ID NO: 16003 - protein, 272 aa, Vibrio fischeri ES114
MEHRNIAFIGAGNMTRSIIAGLISSGYPKDKITATNPSTEKLDHLSQCYGIHTSTDNLQAAQQADVIVLAVKPQMMAMAAEPLQQIDFSNKLVISIAAGISAKRLNEMFASELNLVRVMPNTPALVGKGMSGLFAVEHINEQDKCFASDLLSAVGEVCWVAQESGINSVIAAAGSAPAYFFLFMEAMQAEAINQGFDEATARQLVQQAALGAAEMVVANPETQLSTLREQVTSKGGTTAEALRTFNEHQLQEIVAKAMQAAVSRAEEMESLF

SEQ ID NO: 16004 - protein, 268 aa, Onion yellows phytoplasma OY-M
MHHTTKKKYGQNFLTDVNLLNKIVTKASITDKNVLEIGPGKGALTKIIVPQAKHVLAYEIDATLKPFLNFENHNNVNIIYDDFLKRDLLKDFDHYFSPNSQLSLIGNLPYYITSPILFKIIDTPQINDATIMIQKEVGMRLLAQPNNKNYNALSVIIQFLFSIEKIQEVKRHMFFPAPKVDSIVIKLTKNNNICPTFLQQFIKFVKASFKQKRKTLLNNLSCQFLLSKETIIPFFLQHHIPLQIRAEQVTLETFQKLTVKWFIFFNIS

SEQ ID NO: 16005 - protein, 347 aa, Exiguobacterium sibiricum 255-15
MGVKVAVNGFGRIGRMVFRRLIAEGKSEVVAINASYPVETLAHLIKYDTVHGKFAYPVDIIDGALMVNGRQIQIVSERDPEQLPWGQLGIDIVVEATGKFNSKTGAEKHLTAGAKKVVITAPAKGDLRTIVMGVNDEMYDHETDAIVSNASCTTNCLAPVVQVIDRAFGIESGLVTTIHAFTNDQNNIDNPHKDLRRARACGSSIIPTSTGAAKAISLVLPHLEGKLNGLALRVPTPNVSLVDLVVEVSRDTTVAEVNEAFVKAADGALDGILGLTMEPLVSIDFNGEEKSTVVDGLSTMVMGGRQVKVLAWYDNEWGYSCRVVDLVHLVGAHIEATGNEAKQLELK

SEQ ID NO: 16006 - protein, 223 aa, Pseudomonas fluorescens Pf-5
MTQDQLKQAVAQAAVDLILPKLDDKSIVGVGTGSTANCFIDALALHKGTFDGAVASSEATAARLKGHGIPVYELNTVSDLEFYIDGADESDEHLNLIKGGGAALTREKIVAAVAKTFICIADASKLVPVLGNFPLPVEVIPMARSHVARELVKLGGDPVYREGVITDNGNIILDVHNMQITNPVELESQINAIVGVVTNGLFAARPADVLLLGTAEGVKTLKA

SEQ ID NO: 16007 - protein, 272 aa, Vibrio angustum S14
MEQRSIAFIGAGNMARSIIAGLVASGYDAKKITATAPSDARREPLARDFGIHTTSDNLNAAKNADVVVLAVKPQLMEEVCKPLQDINFAGKLVISIAAGINCERLCEMLGQQVELVRVMPNTPSLIGKGMSGLYANPQLTETDRFFATQLLQAVGEICWVQEESGINGIIAAAGSAPAYFFLFMEAMQQEAMNQGFDADTARLLVQQAALGAAELVKANPDTSLSTLRDQVTSKGGTTAEAINTFNQHQLSDIVAKAMQAAVSRAKEMEQLF

SEQ ID NO: 16008 - protein, 314 aa, Triticum aestivum
  misc_feature (117)..(117): Xaa can be any naturally occurring amino acid
  misc_feature (134)..(134): Xaa can be any naturally occurring amino acid
  misc_feature (146)..(146): Xaa can be any naturally occurring amino acid
  misc_feature (170)..(170): Xaa can be any naturally occurring amino acid
  misc_feature (261)..(261): Xaa can be any naturally occurring amino acid
  unsure (1)..(314): unsure at all Xaa locations
NKFVQKSRLVPVRNSRDIVDPRVRKKPSASSLAVSTAKRGVRVVAEAAAGSPPPSAVSAQRTQPSAAQVARPVVELAPSGTLSLVGPAGCPLGVGPRFVPDPPGAPPLCLAHSGSDXPDGPGQFSTLSLGQSGXRTPPCTFLGALXKPSDKYELKNLSTRWEPKFGEEIXEDRLYLISVERILHMEDFNEGRVWVVPSEYSDAEPDPLRNFAESVVEEMNSEHSEDVHRIYNIYAESDFQALDVKMIWVDRLGFDLHVHSXKGIFAVRIPFSRQVSDQKAVKSSFNMMAHHAWEVDKSYATPEFEKVQFLKKVT

SEQ ID NO: 16009 - protein, 279 aa, Silicibacter pomeroyi DSS-3
MSAIDTLPPLREVIASHQLSARKSLGQNFLLDLNLTAKIARQAGDLSECDVLEIGPGPGGLTRGLLAEGARRVLAIEKDARCLPALAEIAAAYSGRLEVINGDALEIDPLAHMTPPIRIAANLPYNVGTELLVRWLTPRDWPPFWQSLTLMFQREVAERIVAKPGSKAYGRLALLAQWRAEARIVMSLPPEAFTPPPKVSSAVVHLTALPEPRFPADAAILSRVVAAAFNQRRKMLRAALKGQAPDIEDRLLAAGIKPTERAEQVPLEAFCALARELAR

SEQ ID NO: 16010 - protein, 409 aa, Pseudomonas fluorescens Pf-5
MSKTSLDKSKIKFLLLEGVHQSAVDVLKAAGYTSIEYLTGSLPEAQLKEKIADAHFIGIRSRTQLTEEIFDHAKKLVAVGCFCIGTNQVDLSAARERGIAVFNAPYSNTRSVAELVLAEAILLLRGIPEKNASCHRGGWIKSAANSFEIRGKKLGIVGYGSIGTQLSVLAEGLGMQVFFYDTVTKLPLGNATQVGNLHELLGMSDIVTLHVPETAATQWMIGEKEIRAIKKGGILINAARGTVVELDALADAIKDKHLIGAAIDVFPVEPRSNDEEFESPLRGLDNVILTPHIGGSTAEAQANIGLEVAEKLVKYSDNGTSVSSVNFPEVALPAHPGKHRLLHIHENIPGVMSEINKVFAENGINISGQFLQTNEKVGYVVIDVDAEYSDLAQEKLQHINGTIRCRVLF

SEQ ID NO: 16011 - protein, 228 aa, Ralstonia eutropha JMP134
MTQDELKALVAQAAADYVKQEVPEGAVLGVGTGSTANLFIDAVAAFKDRFAGAVSSSEASTRRLQQHGFKVLDLNEVDDIPVYVDGADEIDASGAMIKGGGGALTREKIVASVAGRFVCIADGSKLVETMGAFPLPVEVIPMARAAVARQVAALGGQPRLRMNKDGGIYKTDNGNVILDVSGLKITDPRGLEQSINQIPGVVTVGLFALRGANVLLLGTGEGVQRTDY

SEQ ID NO: 16012 - protein, 261 aa, Candida albicans SC5314
MPQNEYIEQHIKKHGRRLDYEERKRKKEAREGHRVAKDAQTLKGWRAKQFAKKRYAEKVAMKKKIKAHQESKVKGPSTPKAEDGEALPTYLLDRQTNNTAKAISSSIKQKRLEKADKFQVPLPKVKGISEEEMFKVIKTGKSKSKSWKRMITKHTFVGEGFTRRPVKMERIIRPAALRQKKANVTHPELGVTVFLPILGVKKNPQSPMYTQLGVLTKGTIIEVNVSELGLVTAGGKVVWGKYAQITNEPDRDGCVNAVLLV

SEQ ID NO: 16013 - protein, 106 aa, Zea mays
MASGSGKAKASSWAAAMSVGTVEALKDQAGLCRWNYAFRQAAQQRARRPAAGASGSVGPGSGSGSAHAPPASAPSGCAAAARRRARQQQEEELRTVMYLSNWGPNN

SEQ ID NO: 16014 - protein, 537 aa, Streptococcus dysgalactiae subsp. equisimilis
MQKQWWHKATIYQIYPRSFKDTSGNGIGDLKGITSQLDYLQKLGITAIWLSPVYQSPMDDNGYDISDYEAIAEVFGNMDDMDDLLAAANERGIKIIMDLVVNHTSDEHAWFVEARENPNSPERDYYIWRDEPNNLMSIFSGSAWELDEASGQYYLHLFSKKQPDLNWENAHVRQKIYDMMNFWIAKGIGGFRMDVIDLIGKIPDSEITGNGPRLHDYLKEMNQATFGNHDVMTVGETWGATPEIARQYSRPENKELSMVFQFEHVGLQHKPNAPKWDYAEELDVPALKTIFSKWQTELKLGEGWNSLFWNNHDLPRVLSIWGNDSIYREKSAKALAILLHLMRGTPYIYQGEEIGMTNYPFKDLTEVDDIESLNYAKEAMENGVPAARVMSSIRKVGRDNARTPMQWSKDTHAGFSEAQETWLPVNPNYQEINVADALANQDSIFYTYQQLIALRKDQDWLVEADYHLLPTADKVFAYQRQFGEETYVIVVNVSDQEQVFAKDLAGAEVVITNTDVDKVLETKHLQPWDAFCVKLSV

SEQ ID NO: 16015 - protein, 563 aa, Pseudomonas fluorescens
MRPVRPVQNRLKETHMQDWQRSVIYQIYPKSFYSHGGQATGDLLGVVDKLDYLHWLGVDYLWLTPFLRSPQRDNGYDISDYYAIDPSYGTMADCELLITEASKRGIKLMLDIVVNHTSIEHPWFQAARSSLDNPYRDFYIWRDQPNNWESKFGGSAWEYEAQTGQYYLHLFDHTQADLNWDNPQVRAEVFKMMRFWRDKGVGGFRLDVINLISKPADFPDDHTDGRRFYTDGPNVHRYLQEMHREVFEGFDLINVGEMSSTSLEHCVRYSCPASRELSMTFNFHHLKVDYPNLQKWVRADFDFLELKRILSDWQVGMQAGDGWNALFWCNHDQPRVVSRFGDDGEYREPSAKMLATALHFLQGTPFVYQGEELGMTNPGFEHIEQYRDVETLNIYRLKRNAGVSEANAMASIMQKSRDNGRTPMQWNAGPNAGFSRAEPWIGVPANAAFINVEQQQQDPTSVLHYYRQLIALRRSEALIQDGVYRLLLPEHPHVWAYLREGQGERLLVVSHFYGGDCEVELPEGVLTHDTKQRWVIGNYEAGEHRYRRLRLRPYESFVLHLSD

SEQ ID NO: 16016 - protein, 505 aa, Candida maltosa
MAIFTPELWLICFAVTVYIFDYIYTKYLMYKLGAKPITHVIDDGFFGFRLPFLITLANNQGRLIEFSVKRFLSSPHQTFMNRAFGIPIILTRDPVNIKAMLAVQFDEFSLGLRYNQFEPLLGNGIFTSDGEPWKHSRIMLRPQFIKSQVSHVNRLEPHFNLLQKNITAQTDNYFDIQTLFFRFTLDTATEFLFGQSVHSLNDGENSLQFLEAFTKSQAILATRANLHELYFLADGIKFRQYNKMVQDFSQRCVDKVLNMSNSEIDKLDRYFFLYEMVKITRNPQVLRDQCLNILLAGRDTTASLLSFAFFELALNEPIWIKLRTEVLHVFQTSLELITFDLLKTKCPYLQAILHETLRLYPSVPRNARFSKKNTTLPHGGGVDGMSPILIKKGQPVAYFICATHVDEKFYTKDALIFRPERWCEEPLIKKNLAWSYLPFNGGPRICLGQQFALTEASYVLTRLAQCYTKISLQPNSFEYPPKKQVHLTMSLLDGVHVKISNLSIS

SEQ ID NO: 16017 - protein, 409 aa, Nostoc sp. PCC 7120
MKAVVFHGIGDIRLDNVPEPKIKEPTDAIIRLTSSAICGTDLHMIRGTFTGMKPGTILGHEGVGIVEELGSNVRNLQVGDRVVVPSTIACGYCSYCRSGYHAQCDNANPHGHNAGTAFFGGPEAAGPFDGLQAEYARIPYANAGLVKLPKEVTDDQAILLSDIFPTAYFGADIAEITPGDTVAIFGCGPVGQFAIVSARLFGAGRIIAVDTIPSRLEMARDLGAEVIDYNAEDPIEAIRELTGGIGVDRVIEAVGVDANAPDSGPAAKKARQEAQQFQQQLQQIAPETNPQNGNWHPGNAPSQALEWSIQALAKAGTLSIIGVYPPTHNFFPIGTAMNKNLTINMGNCNHRKYIPLLVDLVRNGTVDPTKVLTQVEPLMSVIDAYKAFDQRQPGWVKVELVPGAALANV

SEQ ID NO: 16018 - protein, 521 aa, Candida maltosa
MIDEILPKLVQYWYIVLPTLLIIKHVVSYINTQRLMRKFRAKPVTNVLNDGFFGIPNGIKAIKEKNKGRAQEYNDEKFAAGPKPKVGTYLFKLFTKDVLVTKDPENIKAILATQFEDFSLGKRLDFFKPLLGYGIFTLDGEGWKHSRAMLRPQFAREQVGHVKLIEPHFQSLKKHIIKNKGQFFDIQELFFRFTVDSATEFLFGESVESLKDESIGYDQQDFDFDGRKNFAEAFNKAQEYLGTRAILQLFYWLVNGADFKKSVAEVHKFTDYYVQKALDATPEELEKHSGYIFLYELVQQTRDPKVLRDQSLNILLAGRDTTAGLLSFALFELARNPEVWSRLREEIGDKFGLDEDATIEGISFESLKQCEYLKAVVNECLRMYPSVPRNFRIATKHTTLPRGGGPDGKDPIFIKKGAVVSYGINSTHLDPMYYGPDARLFNPDRWSKPETKKLGWAFLPFNGGPRICLGQQFALTEASYVLVRMIQNFKELELTPNTVYPPRRLTNLTMSLYDGAYIKVN

SEQ ID NO: 16019 - protein, 401 aa, Arabidopsis thaliana
  misc_feature (307)..(307): Xaa can be any naturally occurring amino acid
  unsure (1)..(401): unsure at all Xaa locations
RQSEESKRGEEGSLAFEEIQRIVLLTAGAVSVSIENQRSLRRSVFKQNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYXLKDHPDNFRFDKALSREEKNKKGGKMYVQDKIEEYSDEIFKLLDNGAHIYFCGLKGMMPGIQDTLKRVAEERGESWDLKLSQLRKNKQWHVEVY

SEQ ID NO: 16020 - protein, 269 aa, uncultured archaeon GZfos26D6
MRSKFAGRIKNIEISGIRKAFEALSGDFFNLGLGEPDFDTPEHVKIAAMQALKSGFTSYTSNKGIDELREAISAKLYRDNNLAFSPDEMIVTSGASEALHIAIHSVVERGDEVLIPNPGFVSFAALTELAEGKPIGVPLSDDFSISAEAVKEKITDKTKALIINSPANPTGAVESEENIKALVDIAHDHHVTIISDEVYEQLIYDDLKHISPARFSDDVITVNAVSKTYAMTGFRLGYVAARSEYTEQMLKVHQYVQACASSISQKAAL

SEQ ID NO: 16021 - protein, 461 aa, Burkholderia mallei ATCC 23344
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAANVLNLVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 16022 - protein, 510 aa, Candida maltosa
MIDALYILIVALVIYKTAQFVHRKSLEKKHHCQPVKQIPLVSILSGLGFDMFFKDTAEMTKNGGLHKKLQQMLESLQTTTFRSRMLTGSQIVTMEPENERTMCSSAHMKDWTIGYRPFALKPLLGDGIFSSEGESWKHSRIMLRPIFAKEHIKQITAMEPYMLLLIEIIKSSSANEGPVDLQPLFHAFTIDYASDFLFGESCDVLKENLGGKSTSGMDAQVKRDFASVFNDVQNYLTKRMMLGPLAFLVSSKDFHDGIKKQHEFVSYFVQKAISMSDEELNDESKNYVFLYQLAKQTKDAKVLQDELLSILLAGRNTTASLLSFLFFELSHHENVWTTLKEVVDQSFPDVESITFETIQNCDYLRWCLFESLRVNPSVPFNSRTANKDTILPRGGGEDCSHPILVKKGDQVLFPLYASNRQEKYFGRKPEEFIPERWRDLPKTGGPAFMPFSTGPRMCLGQQFALIEASYVTIRLVQTFSKLKSHSLEYAPKRLVAATIRLIDGCFVSFE

SEQ ID NO: 16023 - protein, 485 aa, Mycobacterium sp. MCS
MTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDLVIKEALRLLAPVPLVMRKTVRDVAIDGYHIPSNTLCAITPAVNHFDRTIWSDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 16024 - protein, 519 aa, Candida maltosa
MIFTAFILDYWYFTLLFLIAAYFIGKHVYTNYLMRKHHAEPILDVVDDGAFGFKFGFQSLKAKKIGNQIDLLFLKFNEAKHPSIGTFVTRSFGMQFIATKDPENIKAMLATQFNEYTLGQRLNFLAPLLGKGIFTLDGNGWKHSRAMLRPQFSRDQIGHVKMLEPHFQLLKKHIIKNKGTFFDIQELFFRFTVDSATEFLFGESVSSLKDESIGYDQEEIDFAGRKDFAEAFNKSQVYLSTRTLLQLLYWLVNSADFKRCNKIVHKFSDYYIKKALTATPEELEKHSSYIFLYELAKQTRDPIVLRDQSLNILLAGRDTTAGLLSFAVFELGRNPEVWSKLRQEIGHKFGLDSYSRVEDISFELLKLCEYLKAVLNETLRLYPSVPRNARFAAKNTTLPHGGGPDGMSPILVRKGQTVMYSVYALQRDEKYYGKDANEFRPERWFEPEVRKLGWAFLPFNGGPRICLGQQFALTEASYVLARLIQSFETLELSPEAAYPPAKLSHLTMCLFDGTPVRFE

SEQ ID NO: 16025 - protein, 189 aa, Brassica napus
  misc_feature (19)..(19): Xaa can be any naturally occurring amino acid
  misc_feature (26)..(26): Xaa can be any naturally occurring amino acid
  misc_feature (129)..(129): Xaa can be any naturally occurring amino acid
  unsure (1)..(189): unsure at all Xaa locations
AAISQDSGLVPIVEPEILXLDGEHDXIDRTYEVAEKVWAEVFFYLAQNNVMFEGILLKPSMVTPGAESKDRATPEQVASYTLKLLRNRIPPAVPGIMFLSGGQSELEATLNLNAMNQAPNPWHVSFSYXRALQNTCLKTWGGRAENVNAAQTTLLGRAKANSLAQLGKYTGEGESEEAKEGMFVKGYTY

SEQ ID NO: 16026 - protein, 519 aa, Candida maltosa
MVFTAFILEYWYFTLLSLAAGHFIGKHVYTNYLMRKHHAEPILDVVDDGAFGFKFGFQALKAKKIGKQIDLLFKKFNEAKHPSIGTFVTRSFGMQFIATKDPENIKAMLATQFNDFTLGQRLSYFAPLLGKGIFTLDGEGWKHSRAMLRPQFSRDQVGHVKMLEPHFQLLKKHIIKNKGSFFDIQELFFRFTVDSATEFLFGESVSSLKDESIGYDQEEIDFAGRKDFAEAFNKSQVYLSTRSLLQLLYWLVNSSDFKRCNKIVHKFSDYYIKKALTATPEELEKHSSYIFLYELAKQTRDPIVLRDQSLNILLAGRDTTAGLLSFAVFELGRNPEVWSKLREEIGDKFGLDPDSRIEDISFELLKLCEYLKAVINETLRLYPSVPRNGRFAAANTTLPHGGGPDGMSPILVRKGQTVMYSVYALQRDEKYYGKDANEFRPERWFEPEVRKLGWAFLPFNGGPRICLGQQFALTEASYVLVRLIQSFETLELSPDAPYPPAKLTHLTMCLFDGAPVRIE

SEQ ID NO: 16027 - protein, 506 aa, Ralstonia eutropha JMP134
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 16028 - protein, 275 aa, Pseudomonas fluorescens Pf-5
MSSHTRTQRLSVPQLVAMKGRQKIVSLTAYTSHMARLMDPFVDFILIGDSTAMVGYGRTSTLDMSLAEIIAHTRAVVAGSRLACVIADMPFGSYQESPQQAYRNCAEVMARTGCAALKLEGGRALAPTVEFLVQRGIPVMAHIGLMPQFVNQMGGFKAQGLDSEAARKIEEDARAHLEAGAFSLLLEGVAEPLARRISDFSPMPTIGIGASPACDGQVLVTEDLLGLGGPQVPRFVKQYADAGALISQACERFAAEVREQAFPQLQHCYGVVQEA

SEQ ID NO: 16029 - protein, 444 aa, Oryza sativa
MPEGGIPACFRGAPGGGAGGGGGGGVGVAGQSSGGVGTSLATSVYETRLGVAALSWSRAALGLSLRVVLRVAGGAGAGAWAAASSSAASDYGCYDEGAECYGGEEEEEEEEATVAVRVRPWLLWRRRGSKRFRVRDRRVDLAWDLTRARFACPGSPEPSSGYFVAVVVDGEMALVAGDMAEEAYRKTKARRGPGPDAVLISRREHVSMRDAGHGRGHKTFVNVRGKEREISVDLVSRGHGKDRDKDKDKERDKADVGMSVTVDGERVLHIRRLRWKFRGTEKVDLGGGDGVQVSWDLHHWLFPNRDTAPADASAVTPPPQPAHAVFIFRFELADIAGDDRDSAEVKDEHLLENAGSGGGGGAWAGYLGRWGRGDWSESSSNGENRRKRGQARRLAKASSSSSASVASSSASWASGSTVMDWASPEEAELQRGHGFSLLVYAWKC

SEQ ID NO: 16030 - protein, 489 aa, Oryza sativa
MPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVKALRILDENCCVGCRSNVEEMRSIQETMQNKELAVLSISLFFACLALFKLACDRVLFLFTRKGAAAAERMCGASKGWILVLASSSFTTFLVLLYN

SEQ ID NO: 16031 - protein, 381 aa, Pisum sativum
CVFDAKSVLSSSRRKHVNGSGVRCMAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 16032 - protein, 832 aa, Methylococcus capsulatus str. Bath
MASKKSDPKKTAPAPDAPEHTRTGMSPEILKAAFIDNLTLAVGRPLETAVPEDWYQAIALSVRDRIMQRWVRQFEKRNAPDVRQVAYLSAEFLPGPHLGNSLLNLGITDNAREALAGQDLDLYIGLEEEPGLGNGGLGRLAACYLDSLATLRYPATGYGIRYEFGIFDQAIKDGWQVETTDKWLLPGNVWEIKRPNFAQVVKIGGHTETFTDQHGAFRVRWIPDRVVVGVPYDTPIVGYLSDSCVLLRLWSAEAAQSFDFADFNRGDYYGAVEEKVFSENISKVLYPNDEQLEGKRLRLEQQYFFVACSIKDMIRLCLRRGSTLERFHEMFCVQLNDTHPAIAVAELMRQLVDKYAMPWERAWDITRRTFSYTNHTLLPEALEKWPLPLFGSVLPRHLEIVYEINRRFLDEVRTRFPGDEDKIARLSIIDESGEKYVRMANLAMVGSHTVNGVAELHSELVKTQLFPDFHDLDPKRFQNVTNGVTPRRFLGLSNPGLTRLIDGCIGDSWLSDLDRLRELEAFAGDAGFQQDWMRIKLENKSRLARIIRDRTGVVVDPTSLFDIQVKRIHEYKRQHLNVLHIITLYQRLKHDPRLQITPRTFLFGGKAAPGYYMAKLIIKLINAVADTVNQDPAVRDLIKVVFLPDYNVKHAQNIYPAADLSEQISTAGKEASGTGNMKLSLNGALTIGTLDGANVEIREEVGAENFFLFGLTCEQAARLRADGYNPGDYCHGDPELRGVIELIDSGLFSHGDRELFRPLTAHLLERDDYLLMADYRPYVNCQQQVGHAYRDCQHWTRMSILNVARMGKFSSDRAVREYAANIWKLKPFTPDP

SEQ ID NO: 16033 - protein, 169 aa, Arabidopsis thaliana
  misc_feature (108)..(108): Xaa can be any naturally occurring amino acid
  misc_feature (114)..(114): Xaa can be any naturally occurring amino acid
  misc_feature (120)..(120): Xaa can be any naturally occurring amino acid
  misc_feature (127)..(127): Xaa can be any naturally occurring amino acid
  misc_feature (130)..(130): Xaa can be any naturally occurring amino acid
  misc_feature (136)..(137): Xaa can be any naturally occurring amino acid
  misc_feature (140)..(140): Xaa can be any naturally occurring amino acid
  misc_feature (143)..(143): Xaa can be any naturally occurring amino acid
  misc_feature (148)..(148): Xaa can be any naturally occurring amino acid
  misc_feature (150)..(150): Xaa can be any naturally occurring amino acid
  misc_feature (162)..(162): Xaa can be any naturally occurring amino acid
  misc_feature (164)..(164): Xaa can be any naturally occurring amino acid
  misc_feature (167)..(167): Xaa can be any naturally occurring amino acid
  unsure (1)..(169): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYXREHGNXTPGYYXWTGTWTXWKXSIVRIXXDFXLKXFKGSXKXSKKGFPGAFIRXNXFCXNR

SEQ ID NO: 16034 - protein, 103 aa, Zea mays
  misc_feature (48)..(48): Xaa can be any naturally occurring amino acid
  misc_feature (72)..(72): Xaa can be any naturally occurring amino acid
  unsure (1)..(103): unsure at all Xaa locations
MTSPKEATPVQFHTTGRLSLCSFCFASASGRRRFAAVRASEETMATEXLGIKEERYPPEARLSKLGGRQRPXRGCEKSKLPWTYFAKVTCYLLQGKVIVLPEG

SEQ ID NO: 16035 - protein, 589 aa, Saccharophagus degradans 2-40
MDHSTIFNVLAYLGAAVVAVPLFRKLGLGAILGYLFAGAVIGPQGFQFIDHPESALHFAEFGVVMLLFLIGLELNPEKLWNMRVQIGLLGGGQLLISALIIAVSLVVGMQWGWHLAIITGLTLGLSSTAFAVQLMDEQGIMGTALGRKGFSILLLQDMAVIPLLLLVSAWAPTSIESTSGHALPWWSGLCAVIAVLLIGRFALGPILTLVARYGSKEVLTAGSLLIVLGTAVLMQYVNLSMGMGAFLAGIILANSSFRHQLEADIEPFKGLLLGLFFIAVGMSLDLQLLLKEPLVILGLALALMLAKATVIMLLTQLRACTWKEGFLLGLMLSQGGEFAFVVMTKAVGLNVIDQSLANYVVMVVGISMALTAPLVMLFKRFIHKPIPANTNYDAATGEEPEVVIAGFGRFGQIVGRILVANNIHFTALDKDPTHVDFVKQFGNKIFFGDAARMDLLRAAGIDHARVLIIAVDDMEDATRIAQQVRHEFPKLKIIARAHNRMHNYQLVAAGCNEIIRETFESSLHAARSTLVALGVNDGQAMFKVELFRMHDEELIQRAAKHRDDMPELLKIAQEGRKELERLFEQDKHN

SEQ ID NO: 16036 - protein, 132 aa, Arabidopsis thaliana
  misc_feature (118)..(118): Xaa can be any naturally occurring amino acid
  misc_feature (122)..(122): Xaa can be any naturally occurring amino acid
  misc_feature (128)..(129): Xaa can be any naturally occurring amino acid
  unsure (1)..(132): unsure at all Xaa locations
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNNSRILXMDGXWTMWEXXLFG

SEQ ID NO: 16037 - protein, 215 aa, Legionella pneumophila subsp. pneumophila str. Philadelphia 1
MWLQRKSLKHKSMCDPVHGIMCVENELYITIKRVIDSHYFQRLRQIKQLSFAEFAYPGAVHNRFSHSIGACYLSTVVFSTIYNDSTNNEDQKICLALTALIHDIGHGPFFHSFEKIFNYALNFVDNKIGKISHEDWTQVFLKKLIEENYIERNYGRVVEDIYTKETNKLHGIISSQLDVDRFDYLLRDSHFYGVSYGNFDLLWLINRLCEQDGVT

SEQ ID NO: 16038 - protein, 277 aa, Chlamydia muridarum Nigg
MARSSIEQLTSFLKSVNGRAKKALSQNFLVDGNILRKILATADVQPGDWVLEIGPGFGALSEVLVSQGANVIALEKDPMFEESLSQLPIDIEITDACKYPLASLDDKGWKGKGRIVANLPYHITTPLLTKFFLECPNRWKTVTVMIQDEVARRITANPGDKDYSSLTVFLRFFADVQYAFKVSPNCFYPKPSVSSAVVHMRVHEDFPLSGSEIDEFFALTRAAFGQRRKLLANSLKNLYPKDKVFQVLEHLGFSEKTRPETISLEEYLKIFRLLKDF

SEQ ID NO: 16039 - protein, 301 aa, Prosthecochloris aestuarii DSM 271
MRNDKWDAGRIARQDGRIALISGANSGIGFDTAVVLAGKGAEVVLAVRDIGKGEEACKAIRKDFPDAALQVMLLDLADLSSVRRFAYAFLARYSRLDLLINNAGVMVPPQRCVTVDGFELQFGTNHLGHFALTLLLSGLLKQTPSSRVVTVSSGAHYFGKLDFSDLNWQRRPYRKWQAYGDSKLANLYFTRQLQRRLAEDHASTIAVAAHPGWSGTNLQRYEPLAMLMNRFFAQTSAMGALPELYAATARDVAGAEYFGPGGIGGLRGYPVRCSSSRLSEDQGVGQRLWEVSEVLTGVFWQ

SEQ ID NO: 16040 - protein, 102 aa, Glycine max
MASGSLKNMLSVAMNQGVVEARARIFGHQLNPTGMKTPHKLLRMKLFGEKVAQWYPHDIKKDDPLVMARQEQERLSKLEMLKRRGKGPPKKGQGRRAAKRNK

SEQ ID NO: 16041 - protein, 548 aa, Lactobacillus sakei subsp. sakei 23K
MQTNWWQNAVFYQVYPRSFQDSNGDGIGDIQGIIQRLDYLADLGVNAIWLSPVYQSPNVDNGYDISDYQAINPEYGSMVDMEQLIEAAKIRKIKIVMDLVVNHTSDQHPWFLEARKSKDNPYRDFYIWRDPATDGSVPNDLQSNFKGSAWAFDAVTGQYYLHFYAKEQPDLNWQNPKVREAVYQMMTWWLQKGIGGFRMDVIDLIGKEPDRKIKENGPQLHAYLQEMNARVLSQYDVVTVGETWGATPEIGQMYSNPNRHELSMIFQFEQINLDKQSGMTRWDLKPLIPAELHAVFSKWQLALDGVGWNSLFWSNHDLPRIVSRWGDDSQYREKSAQALAIYLHMLKGTPYIYQGEEIGMTNYPITSYHEIEDIESRRVYQQRQQQGYAISDILNGINAKGRDNARHPMQWNGKNQSGFTDGTPWLPVNPNYLEINVELAKQDERSIYATYQQLIKLRKRNAIIRQGRFENVPTGNQNVISYKRMLGEQSWLVIINLSKNRESYTLPIQHFGPNQKIISNNLLLNKIAISGVLQPYDALVVAIGNEEK

SEQ ID NO: 16042 - protein, 387 aa, Bacillus cereus E33L
MEQFINPRVKDIQISGIRQFSNMIQNYDNLISLTIGQPDFPTPSLVKEAAKRAITENYTSYTHNAGLLELRKAACNFVKDNYDLHYSPETETIVTIGASEAIDVAFRTILEPGTEVILPAPIYPGYEPIIRLCGATPIFIDVRETGFRLTAEALENAITEKTRCVVLPYPSNPTGVTLSKKELQDIADVLKDKNIFVLSDEIYSELVYEQTHTSIAHFPEMREKTIVINGLSKSHSMTGWRIGLLFAPSYLAGHILKVHQYNVTCATSIAQYAAIEALTAAKDAPKMMRHQYKKRRDYVYNRLIQMGLTVEKPTGAFYLFPYVGHLTSSSFDFALDLVEEAGLAVVPGTAFSEYGEGYLRLSYAYSIETLKEGCDRLEAFLQQKAKS

SEQ ID NO: 16043 - protein, 245 aa, Chlorobium tepidum TLS
MVGNWKMNNTIAESVDLATAIAEKVGADGVQCEVGIAPTFPALYEVCKVIEWSGIRLCAQNCHYESDGPFTGEVSTRMLAAAGCSYVILGHSERRQLFGETNATVNLKVKKALAEGLSVILCVGETLDERERGVTGQIVTAQVVEGLIDVTDISKLVIAYEPVWAIGTGKTATKEQAQEVHALIRAKVTELYGQKAADHLRIQYGGSVKPSNAAELFAMPDIDGGLIGGASLNADDFMAIVEAAG

SEQ ID NO: 16044 - protein, 378 aa, Arabidopsis thaliana
MSRLFLVVSSNVCSDSDFSFLLDPYSDSVSLFADLVRCCISAMDLASNLGGKIDKSDVLTAVEKYEQYHVFHGGNEEERKANYTDMVNKYYDLATSFYEYGWGESFHFAQRWKGESLRESIKRHEHFLALQLGIQPGQKVLDVGCGIGGPLREIARFSNSAVTGLNNNEYQITRGKELNRLAGVDKTCNFVKADFMKMPFPENSFDAVYAIEATCHAPDAYGCYKEIYRVLKPGQCFAAYEWCMTDAFDPDNAEHQKIKGEIEIGDGLPDIRLTTKCLEALKQAGFEVIWEKDLAKDSPVPWYLPLDKNHFSLSSFRLTAVGRFITKNMVKILEYIRLAPQGSQRVSNFLEQAAEGLVDGGRREIFTPMYFFLARKPE

SEQ ID NO: 16045 - protein, 377 aa, Thermotoga maritima
MVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 16046 - protein, 159 aa, Arabidopsis thaliana
MKEDDALPTTTTTGTATGTAMANSKKESSDSVLFGRGRYKFWAFAAILLLAFWSMFTGTVTLRLSTGNLNRLSEDLGIPNYDNLDVLEMEEREKVVKHMWDVYTNSRRIKLPRFWQEAFVAAYEELTSDVPGVREAAIGEIAKMSARSITLDPPPSRSR

SEQ ID NO: 16047 - protein, 384 aa, Symbiobacterium thermophilum IAM 14863
MNVERTQELLVNMGPQHPSTHGVLRLMIKLDGEQVTWCEPDIGYLHRCFEKLAEQKTYPQVIPFTDRTDYLAAMLNELCYVEAVEKLFGDAIQVPERAQYIRVMLAELQRITSHLLALGSMAMDLGATTPFLYCWRDREKLYSLFERITGGRMLYNYLRIGGVRNDLPEGILGTPQDGEDKADKTIWGFINYFDSYVYPEWKALVTGNRIFQYRTKNIGVLTAEQAIAYSCSGAVLRGSGVKWDLRKNLPYAIYDRFEFDIPVGQNGDSFDRWWVRQEEMYQSSRIVKQCLEWLAENPGPVMAPKMPRVLKPPKGEVYHRIEGARGEVACYVVSDGSTNPYKVKWRSPAFTHLQLMPLLCPGHKIADIIAILGSIDVVLGEVDR

SEQ ID NO: 16048 - protein, 228 aa, Arabidopsis thaliana
  misc_feature (69)..(69): Xaa can be any naturally occurring amino acid
  misc_feature (84)..(84): Xaa can be any naturally occurring amino acid
  misc_feature (89)..(89): Xaa can be any naturally occurring amino acid
  misc_feature (149)..(149): Xaa can be any naturally occurring amino acid
  misc_feature (209)..(209): Xaa can be any naturally occurring amino acid
  unsure (1)..(228): unsure at all Xaa locations
MSAFTSKFADELIANAAYIGTPGKGILAADESTGTIGKRLASINVENVETNRRNLRELLFTAPGALPCXSAVSSLFEETLYQKXSDGKXFVDILKEGRSFFQVSRVDKGYPFELAGKPTVRHHSGVLTGLGDRCKKYYEAGARFAKWRXAVLKIGENEPSEHSIHENAYGLARYAVSARRTVLVPLVEPGNLSRWTHDIQKWCCGKMDXVLALANRSYRHHVLVEVTL

SEQ ID NO: 16049 - protein, 558 aa, Arabidopsis thaliana
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGLSVAANFFSFLVFVSGKRFYKHDKPLGSPFTSLLCVIFAALRKRKAVVSTNEKDYHNESITMPTKSFRFFNRAALKQEDEVKPDGTIRNPWRLCSVQQVEDFKAVIRIIPLALATIFLSTPIAMQLSLTVLQGLVMDRRLGPSFKIPAGSLQVITLLSTCLFIIVNDRVLYPFYQKLTGKHLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWILVIGGVLNLGYFLVCSWLYRYRNLKDDDHKQAANVSH

SEQ ID NO: 16050 - protein, 386 aa, Prosthecochloris aestuarii DSM 271
MTNFVFTDIALVVIAATLLGWLSLLTRQPIIIAYILAGVLLGPWGFKVITEIQFINEVSDIGITLLLFLAGLSLHPGKLFELFGKTFFLTLFTSTVFAGVTGAILYGFGATATEAIITGVAMMFSSTILVVKLMPTNTLHQKHMGAVAIAVLIMQDILAVLAIAFIKGGSGSTLLGWITSMAAGILLAFAAIVAERYAIRKIISQVQRYNELLNLVTLAWCFALALLAEKIGLSHEIGAFIAGVSLANGPISNFLAEGLKFFRDFFLVLFFFTLGAKLDFSLLITVLKPALLLTTALLFLKPLIYWSGFRLTGETMKFSREMGFRLGQNSEFALIIAVIAAESGVLSQANSQLIQLVTILTMTISSYILVFFFPTPLGTSKPLKID

SEQ ID NO: 16051 - protein, 390 aa, Burkholderia thailandensis E264
MNAPHDMPTTPTLLSRLPDVGTTIFTVMSALAAEKGAVNLGQGFPDFDCDPRIVDAVARAMRDGRNQYPPMAGIAPLREAIADKIARLYGHRYDAATEITVTAGATQALLTAILCAVHPGDEVIVIEPTYDSYLPSIELAGATPVFVTLNAPDYAIPFDKLAAAITPKTRAILINTPHNPTGTVWREADMRALADIVRGTHLLIVSDEVYEHMVYDGTRHESVARYPELAARSIVVSSFGKTFHVTGWKVGYVAAPAPLTAEFRKVHQFNVFTVNTPMQFGLADYLRDPEPYLTLPAFYQKKRDFFRAGLANTRFKLLPCAGTYFQCVDYSTISDLPEAEFAKWLTTEIGVAAIPVSAFYHEPHESGVVRFCFAKREDTLATALERLARL

SEQ ID NO: 16052 - protein, 398 aa, Caulobacter crescentus CB15
MVPAIPETPVRKFNINFGPQHPAAHGVLRLVLELDGEIVERVDPHIGLLHRGTEKLMEARTYLQNIPYFDRLDYVAPMNQEHAFCLAIEKLLGVEVPIRGQIIRVLYSEIGRILNHLLNVTTQAMDVGALTPPLWGFEEREKLMVFYERACGARLHSNYFRPGGVHQDLPPELVEDIDTWAKAFPKICDDIEGLITDNRIFKQRNVDIGVVSKEEAISWGFSGVMVRGSGIAWDLRRSQPYENYNDFEFDIPLGKNGDCYDRYLCRMQEMRESTKIIRQACEMLRKTHGPVLSEDNKVAPPRRAEMKRSMEALIHHFKLYTEGFKTPAGEVYACVEAPKGEFGVFVVSDGTNKPYRCKIRAPGFPHLAAMDWMNRGHQLADVSAILGSLDIVFGEIDR

SEQ ID NO: 16053 - protein, 225 aa, Saccharophagus degradans 2-40
MATISVSTRVALCVALGGFIFGFDASVISGVVPFISKLFGLSDWQIGAVVSAPTLGAVFSAMGVSTLADRFGRKPILISIAAIYAISAAYSALAPNFESLVIARFIGGLGFGSLVLAPIYISEIAPPHQRGRLVSFNQLNIVVGFSIAYFVNYFIVQAVSNAYSWAPPQSMVSAPWRWMLGLELLPALAYIALLFKIPESPRWLMLNNYSARATDVVKKSSQAIM

SEQ ID NO: 16054 - protein, 218 aa, Glycine max
MFSRMFGKPKQETNAVATLDKLNETLEMLEKKEKVLLKKVAAEVEKAKEFTRGKNKRAAIQCLKRKRLYEQQIEQLGNFQLRIHDQMILLEGAKATTETVDALRTGAAAMKAMQKATNIDDVDKTMDEINEQTENMKQIQDALSAPIGAAADFDEDELEAELEELEGAELEEQLLQPATTAPAAPVQVPAGRQPTRPVPAKRTPEEDELAALQAEMAL

SEQ ID NO: 16055 - protein, 463 aa, Yersinia pestis CO92
MELPVKNKLKRGLTTRHIRFIALGSAIGTGLFYGSADAIRMAGPSVLLAYLIGGVVAFVIMRALGEMSVNNPQASSFSRYAQDCLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 16056 - protein, 251 aa, Bacteroides fragilis NCTC 9343
MRKNIVAGNWKMNKTLQEGIALAKELNEALANEKPNCDVIICTPFIHLASVTPLVDAAKIGVGAENCADKESGAYTGEVSAAMVASTGAKYVILGHSERRAYYGETVEILKDKVKLALANGLTPIFCIGEVLEEREANKQNEVVAAQLASVFDLSAEDFSKIVLAYEPVWAIGTGKTASPAQAQEIHAFIRSAVAEKYGKEIADNTSILYGGSCKPSNAKELFANPDVDGGLIGGAALKVADFKGIIDAFN

SEQ ID NO: 16057 - protein, 376 aa, Phytophthora brassicae
MADEDVQALVVDNGSGMCKAGFAGDDAPRAVFPSIVGRPKHLGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVIVIGNERFRTPEVLFQPSLIGKEASGIHDCTFQTIMKCDVDIRKDLYCNIVLSGGTTMYPGVGERMTKELTALAPSTMKIKVVAPPERKYSVWIGGSILSSLSTFQQMWISKAEYDESGPSIVHRKCF

SEQ ID NO: 16058 - protein, 492 aa, Exiguobacterium sibiricum 255-15
MHKTSEQTLIFEISKAGRVAYSLPLPTVDEVAAEELLPAHLLRQEDVELPEVSELDLVRHYTALSNRNHGVDSGFYPLGSCTMKYNPKINEDMARLPGFAHIHPLQPVESVQGALGLMYDLQEKLAVITGMDEVTLQPAAGAHGEWTGLMLIKAYHHARGDFKRTKVLVPDSAHGTNPASASVAGFDTVTVLSDERGLVDLADLKSKVGEDTAALMLTNPNTLGLFESDIVEIAKAVHEAGGKLYYDGANSNAIMGIARPGDMGFDVVHLNLHKTFTGPHGGGGPGSGPVGVKKDLIPYLPKPIVAKTAEGFVLDYDRPESIGRVKPFYGNFGINVRAYSYIRTMGGAGLARVSKEAVLNANYMLARLKGAYDAPYDVYCKHEFVLSGRRQKALGVRTLDIAKRLLDFGYHPPTIYFPLNVEECIMIEPTETESKETLDDFCDAMLQIAKEVEETPDVVLNAPHTTVVKRMDETLAARKPILRYQPKQEVHV

SEQ ID NO: 16059 - protein, 268 aa, Bradyrhizobium japonicum USDA 110
MGFALGPRALSAGYKLAAFERTGSTNTEAIEHARGGEPGPMWFVTSEQTAGRGRRQRAWIAPRGNLAASILEVMTVPPAVAATLGFAAGLAEEAALEKVSLEAALRLGEGRPRYALKWPNDVLADGKKLVGIGLEAEVIGDRLAVVVGIGTNVVAAPEGTPTPAVSLAALGVQISAEELFSALSDAWVEFRGIWDNGRGFAEIRRLWLERAAGLGERVAINTGTTTLEGIFDTIDDAGCLIVRTADGRRLPVAAGEVFFGSAASVGAA

SEQ ID NO: 16060 - protein, 448 aa, Exiguobacterium sibiricum 255-15
MDFRYLPMTQEDEKEMLQTIGADSIEDLLADIPASVRDQGTLEEVGIPLPETDLIRTLSKLADQNMNTKQYPSFLGAGIYDHYAPAVVNHMLLRSEFYTAYTPYQPEISQGELQAIFEYQTMICELTGMDVANSSMYDGITALAEAAMLACAHKKKKTIVLSDGVHPEAHDVVRTYANGPGLEVETLPLVNGETAIANLDALEDVACVIVQYPNFYGRVEDLQALADATHAKGGLFIVSANPLALGLLEAPGKLGADITIGDCQPFGIPQSFGGPTCGYFTTTKALMRKIPGRLVGQTVDEDGKRGFVLTLQAREQHIRRDKATSNICSNQALNALAASIAMSALGKRGIRELATRNLQTAYALKKSLIQAGFHIVDDGPSFNEFVVELPIDATEAGKQLLQAGIIGGLPLGTFDESRSNQMLVCATELRTKEELDQFVTALGGLTHA

SEQ ID NO: 16061 - protein, 179 aa, Fritillaria agrestis
MAASSTMLSSVATAACAAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVERPE

SEQ ID NO: 16062 - protein, 213 aa, Lycopersicon peruvianum
MFRPQIIGFFIMLCAFYHVYGTFDQLQLVLRWPTSFCNGKNCKRTPKDFTIHGLWPDSEAGELNFCNPRASYTIVRHGTFEKRNKHWPDLMRSKDNSMDNQEFWKHEYIKHGSCCTDLFNETQYFDLALVLKDRFDLLTTFRIHGIVPRSSHTVDKIKKTIRSVTGVLPNLSCTKNMDLLEIGICFNREASKMIDCTRPKTCNPGEDNLIGFP

SEQ ID NO: 16063 - protein, 179 aa, Fritillaria agrestis
MASSATMLSSVATAACAAPAQASMVAPFVGLKSASAFPVTQKTATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTGAAQVVKEAAECKKEYPAAFIRVIGFDNVRQVQCVSFIVEKPE

SEQ ID NO: 16064 - protein, 214 aa, Lycopersicon peruvianum
MFKTQHTLAFFILLCALPDVYGTFNQLQLVLRWPASFCKGKKCERTPNNFTIHGLWPDIKGTILNNCNPDAKYASVTGGKFVKRNKHWPDLILTEAASLNSQGFWAYQFKKHGTCCSDLFNQEKYFDLALILKDKFDLLTTFRNKGIIPKSTCTINKIQKTIRTVTGVVPNLSCTPTMELLEVGICFNRDASKLIDCDQPKTCDTSGNTEIFFP

SEQ ID NO: 16065 - protein, 952 aa, Candidatus Pelagibacter ubique HTCC1002
MLKNAQKDFIQRHIGPSIDEQNVMLKELGYQNLDDLIKDTVPEKILLKDDLDIGDPNSEYKALRKLKDISKKNKIYSSFIGMGYYGTYTPYVILRNILENPGWYTSYTPYQPEVAQGRLEMLLNFQQMIIDFTGMDIANASLLDEGTAAAEAMGLSYRISKSESKKVFVSKNCHPQTIDVIKTRAEPLGLEIIVGDEDKDIKEDIICGIIQYPGTLGDIKDPSEAISKIHKFNGKAVLACDLLALAKLKTPAELGADIAVGSSQRFGIPMGYGGPHAAFFATKDEYKRSMPGRIVGVSVDRHGKKAYRLALQTREQHIRRDKATSNICTAQALLAIVSAAYAVYHGPQGIKKIAESVSQLTKNFADKLKQSGYELYSNEFFDTVTIKTLDKTEKIYKNALDQGVNIRKVNSEMLAVSFDERKNLYRANQLLKIFNCSETIKESMNESLSNIPKNLLRTSTYLDHPVFNSYHSETEMLRYLKKLEDSDIALNKSMIALGSCTMKLNAVAEMIPVTWKEFSQPHPFSPVEQMDGYRELFTDLKNWLRSITGFSGVSLQPNAGAQGEFAGLMVIRKFHEKNGETNRNVCLIPSSAHGTNPASAQMVGMKVVVVKCDQYGNVDYEDLKNKAEEHSENLAALMVTYPSTHGVFEEKITDICELIHNHGGQVYMDGANLNALVGIAKPGNFGPDVCHINLHKTFCIPHGGGGPGMGPIACKKHLEIFLPKHSVIKDCGPVTGMGAVSAAPWGSSSILSISWMYIKMMGSEGLRKASQVAILNANYIAHKLKDSFPILYKGKSGNVAHECIIDIRTIKSETGITEEDIAKRLIDFGYHAPTMSWPVAGTMMIEPTESESLSEIDKFCSTLIKIKQEIDKIQSGEYDKTDNPLKNAPHTHVELTSNKWDHKYEREEAAYPSEFLRTNKYWPPVGRVDNVYGDKNLFCTCPSMEEYEDTAA

SEQ ID NO: 16066 - protein, 393 aa, Psilotum nudum
MAMLLKNKDQMIVSMGPHHPSMHGVLRLIVTLDGENVADCEPVLGYLHRGMEKIAENRTIIQYLPYVTRWDYLATMFTEAITVNAPEKLANIRIPKRASYIRVIMLELSRIASHLLWLGPFMADIGAQTPFFYILREREMIYDLFEAATGMRMMHNYFRIGGVAVDLPYGWIDKCLDFCDYFSPKISEYEKLIVHNPIFLERVKGVGFISREEAINWGLSGPMLRASGVQWDLRKVDHYECYDEVDWQIQWQKEGDSLARYLVRIGEMRESVKILQQALRIIPGGPYENLEARRLHQSQNLEWNDFDYQFMGKKSSPTFKLLKQEHYVRIEAPKGELGIFLIGNDSVFPWRWKIRPPGFINLQILPQLVRGMKLADIMPILGSIDIIMGEIDR

SEQ ID NO: 16067 - protein, 622 aa, Neurospora crassa
MPPLYSHNLEPGRDSLELASLASSDPGPDTGDDTSSRPSISSSRKLSLEREDPLDNGNYAASGHRVRPERSTSVNSTFSFAANLFPLSSTTGGGYAPLGAPTATRGHVNGGLGGGSLEKHKTLTYLNGLSLIVGLIIGSGIFSSPSQVNANAGSPGAAIIVWVVAGILAWTGAASYAELGGAIPLNGGPQVYLSKIFGELAGFLFTWVAVLVLKPGSAAIISIIMGEYLVRTFIGAEAETINPWISKSVALVGLFLVTFLNSVSTKLGTRMNDMLMFLKFVALLGVTIVGIVVAATGFSFSGAANLDWKKHDWFEGTKMDASAFAVALYAGLWAFDGWDNTNYVVGEFRNPGRDLPRVIHTAMPLVILSYILANVAYFFVLPLDTINSTNTVAVIFGSKVFGPVGALILALIVSASCFGALNASTFTSSRLVYVAGKEGYIPELFGRIGSGTAVDQHESLTTMRTRSWFTKKLVRIVADEDTGLFYTPIPALMLNCALTTAYVCVGEFGTLVTFYGVAGYTFYFLTVLGLIVLRVKEPNLERPYKTWITTPIIFCCVSLFLLSRAVFAQPLQTLLVVAFVVVGVPVYYWRRYVNGRSAVKREAGGMREVREERPWWKFWQIR

SEQ ID NO: 16068 - protein, 141 aa, Ralstonia eutropha JMP134
MAIERTLSIIKPDAVAKNVIGQIYARFEAAGLKIVAAKMVHLSRGEAEQFYAVHKERPFFKDLVDFMVSGPVMIQALEGEGAIAKNRDLMGATDPKKADKGTIRADFADSIDANAVHGSDAAETAAVEIAFFFPGMNVYTR

SEQ ID NO: 16069 - protein, 433 aa, Symbiobacterium thermophilum IAM 14863
MTARYERSAALYERAVARIVGGVNSPARSFKSVGGGAPVFMARGQGPYLYDVDGNRYIDYIGAFGAGMFGHGHPELVAAVARAAEGGTIYGTPNPWEVELAERIHQALPSMERIRFVTTGTEAVMSAVRVARAFTGRPKIIKMEGCYHGHSDFALIAAGSGPSQLGTPDSAGVTEGVAQDVITVPYNDLDSLGEALDVWGPQVAAVLVEPIVGNFGVAMPKPGYLEGVKRLAHAHGALLIFDEVITGFRVAYGGAQTLLGIEPDLTTLGKIIGGGLPLAAYGGRAEIMDWVAPLGPAYQAGTLAGNPLCMQVALTGLEILSRPGVYERLDADAAYLADGLVRSARSHGHTVQLGRAGSMFTLFFCDEPVVDYRTAQRSDPAKFAAMFRGLLDRGIALAPSRFEAWMLTVQHTRADLEETLQIADEVFAQMAGQ

SEQ ID NO: 16070 - protein, 395 aa, Frankia sp. CcI3
MHSTATTFLELGGILFCLGVLGHLALRISVSPIPLYLVGGLAFGRGGLLPLGASEEFIGVGAEIGVVLLLLTLGLEYTADELLSGLRRQAPAGVLDLALNATPGVVAAFLLGWGPTAAVVLGGVTAISSSGIIAKVLGDLGRLGNRETPVVLSVLVLEDLAMAVYLPVLTALLAHHTFVRGSLTVAIALGVLVAVLYIALRHSEKVTRLVFNPKAHRNDEILLLRALGLALFVAGVAQRMQVSAAVGAFLVGIALSGPVAEGAEEVLRPLRDLFAAVFFVFFGMQTDPAEIPPALLTGSLLAIAGVATKVMTGWWAARSAGIGTMGRFRAGAALVARGEFSIVIAGLAVAAGLEPRLGPLAACYVLLMAVLGPLAARFVEPVIRTARRLQAARSP

SEQ ID NO: 16071 - protein, 220 aa, Arabidopsis thaliana
  misc_feature (56)..(56): Xaa can be any naturally occurring amino acid
  misc_feature (111)..(111): Xaa can be any naturally occurring amino acid
  misc_feature (113)..(113): Xaa can be any naturally occurring amino acid
  misc_feature (190)..(190): Xaa can be any naturally occurring amino acid
  unsure (1)..(220): unsure at all Xaa locations
SCQIIIFSAYFALATPSNKFYYIEVIYLKKKKKKIYSSRTAAYYQQGARFAKWRTXVVSIPNGPSALAVKEAAWGLARYAAISQESGLVPIVEPEILLDGEHDIDRTYDVXEXVWAEVFFYLAQNNVMFEGILLKPSMVTPGAESKDRATPEQVAAYTLKLLRNRVPPAVPGIMFLSGGQSEVEATLNLXNAMNQGTKPHGQRVPFFLTHRCVCQETTFF

SEQ ID NO: 16072 - protein, 426 aa, Methylococcus capsulatus str. Bath
MLDSTTLFADACRFIPGGVNSPVRAFRGVGGTPVFVDRAEGPYVYGVDGKAYIDYVGSWGPMILGHAHPEVLTAVHAAVDRGLSYGAPTVAETAMAKTVCALMPSLDRVRMVSSGTEATMSAIRLARGYTGRDKIVKFEGCYHGHSDSLLVKAGSGALTLGAPSSPGVPANLAEHTLVLPYNDAAAVRDVFARHGAEIACIIVEPVAGNMNCVPPVPGFLETLRDVCDASGAVLIFDEVMTGFRVALGGAQAHYGICPDLTTLGKVIGGGMPVGAFGGRLDIMEQLAPVGQVYQAGTLSGNPVAMAAGLKTLELISQPKFFDELAEKTRHLAEGLRVRAEQAGIPLCVNWVGGMFGLFFTEQQGVSRFDQVMACDQERFRRFFHGMLEEGVYLAPSAFEAGFVSAAHDYQILDRTLTAAERVFAGL

SEQ ID NO: 16073 - protein, 661 aa, Alkalimonas amylolytica
MLLDGTLIQLLFLLGFMVFMVMLFQRAHIPASIAYLLVGVLLGAHTAGPVISEGYIHKIAEFGIVFLLFTIGLRFSWQQIYQLRHTILGLGTAQVGLTTLLVALLLWAMGVASVVAFVIGAVFAQSSTTIISKQLLEQGEDQSRHGRLGISLSVFQDITAVPFIIVIPVLGVAMAQDIASTLGMALFKAVLATALVVLVGRYLLRHLFHRVSSSDSAELFTLTVLLVCLAAAWLTQSLGLSMAFGAFLAGMVMGETEFKLQVEAAIRPFRDVLLGIFFVSIGMLLDPMLLPEIGHIALAGALLLLLIKIVLVTALVLATGVALETAFRTGLILAVGGEFGFALLALALEGGTLDSRSSQIILTSVLLSMMLAVFLIRYNLQLSRFVVGRWIGQAAVSSEPFDDIEQHGLQQHVVIAGFGRIGQGVAQFLQKEQVPYIGLDLDAARVKNARLADVPVFYADSTDPDTLIAVGLAKARLLVISHEDLSAALTTLRHARTLHPDLPVIVRTRDESHVAELRQAGATEVIPETIEAGMMLTSHVLLMLNVPARRVNQLVQEQRINRYQLLRQQFRGSADLLKTQQQEQLKAVLLAEGSPAIDQSLQMLDLAQYGIQLTELVRAHNRIEQPSLDMVLQENDVLVLFGSAEALEQASLVLTHRLAAD

SEQ ID NO: 16074 - protein, 154 aa, Bacteroides fragilis NCTC 9343
MMEKTLVILKPCTLQRGLVGEITRRFERKGLRLAGMKMVQLTDEVLSEHYSHLSSKPFFQRVKDSMMTAPVIVCCFEGVDAIQAVRALAGPTNGRLAAPGTIRGDYSMSFQENIVHTSDSPETAAVELNRFFKPEEIFDYKQATFDYLYANDEY

SEQ ID NO: 16075 - protein, 429 aa, Streptomyces coelicolor A3(2)
MSTAPILYSPDGPEDLVLDPVEQAVADIAAGRPVVVVDDENRENEGDLVIAAEKATEEIVAFMMTECRGLICAPMEGEELDRLRLPQMVDDNTESMKTAFTVSVDAGAAHGVTTGISAADRATTLRLLAGGTAEPGDLVRPGHVFPLRARPGGVLVRNGHTEAAVDLARLAGLRPAGAIVEIAGEDGRMLRLPELIPFARKHGLTIISIEDLIAYRRSAEPTVRREAEVRLPTKHGEFTAYGYRSTVDGVEHIALVHGEIGDGEDVLVRVHSECLTGDVFGSQRCDCGPQLDASLDRIQAEGRGVVVYLRGHEGRGIGLMSKLRAYELQERGRDTLDANLELGLPADARDYGAGAQILADLGVRAVRLLTNNPDKSDALERHGITVTGREPMPVQAGEHNLRYLRTKRDRMGHDLPWLDTTPVSTCGNQ

SEQ ID NO: 16076 - protein, 140 aa, Silicibacter sp. TM1040
MALERTFSIIKPDATRRNLTGAINAKFEEAGLRIVAQKRIHMTKAQAGKFYAVHAERPFYDELCEFMSSAPVVVQVLEGEGAIAKNREIMGATNPADAAPGTIRAEFAESVGENSVHGSDAPETAAEEIAYFFSGLELVG

SEQ ID NO: 16077 - protein, 523 aa, Candida maltosa
MAIEQIIEEVLPYLTKWYTILFGAAVTYFLSIALRNKFYEYKLKCENPVYFEDAGLFGIPALIDIIKVRKAGQLADYTDTTFDKYPNLSSYMTVAGVLKIVFTVDPENIKAVLATQFNDFALGARHAHFDPLLGDGIFTLDGEGWKLSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 16078 - protein, 227 aa, Drosera adelae
MENYSMIIKLLVWQSLAAMALCQSPGFDFFYFVQQWPGAYCDTSRGCCNPTSGKPPSDFGIHGLWPNYNSGGYPSNCDSSNPFDPSQIQDLLSQLQTQWPSLTCPSSDGTSFWTHEWNKHGTCSESVLTEHAYFAAALNLKSQANTLASLTNAGITPNNSFYNLSDVLAAIKQGTGHDAYVQCNTDENGNSQLYQIYICVDTTGANFIECPVAPNQNCPSSIEFPSF

SEQ ID NO: 16079 - protein, 254 aa, Listeria innocua
MRKPLVGINMKNYINTRAQTSEWLEATIPLLENFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVHANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 16080 - protein, 511 aa, Gerbera hybrid cultivar
MNTLQLIFLLFFFPTLLFLYCLPYKRNQNHRRLPPSPPSFPIIGHLHHLGPLIHQSFHALSTRYGSLIHLRLGSVPCVVVSTPDLAKDFLKTNELAFSSRKHSLAIDHITYGVAFAFAPYGTYWKFIKKLFTVELLGTQNLSHFLPIRTHEIRELLRTLMVKSRAKERVNLTEELLKLTNNVISQMMMSIRCSGTNSEADEAKNLVREVTKIFGQFNVSDFIWFCKNIDLQGFKKRYEGTHRRYDALLERIIMGREENRRRGKIKDGEGKDFLDMLLDVLEDGKAEIKITRDHIKALILDFLTAGTDTTAIAIEWALVELINNPNALEKARQEIDQVIGDERLVQESDTPNLPYIQAIIKEALRLHPPIPMLIRKSTENVIVQGYDIPAGTLLFVNIWSIGRNPQCWETPLEFKPHRFLDGGDLKSSLDIKGHNFQLLPFGTGRRGCPGVNLAMRELSVVIANLIQCFDWDVVGERLLNTDERAGLTAPRAVDFVCVPLERGNTLKILGSN

SEQ ID NO: 16081 - protein, 244 aa, Glycine max
MMVVQNFVVDLNKALVFQVGHLGEAYEEWVHQPIVSKEGPRFFENEILEFLTRTVWWAIPVIWLPVVCWFIYKSIRMGLSCPHLALLVVLGIFVWTLLEYSLHRFLFHIKTKTYWGNTLHYLLHGCHHKHPMDGLRLVFPPAATAILLMPFWNLVKLMATTSTAPALFGGGLLGYVMYDCTHYYLHHGQPRTEVPRNLKHKSLKRKIYHLNHHFRIQDKGFGITSSLWDKVFGTLPPKMDAKSM

SEQ ID NO: 16082 - protein, 322 aa, Medicago truncatula
MERRVLDGIINRLLDVRGRPGKQVQLSEGEIKQLCVVSRDIFLKQPNLLELEAPIKICGDIHGQYSDLLSLFEHGGFPPRSNYLFLGDYVDRGKQSLETICLLLAYKIKYPENFFLLRGNHECASINRVYGFYDECKRRFNVRVWKIFSDCFNCLPVAAIIDEKIICMHGGLSPELHSLKQISNLPRPSEVPETGLLCDLLWSDPSKDVHGWGVNERGVSFTFGASKVAEFLQRHDLDLICRAHQVVEDGYEFFANRQLVTIFSAPNYCGEFDNAGAMMSVDETLMCSFQILKPVDHKMPKFGFRSTTSFKKAFLGAKVRAD

SEQ ID NO: 16083 - protein, 90 aa, Triticum aestivum
MAIAAKASWMVAMSVGTVEALKDQARLCRWNYALRSIHRAAKAKATVRGGVSLGTEQLLASTAAVAERRRATKAEEGLRTVMYLSCRGPN

SEQ ID NO: 16084 - protein, 476 aa, Lactobacillus sakei subsp. sakei 23K
MAENEMKRELKTRHLSMIALGGSIGTGLFVTSGSAIAKAGPGGALLAYCGIGIMVFFLMTSLGEMATYLPVSGSFSTYATRFVDPALGFALGWNYWFNWAITLAVDVSTAALVMQFWLPDMPGWIFSLVALLLIFLINITSVKSFGETEYWFALIKVITVIIFLGVGVLTIFGIMGGHRTGLSNFTIKKAPFVGGLPMMLSVFVVAGFSFQGTELIGITAGESKTPEKSIPKAIKQVFWRILLFYILSIFVIACLIPYTSPSLLGASETNIAVSPFTLVFKRAGLASAASIMNAVILTSVLSAANSGMYASSRMLWSMAEDGYAAKIFAKTNKRGIPVMALIGTTIIGALTFMTSVFGTRIYLFLVAASGLTGFIAWLGIAISHYRFRRAFKVQGHQLSELKYHARWFPFGPIFAFLLCVIVIIGQDIQAFAHFDWTAIGISYMSIPLFIILYSYYKIRYKTKVIPLEKVDLSKHR

SEQ ID NO: 16085 - protein, 101 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEF

SEQ ID NO: 16086 - protein, 277 aa, Corynebacterium sp.
TVPSIVLNDGNSIPQLGYGVFKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPKSVRRERLEENLDVFDFDLTDTEIAAIDAMDPGDGSGRVSAHPDEVD

SEQ ID NO: 16087 - protein, 257 aa, Candidatus Pelagibacter ubique HTCC1002
MNKKILNFIKKKNKTKIISLTAYSKNIALIIDRHCDLVLVGDSLGSVLYSFSSTKKVTLDMMIEHSKSVRMGVKKSLMVVDMPHNTYRNSKEALSNAKKIISKTKCDAIKLEGGKKVIQIIKTLIKNKIPVMGHLGVLPQSATNFKFKGKEITERKIILRDSKLLEDAGVFSIVLECVESSLAKEITKTVKVPTIGIGASVHCDGQVLVTDDLIGLNKIKARFVKRYSNIEKQINDAALKFKKDVIRGKFPTKKHSY

SEQ ID NO: 16088 - protein, 279 aa, Conotrema sp. 2-MW-2004
SIEHGAVNVVAVNDPFIEAEYAAYMLKYDSTHGQFKGEIKVDGNDLVVNGQKVKFYQKKDPADIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 16089 - protein, 346 aa, Novosphingobium aromaticivorans DSM 12444
MTDTVPVVLCGGSGTRLWPRSRKQKPKPFLPLVGENTLFAQTVLRCGRDAGFSPPVVVTGAAHLAHVEEQLPDRASTRIIVEPEGRNTAAAIALAALSLPEDAVMLVCPSDHHIGDCEAFQAAAREAVALAVEGWLVSFGIVPTAPETGFGYLKQGEPIAGTVGRRVQRFVEKPDLARAMEFLASGEYAWNGGIFAFRAGTFIDELGKYRPAILAAVRDAVGRGKWDGMRFHPDAAAFSRVESESVDYAVMENTDKAAMVPAVMAWSDIGNWQALHEALDRDEHGNAVRGPAELRDCSNVLVMSDGPRVSVVGASNLVVVVDGDEVLVCTPEGAQSVGKLSGAANQ

SEQ ID NO: 16090 - protein, 257 aa, Stictis sp. 2-MW-2004
AYMLKYDSTHGQFKGEIKVDGNDLVVNGQKVKFYQKKDPADIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSTDLNGDNHSSIFDAKAG

SEQ ID NO: 16091 - protein, 513 aa, Lactococcus lactis subsp. lactis Il1403
MINLKIGQKLQLEIERMGINGEGIGVISGRLVFIPYALPGEEVLVEITENARNFSRAKLVKIIEKSPNRVKPQDRAYHEMSQSHIMHLSYPMQLEFKRDVMRQALEKYKPAGWRNYELRATLGMENTLGYRNKLQFQVRRLNDGTVIAGLYQEGTHHLVNLDNCLVQDPKTQEIINHICRLIEKFDLPVYDERKIGGIRTVMVRRSQKTGEVQIIFVTSTPIILDGQVWPELREEPSKRQKNSFVKFDKMLSALTEEFEEIVTVAVNFHPRKTSEIYGERTQILFNEKETITEGVLDYEFELSPRAFYQLNSEQANVLYGEAVKALNPKKDDRVIDAYCGVGTIGFAVAKKVKSVHGMDITPESIFDARENAKRLGLKNCHYEIGKAERIIPNWNKSGHRATAMIVDPPRTGLDDALLETITKFPPEKMVYVSCNVSTLAKDLVVLANFYKVEYIQSVDMFPHTARTEAVVKLTKRDEPLKIVKFEHLEEERKAEAFAKGKKRGRRPQKYGKY

SEQ ID NO: 16092 - protein, 1057 aa, Pisum sativum
MERARRLANRATLKRLLSEAKQNRKTESTSTTTTTPLPFSLSGSSSRYVSSVSNSILRGRGSKPDNNVSRRVGGFLGVGYPSQSRSISVEALKPSDTFPRRHNSATPDEQTKMAESVGFDTLDSLVDATVPKSIRLKEMKFNKFDGGLTEGQMIEHMKDLASKNKVFKSFIGMGYYNTHVPPVILRNIMENPAWYTQYTPYQAEISQGRLESLLNFQTMITDLTGLPMSNASLLDEGTAAAEAMSMCNNIQKGKKKTFIIASNCHPQTIDICQTRADGFELKVVVKDLKDIDYKSGDVCGVLVQYPGTEGEVLDYGEFIKKAHANEVKVVMASDLLALTVLKPPGEFGADIVVGSAQRFGVPMGYGGPHAAFLATSQEYKRMMPGRIIGVSVDSSGKQALRMAMQTREQHIRRDKATSNICTAQALLANMAAMYAVYHGPEGLKAIAQRVHGLAGVFALGLKKLGLEVQDLGFFDTVKVKTSNAKAIADAAIKSEINLRVVDGNTITAAFDETTTLEDVDKLFKVFAGGKPVSFTAASLAPEFQNAIPSGLVRESPYLTHPIFNTYQTEHELLRYIHRLQSKDLSLCHSMIPLGSCTMKLNATTEMMPVTWPSFTDLHPFAPTEQAQGYQEMFNNLGDLLCTITGFDSFSLQPNAGAAGEYAGLMVIRAYHLSRGDHHRNVCIIPASAHGTNPASAAMVGMKIVTIGTDAKGNINIEELKKAAEKHKDNLSAFMVTYPSTHGVYEEGIDDICKIIHDNGGQVYMDGANMNAQVGLTSPGWIGADVCHLNLHKTFCIPHGGGGPGMGPIGVKKHLAPFLPSHPVVPTGGIPAPENPQPLGSISAAPWGSALILPISYTYIAMMGSQGLTDASKIAILNANYMAKRLESYYPVLFRGVNGTVAHEFIIDLRGFKNTAGIEPEDVAKRLMDYGFHGPTMSWPVAGTLMIEPTESESKAELDRFCDALISIRKEIAEVEKGNADVHNNVLKGAPHPPSLLMADAWTKPYSREYAAFPAAWLRGAKFWPTTGRVDNVYGDRNLVCTLLPASQAVEEQAAATA

SEQ ID NO: 16093 - protein, 260 aa, Magnaporthe grisea 70-15
MPQNEYIERWRKQHGQRLDHEERARKKAAREEGHGKSAKAQNLRGLKAKLFAQERRKEKIRMKKAIKQHEERNVKGAAADKDPTNPVPAYLLDRNTPNTSKALSSSIKQARAEKAAKFSVPIPKVRGISEEELFKVVHTGKSKRKSWKRMVTKPTFVGQNFTRRNPKYERFIRPMGLRYKKAHVTHPELNVTVHLPILGVKKNPSNPLYTQLGVLSKGTVIEVNVSELGIMAGNKVAWGRYAQVTNSPENDGCVNAVLLV

SEQ ID NO: 16094 - protein, 508 aa, Yersinia pestis CO92
MSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 16095 - protein, 553 aa, Synechococcus sp. CC9605
MTPALTWWSGTVIYQLIVRSYSDGNGDGTGDFKGLAARLPYLRWLGVNTLWLTPIYPSPLRDGGYDITDFTGIHPDLGDLSSFHRFLTAAHSQGMRVILDLVLNHTSDLHPWFQRARWAPKGSPERDVYVWSDDPKRYAEAPVLFRHFEASNWEWDPVAEQYYLHRFLRHQPDLNYENPWVQDTMLEVVDFWLDRGVDGFRLDAVPFLFESEGTRCEGLPETHAFLTRLRERVDAHGRDVLLLGEAIQPVEEAAPYLADDELHGAFNFVLTAHLFAAIASGRTQQLGECLMQAEQAVSGPRWALPLRNHDELWLGDGHLVSDEVIQTIRVGLPQGQGHWLNWGINRRLAPLLNGDPRSNRLLHGLLYSLPGMPCLYYGDELGMGDWPGLRDRDPNRTPMAWTPARNGGFSTAPDPLLVLPPITAPGYDYRVVNVEVQKQLPGSLLNWHRRMLTCRRLLPALRHGSFRLLYSPHPGVLVYLRCTEAMTVLVAANVTAAGASLSLDLSEWTGERTREVMWGCEFPPAAAEWFVNLPPYGFNWWLIGEVEPAATAA

SEQ ID NO: 16096 - protein, 390 aa, Pseudomonas fluorescens Pf-5
MAQPYSARSRAIEPFHVMALLARANELQAAGHDVIHLEIGEPDFTTAEPIIKAGQAALSAGKTRYTAARGIPELRGAISGFYQQRYGLDIDPERIMITPGGSGALLLTSSLLVDPGKHWLLADPGYPCNRHFLRLVEGAAQLVPVGPDVRYQLTPDLVERYWDQDSVGALVASPANPTGTVLSRDELAGLSTAIKARNGHLVVDEIYHGLTYGTDAASVLEVDDSAFVLNSFSKYFGMTGWRLGWLVAPPAAVGELEKLAQNLYISAPSMAQYAALACFEPQTLEILEERRAEFGRRRDFLLPALRELGFGIAVEPEGAFYLYADISAFGGDAFAFCRHFLETEHLAFTPGLDFGRHQAGHHVRFAYTQSLERLQEAVERIARGLQSWHA

SEQ ID NO: 16097 - protein, 298 aa, Aspergillus oryzae
MASLQHTKKTYTLNTGDKIPAIGLGTWQSKPNEVREAVKNALLKGYRHIDTALAYGNEAEVGQGIKDSGVPREEIWITTKLDNTWHHRVSEGIESSLKDLGVSYVDLYLVHWPSSTDPNDKSKHLPDWDFIKTWQEMQKLPATGKVRNIGVSNFGIKNLEKLLNDPSTKIVPAVNQIELHPNNPSPKLVAYNTSKGIHSTGYSCLGSTNSPLYKDPTLLQLAEKKGKTPQQCLLQWGIQKGWSVIPKSVSKERIDTNFELDGWNLTDEEVNQLDNLKDRRKVCGDSWLPIKVFFGDDE

SEQ ID NO: 16098 - protein, 589 aa, Lactobacillus delbrueckii subsp. lactis
MKKTKIVSTLGPASNDIETITKLAEAGANVFRFNFSHGDHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELICEAQNTGVIGSKKGVNAPGVEIRLPGITEKDTDDIRFGLKHGINFIFASFVRKAQDVLDIRALCEEANAPYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVESVQAMHDINVRTEKEMDTRNTLALQRFEEYKGSNVTEAIGESVVRTAQELGVKTIITATSSGYTARMISKYRPDATIVALTFDEKIQHSLGIVWGVEPVLAKQPSNTDEMFEEAARVAKEHGFVKDGDLVIIVAGVPFGQSGTTNLMKLQIIGNQLAQGLGVGTGSVIGKAVVANSAEEANNKVHEGDILVAKTTDKDYMPAIKKASGMIVEASGLTSHAAVVGVSLGIPVVVGAADATSKIADGSTLTVDARRGAIYQGEVSNL

SEQ ID NO: 16099 - protein, 339 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYKYIWYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 16100 - protein, 148 aa, Gossypium hirsutum
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATACGWTQKYAMG

SEQ ID NO: 16101 - protein, 469 aa, Caulobacter crescentus CB15
MSTAKDILNLIKEKDVKYVDVRFTDVRGKMQHVTFDIDLVDDDFLNDGTMFDGSSIAGWKAINESDMKLRPDLSSAIIDPFYQQTTLALFCDVVNPDTGTPYNRDPRSIAKAALNYLKSAGVGDTVYFGPEAEFFIFDDVRWSTAPHDTSYSFDSTELPVNSNKQYAEGNMGHRPGPKGGYFPVNPVDSCQDLRGEMLAVMGELGMKPEKHHHEVAPAQHELGLKFDTMVTMADRMQLYKYVIHNVAAAYGKTATFMAKPMFADNGSGMHVHQSIWQDGKPLFAGDKYAGLSQECLWYIGGIIKHAKAINAFSNSTTNSYKRLVPGYEAPVKLAYSSRNRSASIRIPHVDSPKAKRLEARFPDPMGNPYLTFVALLMAGLDGIINKIDPGAPADKNLYDLPPREQKKIPEVCGSLREALENLDKDRAFLKAGGVMDDDFIDSYIELKMEEVMRLQLHPHPVEFEMYYKC

SEQ ID NO: 16102 - protein, 148 aa, Gossypium hirsutum
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVLEIAHMYKTDRAKYEATARGWTQKYAMG

SEQ ID NO: 16103 - protein, 148 aa, Gossypium arboreum
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 16104 - protein, 351 aa, Xanthomonas campestris pv. vesicatoria str. 85-10
MATMAAHFLHRLPVPMSRPSLTRFLIEEQHAGRIDAELRQLITIVSRACKRISIAVSKGTLGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 16105 - protein, 467 aa, Burkholderia pseudomallei K96243
MEGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGVGAVLAAMLTTMFSFLGTEIVTIAAAESEHPERQIVRATNSVIWRISLFYLGSIFVVAALVPWNDALLPVHGSYQRAMELIGVPHAKGIIDVIVLVSVASCLNSALYTASRMIFSLSTRGDAPAFLRRTDASGTPRAAVLASTAFGFLTVIANYVMPEQVFGFLLATSGAIALLVYLVIAISQLRMRSTLDATGERLPLRMWCFPWLTWAVIVFICGVLVVMLLREDHRMEVGATAVLALAVVVASRMNRRARGGDEPTPAASRVSANLR

SEQ ID NO: 16106 - protein, 497 aa, Arabidopsis thaliana
MEMLLGGQATNGALRSKTKIVCTLGPASRSVEMIEKLLKAGMNVARFNFSHGSHSYHQETLDNLRTAMDNTGILCAVMLDTKSPVIRTGFLKEGKPIQLKQGQEITISIDYKIQGDSNTISMSYKKLAEDLKPGDVILCSDGTISLNVLSCDKYLGLVRCRCENSALLGERKNVNLPGIVVDLPTLTEKDKEDIMQWGVPNKIDIIALSFVRKGSDLIQVRKLLGEHSKSIMLMSKVENQEGVMNFDKILENSDAFMVARGDLGMEIPIEKMFLAQKTMINKANAHGKPVVTATQMLESMTVSPRPTRAEATDVANAVLDGTDCVMLSGETAAGAHPETAVLTMSRICKEAEDFIDYDILHKKTLGMVSLPLSPIESLAASAVSTARSVFASAIVVLTRGGYTAELVAKYRPSVPILSVIMPEIAECSDSVAHVARRGLIYRGIIPVVGCSARDSTEEMIRLAIGFAKTKGICKTGDSIVALHKIDGSSIVRIVSVE

SEQ ID NO: 16107 - protein, 368 aa, Zea mays
MDRELLETFDAAKKAADAAAGQGNSPEAGRCLDALRRLRDIRVNTDILVSTQVGKRLRPLTKHPHSGIQAVAADLFGYWKKVVLEESGKKNGGSENERSSDSSGKVEKVRPVKIEKNSASASMKLEKRDVDVRGQKPNNVKVEKTTSNGSKAQSVKVERVSKEVIRTPDAKRPASVPNGHPKLTSLVKCNDPTRDKIRELLAEAFVRVSRETSDDDRDEVRNILDEVEACDPYRVAVTVESALFERLGPSTGTHRAKYRSIMFNLRAENNTDFRRRVLIGLVAPERLPDIPPDEMASDARKQENMQIKEKALFDCERGAAPKATTDQFKCARCGQRKTTYYQLQTRSADEPMTTFVTCVNCNNHWKFC

SEQ ID NO: 16108 - protein, 335 aa, Xanthomonas oryzae pv. oryzae KACC10331
MNMAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKDTAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPALNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 16109 - protein, 454 aa, Halobacterium sp. NRC-1
MTNGDSSSSALTDNERAVLDDIEAQGIDFLRLQFTDILGTVKNVSIPAHQAEKAFTEGIYFDGSSIEGFVRIQESDMRLDPDPETFAVLPWRSNGDGGSARLICDVVDREGNAFAGGPRQVLKNVLARADDMGYSVSIGPEPEFFLFEKDDDGNATTTAHDQGGYFDLAPKDLASDIRREIIFTLEAMGFEIEASHHEVARGQHEINFKYDDALTTADNIATFRAVVRAVAEQHDVHATFMPKPIGEINGSGMHSHISLFDEDGENVFADNDDEFNLSETAYQFMGGVLEHAPAFTAVTNPTVNSYKRLVPGYEAPVYIAWSGVNRSALIRVPDAAGVSARFEIRSPDPSCNPYLALAAVIAAGLDGIDTDADPGDAVREDIYEFDEDKRDAYGIDTLPGHLGDAVTALESDPVMQDALGEHVCEKFAEAKRHEYAEYKASVSEWETDRYLEKF

SEQ ID NO: 16110 - protein, 279 aa, Stictis sp. 3-MW-2004
SIEHGAVNVVAVNDPFIEAEYAAYMLKYDSTHGQFKGEIKVDGNDLVVNGQKVKFYQKKDPAEIPWSETDAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKITGMAMRVPTANVSVVDLTCRLEKSVSYDQIKETIKKASEGELKGILAYTEDDIVSSDLNGDNNSSIFDAKAG

SEQ ID NO: 16111 - protein, 524 aa, Methanocaldococcus jannaschii DSM 2661
MVKILVTDPLHEDAIKILEEVGEVEVATGLTKEELLEKIKDADVLVVRSGTKVTRDVIEKAEKLKVIGRAGVGVDNIDVEAATEKGIIVVNAPDASSISVAELTMGLMLAAARNIPQATASLKRGEWDRKRFKGIELYGKTLGVIGLGRIGQQVVKRAKAFGMNIIGYDPYIPKEVAESMGVELVDDINELCKRADFITLHVPLTPKTRHIIGREQIALMKKNAIIVNCARGGLIDEKALYEALKEGKIRAAALDVFEEEPPKDNPLLTLDNVIGTPHQGASTEEAQKAAGTIVAEQIKKVLRGELAENVVNMPNIPQEKLGKLKPYMLLAEMLGNIVMQVLDGSVNRVELIYSGELAKEKTDLIKRAFLKGLLSPILLAGINLVNAPIIAKNRNINVVESSTSEEKYGNAIKITAESDKKKFSIVGAIINNKPVILEVDGYEVSFIPEGVLAIIKHIDRPGTIGRVCITLGDYGINIASMQVGRKEPGGESVMLLNLDHTVPEEVIEKIKEIPNIKDVAVINL

SEQ ID NO: 16112 - protein, 394 aa, Zea mays
MASAATTLLKSSFLPKKAEWGSKHQLVAAHPRPATVVVSMVARASAYADELVQTAKTIASPGRGILAMDESNATCGKRLDSIGLENTEANRQAYRTLLVSAPGLGQYISGAILFEETLYQSTVDGKKIVDVLSEQGIVPGIKVDKGLVPLAGSNNESWCQGLDGLASREAAYYQAGARFAKWRTVVSIPNGPSQLAVKEAAWGLARYAAISQENGLVPIVEPEILLDGEHGIERTFEVAQKVWAETFFYMAENSVMFEGILLKPSMVTPGAECEEKATPEQVAEYTLRLLRTRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 16113 - protein, 143 aa, Shewanella oneidensis MR-1
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAQSIDENAAHGSDSLASAEREIAYFFSAEELCPRTR

SEQ ID NO: 16114 - protein, 134 aa, Zea mays
  misc_feature (11)..(11): Xaa can be any naturally occurring amino acid
  misc_feature (117)..(117): Xaa can be any naturally occurring amino acid
  unsure (1)..(134): unsure at all Xaa locations
MPGYGAKYRDXLIKNAAYVETPGHSLSLLLMRPLSTIGKRLSSINVENDEENRRALRELLFCCPGALQHIRGEILFEENLNQKTKDGKPFVDVLKEGGVLPDIKVDEVTIEDVVTDXETSIQEHDDHAKCSVKN

SEQ ID NO: 16115 - protein, 796 aa, Corynebacterium callunae
MSPEKQPLPAALVGSHVRAAAGTPADLATDRKFWTGLSRAVQERIADDWERTREAYGAARQQHYFSAEFLMGRALLNNLTNLGLVDEAAAATRELGHELTDILEIENDAALGNGGLGRLAACFLDSAVTQDYPVTGYGLLYRFGLFRQSFNEGFQVEKPDPWREEEYPFTIRRASDQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQDHLAHHKDLSNFAEFHSVQLNDTHPVLAIPELMRLLMDEHDMGWEESWAIVSKTFAYTNHTVLTEALEQWDEQIFQQLFWRVWEIIAEIDRRFRLERAADGLDEETINRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYKPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 16116 - protein, 266 aa, Pseudomonas fluorescens Pf-5
MPDITLTTLQSLKQKGEKITMLTCYDATFAHTCCEAGVEVLLVGDSLGMVLQGHDSTLPVSTADMAYHVAAVKRGNNGALILADLPFMSYATTEQALSSSAQLMQAGAHMLKIEGAAWLAEPVRLLNERGVPVCVHMGLTPQTVNVLGGYKVQGRNESQARQMRADAIALEQAGAAMLLLECVPSELAAEITQAVKIPVIGIGAGNATDGQVLVLHDMLGLSLSGRSPKFVKNFMAGKDSIQAALSAYVEEVKAVTFPGAEHGFSA

SEQ ID NO: 16117 - protein, 390 aa, Trichodesmium erythraeum IMS101
MKLAARVGKVPLSLTLAISAKARAMKADGKDVCSFSAGEPDFDTPEHIKVAAQKALDSGYTKYGPAAGEPKLREAIAHKLSQENGLNYKAENIIVTNGGKHSLFNLMLALIEPGDEVIIPAPYWLSYPEMVKLAGGEPIILTTDPETGYKVTPEQLRQSITDKTKLFVLNSPSNPTGMVYQPAEIKALAEVLVEKDILVVSDEIYEKIIYDDAEHLSIGAVNSEIFKNTIISNGFAKAYSMTGWRIGYLAAPVELINATVKIQGHSTSNVCTFAQYGAIAALESSQDCVEQMRQAFAKRRKIIYDLLKTLPGISCNQPEGAFYMFVNISKISSSSLEFCNALLEDQNVAVIPGIAFGADDHIRISYATDLETIEKGMDRLERFIRSQSSG

SEQ ID NO: 16118 - protein, 123 aa, Arabidopsis thaliana
  misc_feature (7)..(7): Xaa can be any naturally occurring amino acid
  misc_feature (48)..(48): Xaa can be any naturally occurring amino acid
  unsure (1)..(123): unsure at all Xaa locations
MASSMLXSAAVVTSPAQATMVAPFTGLKSSAAFPVTRKTNKDITSIAXNGGRVSCIKGGPPIGKKKVGTLSYLPDLNGLELAKGGDYLLRNKGIPWVEIQLKHGFLYREHGNTPGYYDGRYWT

SEQ ID NO: 16119 - protein, 506 aa, Lactococcus lactis subsp. lactis Il1403
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 16120 - protein, 470 aa, Glycine max
  misc_feature (395)..(395): Xaa can be any naturally occurring amino acid
  unsure (1)..(470): unsure at all Xaa locations
MAGPVSSLGYVNTERKFLKHIRDNVHGNILLEPIFLSFMDTEQFQRLRDLKQLGLSYMVYPGAVHSRFEHSLGVYWLAGKAIDAIKKYQGQELGIEHTDVLTVKLAGLLHDVGHGPFSHTFERGFLPLVLQGSTWSHEEMSVKMIDHIVDQHKIDLDSELLKKVKEMITSSPGHSSQREKRFLYDIVANGRNGIDVDKFDYIVRDSRACGLGCNFQHERLMETMHVVDDEICYRANDYLTVHKLFATRADLHQTVYTHAKVKAIELMVIDALVKANPFLQITSLIHQPSEFWKLDDSILKTIESSSQQELKESRDLIQRIRRRDLYQYCNEFSVPKERLDHFRSITPQDIVCSQTNGANLKEEDVVVSYVKIDLTRGRANPLGRYLLKKQLLINXEYGSKEKFRIPNDCISHLLPAYCEDVIVRVYSREREQVEAVSNAFENYQLKTFGRKKQVHDTPEKKKRPKYFPSL

SEQ ID NO: 16121 - protein, 521 aa, Gibberella zeae PH-1
MEKFPDFVDTPLGESPSDSPSNTPGWANGAPPRPSDRWLPVSKHDSNWSTASRGHTRQKSLTDAIRTIRGRNGSVSQNAQEIADALRAPVSPKLIILCLMWYASSALTNTSSKSILIAFDKPATLTLVQFAFVSSLCIFMAWLATIFPVLRTKVAALKYPIRKPTRDVIRTTLPLAAFQIGGHLLSSTATSKIPVSLVHTIKGLSPLFTVLAYRFVYDIRYPKTTYLSLIPLTFGVMLACSGKTTYGGELIGVIHALLATVIFVTQNIFSKKLFNEAAKAEAESPHSMSKKLDKLNLLCYSSGMAFLLTLPIWLWSEGFTLLMNLYHEGSIDLNEQPNSMDHGRLTLEFIFNGVFHFGQNILAFILLSIVSPVTYSVASLIKRVFVIVLALVWFRSPTTPIQGVGIALTFLGLYLYDRTKSSNKADQKAQSMQVKRSSLLPTTNGGLRPTPITESPQSTDLNPYPYREGYFGRPTAAEDSKKSDDGGARSRTPATSNGWLPPGTKQEDTWQPGDRVAGVAR

SEQ ID NO: 16122 - protein, 285 aa, Oryza sativa
MDPTPHRGGSPSPRFTLQPSRLPPEDMLFCVDVDLETRSEMRIAPGPAAAAAASPGAAGASSGAAAASRQAARPPVKRMDAVKQALLLFVHSKLTMCPDHRFAFASLGDTVSLVKKDFSSDAGSAVEAIQSLDASETRYAMADLTQLFKIAYQEGKRAELQGRLLRVVLIYCRSSTKPQHQWPIKQKNFTLDIIYLHDKPTADNCPQKVYDALVDALEHVSQYEGYILETGQGLARILFRQTCILLSHPLQRCIQDDLDIPKPLAKKNMVTEAAQNEDGMPVSTQ

SEQ ID NO: 16123 - protein, 274 aa, Synechococcus sp. CC9605
MGFSGHHARKRFGQHWLLDESVLQRIIEAADLQSTDRVLEVGPGRGALTERLLAAGLKAVHAIELDRDLVQGLRDRFVVQPGFSLHQGDVLEAPLELSDGRIADKVVANIPYNITGPLLERLVGRLDRPVDPPYQRLVLLVQKEVAERIRARPGHSSFSALSVRMQLLARCHSVCPVPPRCFQPPPKVQSEVICLEPLPASERVMPDLAARVESLLKQAFLARRKMLRNTLAGVAEPNRLKDLAASAGFSLQQRPQELAPATWVALARGLNRGD

SEQ ID NO: 16124 - protein, 231 aa, Burkholderia pseudomallei K96243
MTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 16125 - protein, 269 aa, Corynebacterium glutamicum ATCC 13032
MSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 16126 - protein, 456 aa, Salmonella enterica subsp. enterica serovar Paratyphi A str.
MDSQQHSEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 16127 - protein, 148 aa, Gossypium raimondii
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 16128 - protein, 334 aa, Chlorobium tepidum TLS
MAKVKVGINGFGRIGRLVFRQAMENPEIEIVGINDLTDVKTLAHLLKYDSSHKKFNGEVTIEGDNLIVNGRTIAICAQKDPAQLPWASLGATLVVESTGIFTSREAASKHLAAGAKKVIISAPAKDKIDATIVIGVNDKSITGKEEIISNASCTTNCLAPMTKVLNDNFGIVKGFMTTVHAYTNDQNILDLPHKDLRRARAAACSIIPTSTGAAKAIGEVLPELAGKLDGFAMRVPIPDGSVTDLSVIIEKSATKEEINAVMKAAAEGPMKGILEYNVDPIVSCDIVGNAHSCIFDSPLTMSSGNMVKIVGWYDNELGYATRVVDLLGIYSKFV

SEQ ID NO: 16129 - protein, 472 aa, Neisseria meningitidis MC58
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 16130 - protein, 334 aa, Geobacillus stearothermophilus
AVKVGINGFGRIGRNVFRAALKNPDIEVVAVNDTGGANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 16131 - protein, 275 aa, Methanocaldococcus jannaschii DSM 2661
MFKPKKKLGQCFLIDKNFVNKAVESANLTKDDVVLEIGLGKGILTEELAKNAKKVYVIEIDKSLEPYANKLKELYNNIEIIWGDALKVDLNKLDFNKVVANLPYQISSPITFKLIKRGFDLAVLMYQYEFAKRMVAKEGTKDYGRLSVAVQSRADVEIVAKVPPSAFYPKPKVYSAIVKIKPNKGKYHIENENFFDDFLRAIFQHRNKSVRKALIDSSKELNYNKDEMKKILEDFLNTNSEIKNLINEKVFKLSVKDIVNLSNEFYRFLQNRGRL

SEQ ID NO: 16132 - protein, 95 aa, Triticum aestivum
MAWRASLSRNVKEIRFLFCQSSPASGPAREFVKKNYGDIKTRNPTLPVLIRECSGVEPQLWARYDMGVERCVRLDGLTEAQIDKKLEELAKAGVA

SEQ ID NO: 16133 - protein, 304 aa, Zea mays
  misc_feature (177)..(177): Xaa can be any naturally occurring amino acid
  unsure (1)..(304): unsure at all Xaa locations
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIXELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 16134 - protein, 276 aa, Stictis sp. 1-MW-2004
HGAVNVVAVNDPFIEAHYAAYMLKYDSQHGQFKGEIKVDGNDLIVKGQKVKFYQEKDPANIPWSETGAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKLTGMSMRVPTSNVSVVDLTCRLEKAVSYDQIKETIKKASEGEMKGILAYTEDDIVSTDLNGDNHSSIFDAKAG

SEQ ID NO: 16135 - protein, 243 aa, Mycoplasma hyorhinis
MSKTIIIGNWKMNKTFTQTKEFFSAFNQLYIENKNKINQNLDFAVALPAINVAAFSKNTTKLELAVQNMSQFEKGAYTGEISAQMLLDLNVKYAIIGHSERRQYFKETDLDVNAKTQQAIKNNIIPVVCVGETLEEYEAQKTSQVIEYQLKNSLKDVDLSKVIVAYEPIWAIGTGKTATPEQAQQVCKFIRKQTNKNLTILYGGSVSQENIEQLLNQADINGALVGGASLKVDSFIKLLTLNK

SEQ ID NO: 16136 - protein, 446 aa, Lactococcus lactis subsp. lactis Il1403
MTITAADIRRDVKEKDIKFLRLMFTDILGTLKNVEVPATDEQLDKLFENKMMFDGSSIEGFVRINESDMYLYPDLDTWIVFPWGDEYGKVAGVICDVYTPEGEPFAGDPRGVLKRNLKSMEKLGFKSFNLGPEPEFFLFKLNENDEPTLEVNDKGGYFDLAPTDLAGNTRREIVNVLTDLGFEVEASHHEVAIGQHEIDFKYANALKACDNIQIFKLVVKTIARKHGLHATFMAKPVHGINGSGMHCNMSLFTEDGANAFADPTGDMGLSDVAHSFIAGLLKHAYNFTAITNPTVNSYKRLVPGYEAPVYVAWAGRNRSPLIRVPASRGLSTRVELRAVDPTANPYLALAVLLAAGLDGVEHKLEAPEAIESNIYVMTEEERKAHGITDLPSTLHNAVKALPEDTIVTEALGEHVLVNFVEAKRIEWASYAQFVSQWEIDNYLELY

SEQ ID NO: 16137 - protein, 275 aa, Bacillus cereus ATCC 10987
MHIPTTTLHNGVKMPMIGLGVYKAKEGDEVKQAVKTALEVGYRSIDTATVYENESGVGEAVRESGIPREEIFITTKVWNDDQGYEETLEAFEKSLKKLQMDYVDLYLIHWPIRGKYVDTYRALEKLYEEGKVRAIGVSNFHKHHLELLLPNCKVKPMVNQVELHPMLTQFELRNFCQGEQIQMEAWSPLMRGGEVFQHPIIQAIATKYEKTPAQVILRWDIQSGVVTIPKSVTPSRIQENFSIFDFSLTEEEMTQINTLNRNLHVGTNPDKYDTL

SEQ ID NO: 16138 - protein, 248 aa, Solibacter usitatus Ellin6076
MKKLVLIRHGESTWNKENRFTGWTDVDLSDEGRQQATEAAEVLKREGYVFDVAYTSVLKRAIRTLWTVLDGMDLMWIPVHRSWRLNERHYGALQGLNKAETAAKFGEDQVKIWRRSYDIPPPVLTADDPRFPGHDPRYQSLTKEELPLTECLKDTVARFLPLWHDTIAPAIRSGQRVIIAAHGNSLRALVKYLDGVSEADIVELNIPTGMPLVYELDDDLKPLNRYYLGDPEKVKAAMEAVAAQGKKK

SEQ ID NO: 16139 - protein, 183 aa, Saccharomyces cerevisiae
MPNFWILENRRSYTSDTCMSRIVKEYKVILKTLASDDPIANPYRGIIESLNPIDETDLSKWEAIISGPSDTPYENHQFRILIEVPSSYPMNPPKISFMQNNILHCNVKSATGEICLNILKPEEWTPVWDLLHCVHAVWRLLREPVCDSPLDVDIGNIIRCGDMSAYQGIVKYFLAERERINNH

SEQ ID NO: 16140 - protein, 189 aa, Arabidopsis thaliana
  misc_feature (48)..(48): Xaa can be any naturally occurring amino acid
  misc_feature (62)..(62): Xaa can be any naturally occurring amino acid
  misc_feature (114)..(114): Xaa can be any naturally occurring amino acid
  misc_feature (120)..(120): Xaa can be any naturally occurring amino acid
  misc_feature (134)..(134): Xaa can be any naturally occurring amino acid
  misc_feature (159)..(159): Xaa can be any naturally occurring amino acid
  misc_feature (172)..(172): Xaa can be any naturally occurring amino acid
  misc_feature (180)..(180): Xaa can be any naturally occurring amino acid
  unsure (1)..(189): unsure at all Xaa locations
MAFSMLSSAAVVTSPAQATMVAPFTGLKSSAAFPVTRKTNKDITSIAXTGERVSCMKVWPPXIGKKKFETLSYLPDLSDVELAKEVDYLLRNKWIPCVEFELEHGFCVTREHGXNTPGYXDGRYWTMWKLPLFXGCTDSGSSVERKLKNARREYPGAFXIRIIGFDNTRQVXQCISFICXYSPPSFTEA

SEQ ID NO: 16141 - protein, 90 aa, Triticum aestivum
MAGAAKASWMVAMSVGAGEALKDQVGLCRWNYVIRSIHRAAKARANIHGGVSQGAKQLPASAGAVAERRRAEKAEEGLRTVMYLSCWGPN

SEQ ID NO: 16142 - protein, 123 aa, Prunus avium
TMPSNCNGSRFKKELLSPRMQSKLKISWPNVVSSNDTKFWESEWNKHGTCSEQTLNQVQYFEISHEMWNSFNITDILKNASIVPHPTQTWKYSDIVSAIQSKTQRTPLLRCKTDPAHPNANTQ

SEQ ID NO: 16143 - protein, 546 aa, Mycobacterium bovis AF2122/97
MDQHQRPDPMGPGSPRASARRPEPDPMGEPWWSRAVFYQVYPRSFADSNGDGVGDLDGLASRLDHLQQLGVDAIWINPVTVSPMADHGYDVADPRDIDPLFGGMPAFERLVAAAHRQGIKVTMDVVPNHTSSAHPWFQAALADLPGSPARDRYFFRDGRGPDGSLPPNNWESVFGGPAWTRVREPDGNPGQWYLHLFDTEQPDLNSDNPEILDDFEKTLRFWLDRGVDGFRIDVAHGMAKPPGLPDSPDLGIEVLHHRDDDPRFNHPNVHAIHRDIRTVIDEYPGAVTVGEVWVHDNARWAEYLRPDELHLGFNFRLARTEFDAAEIRDAVANSLAAAALQNATPTWTLANHDVGREVSRYGGGEIGLRRAKAMAVVMLALPGVVFLYNGQELGLPDVDLPDEVLQDPTWERSGRTERGRDGCRVPIPWSGNIPPFGFSTCPDTWLPMPPEWAALTAEKQRADAGSTLSFFRLALRLRRERNEFDGDVDWLAAPDDALIFRRHGGGLVCALNAAERPLALPAGEPILASAPLTDATLPPNAAAWLV

SEQ ID NO: 16144 - protein, 726 aa, Guillardia theta
MFFILPKPALRVYKNFKNIVLYDKKNVHNLSKNGKSVQKYYNNIIYLYKNIKVKEKFTNLKIIFFLLLLVDLTIGNSEKIFLDKKKINLSMNDNTIVKNENVKNYDIKNNSNLLFIDITPLNVINDKFYEIIKEMDHHVSRPVKDALILLLATVFVVPLMRKFNTSPILGFLAAGLFLGPNGFGLVHRIGASKTLAEFGVVFFLFEMGLELSLSRLKSLGMDVFGLGYLQWLITGFILAFISLCNNASIEISLVIGFGLALSSSAFVLQLLSERGEVGTRFGRASFGILLFQDLAVVPLLVVVPLLATGGGDFTSLMNALILAAGKAAVALGIIFLGGRTCLEPVFRFGASAKSPEAFVATILVTVLAMSTLTESLGLSDTLGAFLAGVLLAETKYRHQIEADIAPFRGLLLGLFFITVGFGIDISLISGNFLTVITMLITLLVIKASIITTLGFFFGINFASAQRTGLILAQGGEFAFVTFGLAQKSNLMSPQLSQLLFLIVALSMVMTPFLATTGFKIASSIESKRGLMGARKEDIANAKDYVVVAGFGRVGQSVCDLLNARLIRYMAFDMNPARVIEARNKGLPVFFGDACRPEVLKAAGIKNPKAVVVTLDDKDGASKAVNALRREYPSIQIFVRAKDAKHQKMLQLGGATAIVPELLESSLLLGGAVLLSYGTPIEEVNSLIEEARKKTLIDAGLDVTGLTNFSSHNKNDDKKSDNDCNEN

SEQ ID NO: 16145 - protein, 118 aa, Prunus avium
RMPSKCTGSLFNFRKVYPQLRSDLKISWPDVESGNDTRFWESEWNKHGRCSEASLNQMQYFERSHAMWISYNITEILKNASIVPSATKNWTYSDIVSPIKRATKRTPLLRCKYDKSTQ

SEQ ID NO: 16146 - protein, 436 aa, Bacillus cereus ATCC 14579
MHHDEKNKIGLTVALSIVVGTIIGSGVFMKPGSVLDYSGSSNMAILAWIIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISQNQSIGMAILATLFAYDGWILLASIGGEMKNPTKLLPKAMTVGILIVTAAYVLINLALLNVLPAAKIVDLGENATATAAGMLLGEYGGKIISIGIIVSIFGCLNGKILTFPRIPMSMAERGQLPFSKFIAKESPRFKTPANAITVEIILGIILMIISDPNKLSEISVFIIYIFYVMTFIGVFILRKRNKNKERAYSVPLFPIVPIVAILGSFFVIGSAIINDPVSCFLSIGIVFTGLPVYWYLNKKKETE

SEQ ID NO: 16147 - protein, 297 aa, uncultured archaeon GZfos17F1
MADIIGIGALNVDKLYLVERIGAAGEEIGINSVSEQPGGSAANTIAALTRLGIKTGFIGRVGDDADGAYLRSELVKEGVDTRGIEVARGRTGSAIVLVDPGGERSMYVHPGVNDVLSLTPENISYAKNAKYLHLSSFVGETVIDVQREILDRSKAEISFAPGMLYARRGVDTLRKIISNARVVFLNRDEIEMLTGSGYSEGAGELNDIGAEIVVVTLGGDGCYIRTSDAEISIPGLAARVVDTTGAGDAFCAGFLYGLLIDKPLSVCGRLGNFVAAKCIEAVGAREGLPRKIEIVEG

SEQ ID NO: 16148 - protein, 122 aa, Prunus avium
KMPSNCIGSQFNESKVYPRLRSKLRISWPDVESGNDTKFWGDEWNKHGTCSQRILNQFQYFERSQQMWRSYNITNILKKAQIVPNATQTWSYSDIVSPIKTATNRTPLLRCKSQPKSQANFQ

SEQ ID NO: 16149 - protein, 339 aa, Guillardia theta
MPTKIGINGFGRIGRLVTRAAFSNKKADCQVVAVNDPFIDLDYMVYMFKYDSTHGIWKGSCEKKGDKLVIDGCEITCFTERDPTAIKWAAAGAIYVVESTGVFTTIDKAQAHLSGGAKKVVISAPSADAPMFVMGVNNKAYDGTPTIVSNASCTTNCLAPLAKVVERNFGIVEGLMSTVHATTATQKTVDGPSGKDWRGGRGAAQNIIPSATGAAKAVGKVLPELNGKLTGMAFRVPTPDVSVVDLTVKLAKPASYQQICDAIKAATTDPEYCGVIAYTDDEVVSTDFLGNSYSSIFDAKAGIALNDTFVKLVSWYDNEWGYSNRVVDLIAHMATVDKF

SEQ ID NO: 16150 - protein, 339 aa, Pyrenomonas salina
MSIPIGINGFGRIGRLVTRAAFTNEGANCKVVAVNDPFIDLDYMVYMFKYDSTHGIWKGQVEKKGDKLVINGTEVTCFTERDPTAIKWGDAGAKYVVESTGVFTTIEKASAHVAGGAKKVVISAPSADAPMFVMGVNNKTYDGTPQIVSNASCTTNCLAPLAKVIDTNFGIVEGLMSTIHAITATQKTVDGPSGKDWRGGRGAAQNIIPASTGAAKAVGKVLPQLNGKLTGMSFRVPTPDVSVVDLTCKLAKPASYQAICDAVKKAESDPEYCGVIQYCDEEVVSTDFQGNSKSSIFDAKAGIALNETFVKLVSWYDNEWGYSNRVVDLIAHMQTVDKL

SEQ ID NO: 16151 - protein, 188 aa, Brassica napus
  misc_feature (3)..(3): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(33): Xaa can be any naturally occurring amino acid
  misc_feature (36)..(36): Xaa can be any naturally occurring amino acid
  misc_feature (43)..(43): Xaa can be any naturally occurring amino acid
  misc_feature (67)..(67): Xaa can be any naturally occurring amino acid
  misc_feature (76)..(76): Xaa can be any naturally occurring amino acid
  misc_feature (81)..(81): Xaa can be any naturally occurring amino acid
  misc_feature (86)..(87): Xaa can be any naturally occurring amino acid
  misc_feature (90)..(90): Xaa can be any naturally occurring amino acid
  misc_feature (103)..(103): Xaa can be any naturally occurring amino acid
  misc_feature (122)..(122): Xaa can be any naturally occurring amino acid
  misc_feature (131)..(131): Xaa can be any naturally occurring amino acid
  misc_feature (133)..(133): Xaa can be any naturally occurring amino acid
  misc_feature (137)..(138): Xaa can be any naturally occurring amino acid
  misc_feature (144)..(144): Xaa can be any naturally occurring amino acid
  misc_feature (146)..(146): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (165)..(165): Xaa can be any naturally occurring amino acid
  misc_feature (169)..(171): Xaa can be any naturally occurring amino acid
  misc_feature (175)..(175): Xaa can be any naturally occurring amino acid
  misc_feature (177)..(178): Xaa can be any naturally occurring amino acid
  misc_feature (180)..(180): Xaa can be any naturally occurring amino acid
  misc_feature (182)..(183): Xaa can be any naturally occurring amino acid
  unsure (1)..(188): unsure at all Xaa locations
MSXFTSKFADELIANAXYXGXPGKGILXADEXXGTXGKRLASXNVENVESNRRALRELLFTAPGALXCLSGGILFXETLYXKSSDXXLFXDILKEGGVLPGIXVDKGTVELAGTNGETTTQXLDGLGERCXKXYEAXXRFGKWXAXLXIXEXEPSELSIHENAYXLVRXXXICQXKXXLXPXXNPPPP

SEQ ID NO: 16152 - protein, 483 aa, Nocardia farcinica IFM 10152
MVSVPELLESVPTQLWIGGPVDATGGATFPVHDPATGEVLTHVADATPEDAVRALDAAVAVQDEWAATPARTRGEILRAVFDAITARAEDFALLMTLEMGKALGESRNEVRYGAEFFRWFSEEAVRVHGRYQHAPSGTGRIIVHKQPVGPCLAITPWNFPLAMGTRKIGPALAAGCTMIVKPASETPLTMLLLARLCSEAGLPDGVLSVITTKHSSAVTKPLLDDPRLRKLTFTGSTEVGKKLVEQSANKLLRTSMELGGNAPFVVFDDADVDAAVQGAMLAKLRNGGEACTAANRFHVQRGVAEEFTDKLVEAMRSSVRLGPGTDPETTLGPLVNADQLATVTELVDDAVSAGARVRLGGEAPGGPGWFYPATVLSDVPDRARILNEEVFGPVAPVVTFDTEEQGLAAANDTRFGLVSYIYTRDLDRALRVAEGLESGMVGINRGVISDPAAPFGGVKESGFGREGGFEGIEEYLSTKYIAL

SEQ ID NO: 16153 - protein, 175 aa, Triticum aestivum
MAPAVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 16154 - protein, 89 aa, Triticum aestivum
MEGAAKASWMVAMSVGGVEALKDQAGLCRWNYALRSIHRAAKARANVRGGVLQGAKQLPASAAVAERRRGDKAEEGLRTVMYLSCWGPN

SEQ ID NO: 16155 - protein, 512 aa, Oryza sativa
  misc_feature (115)..(115): Xaa can be any naturally occurring amino acid
  unsure (1)..(512): unsure at all Xaa locations
MLPPASPPAVRQCLSFTSHRIAACRREAPLMKGESEEEETQALTAQSSHIHQEAHTAAAPPHPGLLTPPGGGATARTPAAAASAAAAYKAAAAAAAVGANSGTGVDLTPAAARRXKKRKLPEKQLPDRVAALLPESALYTQLLEFESRVDAALHRKKVDIQEALKSPPALQRTLRIYVFNTFANQAPRTIPPPKNAEPPTWSLKIIGRVLEDGAELDPASVVPKHNPVYPKFSSFFKRVTIALDPSLYPENPLIIWENARSAAPQEGFEVKRKGDKEFSANIRLEMNYNPEKFKLSQPLMEVLGVEVDTRSRVIAALWQYIKAKKLQNPTDPSFFMCDPQLKKVFGEDKLRFAMLSQKISQHLSPPPPINLEHKIKLSGNGAHASACYDVIVDVPFPLQKEMSAFLANTEKHKDIEACDEVISASIKKIHEHRRRRAFFLGFSQSPVEFINALIASQSKDLKLIAGEANRNIERERRADFYNQPWVEDAVIRYLNRKPASGNEGPGGGAGGS

SEQ ID NO: 16156 - protein, 119 aa, Zea mays
  misc_feature (3)..(4): Xaa can be any naturally occurring amino acid
  misc_feature (9)..(9): Xaa can be any naturally occurring amino acid
  misc_feature (16)..(17): Xaa can be any naturally occurring amino acid
  misc_feature (23)..(23): Xaa can be any naturally occurring amino acid
  misc_feature (33)..(33): Xaa can be any naturally occurring amino acid
  misc_feature (37)..(37): Xaa can be any naturally occurring amino acid
  misc_feature (42)..(44): Xaa can be any naturally occurring amino acid
  misc_feature (46)..(46): Xaa can be any naturally occurring amino acid
  misc_feature (53)..(53): Xaa can be any naturally occurring amino acid
  misc_feature (60)..(60): Xaa can be any naturally occurring amino acid
  misc_feature (64)..(64): Xaa can be any naturally occurring amino acid
  misc_feature (75)..(75): Xaa can be any naturally occurring amino acid
  misc_feature (80)..(81): Xaa can be any naturally occurring amino acid
  misc_feature (85)..(87): Xaa can be any naturally occurring amino acid
  misc_feature (89)..(89): Xaa can be any naturally occurring amino acid
  misc_feature (93)..(93): Xaa can be any naturally occurring amino acid
  misc_feature (95)..(96): Xaa can be any naturally occurring amino acid
  misc_feature (106)..(107): Xaa can be any naturally occurring amino acid
  misc_feature (109)..(109): Xaa can be any naturally occurring amino acid
  misc_feature (111)..(111): Xaa can be any naturally occurring amino acid
  unsure (1)..(119): unsure at all Xaa locations
MLXXSKKSXSKRVTLXXKHKVEXKVKEHHRKKXRRIXNLAKXXXRXKVEKDPXIPNEWPXKEQXLKGLEAQFVKXLQEFXXKKQXXXGXGFKXGXXDCLRTKKLVXXAXGXSAQGKRVC

SEQ ID NO: 16157 - protein, 473 aa, Synechococcus sp. CC9605
MSKSPQDVLRQIKDEGIELIDLKFTDLHGKWQHLTVCTDLLEEESFTEGLAFDGSSIRGWKGIQASDMAMVPDANTAWVDPFYKHKTLSMICSIQEPRTGQPYERCPRALAQRALNHLASTGLADMAFFGPEPEFFLFDDVRYNSAEGGSFYSVDTIEAGWNTGRIEEGGNLAYKIQVKEGYFPVAPNDTAQDIRSEMLLLMSQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLEFRSGDALANPYLAFSAMMMAGLDGIKNQIDPGDGEDRDLFELPAEELSKIATVPASLNGALEALNADRGFLTAGGVFSDDFIDNWIDLKYEEVQQLRQRPHPHEFTMYYDA

SEQ ID NO: 16158 - protein, 508 aa, Debaryomyces hansenii CBS767
MPQTVNNENEYRLTRSKAMQNQSLRGNEGGPKTHAQTQMEAQSQKGGRGEAVMGDGNGDTKDGLYNLSQHSSEEVLAGTRSYLGDVSNQYGSSGVKPNMGSKRRPLGGDNAPLQQHQRIMLKPNNSSTNTNHLLASQPKDTVTTTTATINDNTNGNITTNNHTSASSSNSSTQNLAVPARMPQKRQATESSTNLVEKLHISGPHSNHVSYKKSRIIDYEWQDLDEEDIDDPLMVSEYVNDIFPYLSELEHKTLPDSQYLFKQKHLKPKMRSILVDWLVEMHTRFRLLPETLFLAINIMDRFMSLEIVQIDKLQLLATGSLFIAAKYEEVFSPSVKNYAYFTDGSYTEDEILQAEKYILTILNFDLNYPNPMNFLRRISKADDYDVQSRTLGKYLLEITIIDYKFIGMLPSLCSASAMYIARLILGKTPVWNGNLIHYSGGYRVSDMKDCIELLVQYLIAPVEHDEFFKKYATRKFMKASILCRSWAKKIVSENKDIFANDLFINKAEN

SEQ ID NO: 16159 - protein, 469 aa, Saccharomyces cerevisiae
MTSIDINNLQNTFQQAMNMSGSPGAVCTSPTQSFMNTVPQRLNAVKHPKILKPFSTGDMKILLLENVNQTAITIFEEQGYQVEFYKSSLPEEELIEKIKDVHAIGIRSKTRLTSNVLQHAKNLVCIGCFCIGTNQVDLDYATSRGIAVFNSPFSNSRSVAELVIAEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVALKSLSYDQENTVRVLYIHQNVPGVLKTVNDILSNHNIEKQFSDSNGEIAYLMADISSVDQSDIKDIYEQLNQTSAKISIRLLY

SEQ ID NO: 16160 - protein, 397 aa, Bacillus cereus ATCC 10987
MFHRIEEALEDLKQGKVVIVCDDENRENEGDFIALAEYITPETINFMITHGRGLVCVPITEGYAERLQLEPMVAHNTDSHHTAFTVSIDHVSTTTGISAHERATTIREMLNPASKGADFNRPGHIFPLIAKEGGVLRRAGHTEAAVDLAQLCGAEPAGVICEIINEDGTMARVPDLLQCAKQFDIKMITIEDLIAYRRHHETLVTREVEITLPTDFGTFHAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLEVIERVPLQMPAKEENKTYLQTKVNKLGHLLNL

SEQ ID NO: 16161 - protein, 241 aa, Bradyrhizobium japonicum USDA 110
MNMDQLKRQAAARALEEVRDGMQLGLGTGSTAKHFVELLGERVAAGLKVIGVPTSEATRLDATRCGVPLTTLDEIDHLDITVDGADEIDPELNLIKGGGGALLREKIVAAASDRMIVIADDTKWVPTLGRFPLPIEVIPFGLGATRRAIETAFAQCGVSGQMAVRKAKGGDKDGHVFVTDGGHWILDAQLGRIVDPPSLAKALSAIPGVVEHGLFIGLASSAVLAGGEGIRVIERRKPKGD

SEQ ID NO: 16162 - protein, 117 aa, Prunus avium
RMPSNCTGPQFKRILSPQLRSKLQTSWPDVESGNDTKFWESEWNKHGTCSKETLNQMQYFERSYAMWMSYNITEILKNASIVPHPTQTWKYSDIVAPIKAATKRTPLLRCKQDKNTV

SEQ ID NO: 16163 - protein, 451 aa, Aspergillus nidulans FGSC A4
MFEDDSEAPGCQRSEAYRTSSTASPLDSGAFPDHQPNESEYLNGRSRQAGGVNSIDNFARSWQRAACFPEVFPRRPSFATVDSDEEWQSSSGNFIRSLGSSHVDLDPALTRPLLSDYGVSSGQRDGISSSCHLEPALGTSYGSVSSRVSESARKHVIEFHRQQQAYSEPAVGHEGEPLLVKQVQHEDGTRESIVVGQSTVPQTVFNSVNVLIGVGLLSLPLAMKHAGWLFGLTFLLFAAIATSYTAKILAKCLDVDRGLVTYADLAYISFGHRARLVSSCTFSGIEHYPMADYIMSIPFLLKGANTQLIALVVAITCIDGFIKPHAPGSLREPAQTHLLPENWGTVPLSFGLIMSPWGGHGVFPNIYRDMRHPHKYGRSLWSTFIDIMLTSILWQYSLDCAMAVLGWMMFGDTIRDEVTANVLTMNEYPQLLSICIIISVAVIPITKVPLK

SEQ ID NO: 16164 - protein, 97 aa, Zea mays
PPGVFSIAVERNPPESRLQQLGVKSWPKWGCPPGKFPVKFDARQTCYLLKGKVRAHIKGSSECVEFGAGDLVVFPKGLSCTWDVVAAVDKYYKFDSS

SEQ ID NO: 16165 - protein, 469 aa, Bradyrhizobium japonicum USDA 110
MKTAKDVLKSIKDNDVKYVDLRFTDPRGKWQHVTFDVSMIDEDIFAEGTMFDGSSIAGWKAINESDMCLMPDPVTATIDPFFAETTMVITCDVLEPTTGEPYNRDPRGIAKKAEAMVKSMGVGDTVFVGPEAEFFVFDDVRFSSSPYNTGFRLDSSELPTNTDTEYEGGNLGHRVRTKGGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGLDGIKNKIDPGPAMDKDLYDLPKEELKQIPTVCGSLREALENLDKDRAFLKAGGVFDDDFIDSYIELKMTEVERFEMTPHPVEFDMYYSG

SEQ ID NO: 16166 - protein, 326 aa, Nocardia farcinica IFM 10152
MTRAPAEPGRRGFRRVPARRPPLWHGGLYESVADMKTILITGATSGIGSAAAEQLGARGEHLILVGRNPEKLAATEQRVRAAGAGAVDTLRCDVGSQAAIRELAEQVRQRYDRLDVLANNAGGHFPDRALTEDGVETTFAVNYLGPFLLTELLLDLLLDSAPARVVFTSSVLHFGARLDLDDLPFEHGYTGEKAYSRSKLALILYTRELARRLDGTGVTVNAFHPGAVATGIWDTMPWYGKPLAAIAKRIFMISPEQGAEALTYLATDPEVADTTGCYFQRNRPKQPGRRATDDELGARLVEVSARLCGLPTPLKAGDARGGTPPA

SEQ ID NO: 16167 - protein, 460 aa, Idiomarina baltica OS145
MSELSIEWPIHLTHLGGTWQVTGSCHLWHLNAQQTVMIDCGAFQGITQEDDLTPYVDVDSLAAVFITHAHLDHVGRLPQLLALGYRGPIYCTAATLALMQLVLGDSLQLAGIRDESALTAFNTLLARHVVLCEYGQTVDVLPSLSVTFEEAGHILGSSYLCFDIKSLHKRVVFSGDLGCRNSPLINDPTPLKRADLLVLESTYGDRSHGDRSQRTQQLESIIKRAVVDGGAILIPAFSIGRTQELLYEFEQIWHQHACSKDTDFPEIVIDSPMANKVTDIYQHHEALWDATSRSRQAHGRHPLDFSHAHPVDEHSLHLALVNRLKSTAEPVIVIAGSGMCTGGRIINYLDALIEDPRTDLLFVGYQAQGTLGEQIQRAATGDVVTINQQKRKVNAQVYSLTGYSAHADQDELLAFIGNAEFPVQAVRLVHGSAPAQHTLAEKIRQQFSIPVTTTVATEKP

SEQ ID NO: 16168 - protein, 509 aa, Xanthomonas oryzae pv. oryzae KACC10331
MPVATGITLSEHLQRSANDCTPSAHSQTVDLVAFDYRQPSSPTRPFRRVGARGRRPDNGQRDARCRASMPPIGISQGSARMNHSRSHALFAQAQTVLPGGVNSPVRAFKSVGGEPFFVARADGSYLFDVDGNRYIDYVGSWGPMIAGHNHPAVREAVERAIRDGLSFGAPCAAEVTMAETITGLVPSCEMVRMVNSGTEATLSAVRLARGATGRNRIIKFEGCYHGHGDSFLVKAGSGMLTLGVPTSPGVPAGLSELTATLSFNDFEGATALFDEIGPEVAAVIIEPVVGNANCIPPQAGYLQHLRTLCTRHGALLIFDEVMTGFRVALGGAQAHYGVTPDLSTFGKIIGGGMPVGAYGGRRDLMEQIAPAGPIYQAGTLSGNPVAMAAGLAMLELVQEPGFHMRLSEATSALCEGLKDAARTAGIAVTTNQVGGMFGLFFTDDIVESYAQATACDITSFNRFFHAMLQRGVYLAPSAYEAGFMSSAHDATVIEATLAAARDAFADVAR

SEQ ID NO: 16169 - protein, 236 aa, Brassica napus
  misc_feature (118)..(118): Xaa can be any naturally occurring amino acid
  unsure (1)..(236): unsure at all Xaa locations
MKKPTAVTQDEWLTAALTEDAVVVELLLRLKHAGTVESAANIPLLRWGSRKPRSRLGVGGVLKKETDSARASPMTPLCWSGGSGSGGSSCPSADGFEDASRQSTCSTSTGYGSKGVTXTNEISSYKRSKKQKIFLDLKDAENFQLKERLNLQKNIANVQATYEKRSAKNQSLKRMKLEYSDRIKNIPINRSNLDESRKKRRLPFSSSRKPVKNEHSYRTTSETKRPCTGRVKQRKL

SEQ ID NO: 16170 - protein, 414 aa, Triticum aestivum
  misc_feature (164)..(164): Xaa can be any naturally occurring amino acid
  unsure (1)..(414): unsure at all Xaa locations
MPNAIPAFFRASPAAASGSGAGAGPSLATSVYETRLGLAALSWSRAAFGLSLRAVLRVGALASSSSASDYGCYDDGPEFDEEATIAVRVRPWLFWRRRGSKRFHVHDRRIDLAWDLTRARFASPGSPEPSSGYFVAVVVDGEMAVVAGDMTEEAYRKTKAQRAXGPGHVLISRREHVSMRDGGHGRGHKTCVKVRGKEREISLDLVSRGHGKDREMDKEKDKAEVGLSVSVDGERVLHIRRLRWKFRGSEKVDLGGGDRVQVSWDLHNWLFSAREPALTDAASVLAAASPPAHAVFVFRFELGDTAGGEERDSAEAKEKELLDKARRGGAGVLSGYLGRWGRGDWSETSSNGENRRKRGQARRLAKASSSSSASIASSSASWASSSTVMDWASPEEAELHRGDGFSLLVYAWKS

SEQ ID NO: 16171 - protein, 507 aa, Glycine max
MCGVSLLAFLLLLSLCAEASVHDYRGEKFAAKGNAFVVHGGSEGIYASAPNLTDAYPPPNPDSYIRFERITFRRNKELSNFSSWPIQAVVFEVEDRETIGGSAYGGQRAVCCTGDLAKLGVCAEGQVIYRPSVENPDWPQVFGVSFEMDDEVAVLPLKSIQITKTGMYNLYFIHCDTRLKELVVEGKTVWKNPSGYLPGRMAPMKVFYQFMSFAYVLLGIFWFSQYARFWKEVFPLQNCITAVITLGMFEMALWYFDYAEFSETGIRPTGTTIWAVTFGTVKRTFARLVILLVSMGYGVVRPTLGGLTSKVVMLGGTFFIASEVLELVENVGAVSDLSGKAKLFLVLPAAVLDVFFILWIFTSLSATLTKLQTRRMMIKLDIYRKFTNALAAAVLVSVGWICYELYFKSNDVYNEQWQNAWIIPAFWQVLSYSLLCVICILWAPSQSATRYAYRDDGSDEFDRDETTLTLIKPSPISSKDVRSVPDARPVQSSNGNSNDDLEEDKRE

SEQ ID NO: 16172 - protein, 464 aa, Vibrio vulnificus YJ016
MNRVINRSKIFLTAVERGTMPATWSEQSEEDKPMTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDLERFKRFFHLMIDHGVYLAPSAFEASFTSLAHGSKEIEATLEAADRCFAILAAESK

SEQ ID NO: 16173 - protein, 478 aa, Bacillus thuringiensis serovar konkukian str. 97-27
MRKTMSQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 16174 - protein, 328 aa, Carboxydothermus hydrogenoformans Z-2901
MKEEIISMLVKSQDYVSGEEISQKLGVTRTAIWKHIKELKREGYEITAHPRKGYKLERYPDIPAYYLLKPFLKTRYLGHTGEYHDLIGSTNDRAKELAANKVPEGFLVSANGQTAGRGRLGRSWNSPPGQGLYFSLVLYPSLPPVELPRLTLLAGLALAQALENLGVNVQIKWPNDLLINGQKVAGILTEIAAEAERTIYAVVGIGINIEPLDEEVKSSFAYPATALKEHLPGVSRQSLLAMFLERFEKLYEEFKKGEFAQSLTEYKKRLAFLGEEVMIITGDREYIGVLHDLGEDGSLIINDGNTVKRFAAGEISLRRKEGEHVLSN

SEQ ID NO: 16175 - protein, 126 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGS

SEQ ID NO: 16176 - protein, 428 aa, Staphylococcus aureus subsp. aureus Mu50
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 16177 - protein, 390 aa, Anabaena variabilis ATCC 29413
MQFAKRLEKIPPYLFAEINRKREALIAQGVDIINIGVGDPDKPTPAHILQAMREAIDEASNHNYPPYEGTQEFREAAVKWMERRFGVVDLNPNTEVVSSIGSKEAIHNTFLAFVEAGDYTLIPDPGYPVYRTSTIFAGGEPFTMPLKAENKFLPDLDLIPEEVARKAKMLWVNYPNNPTGALATLEFFEELVAFCQQHSILLCHDHAYSEMAYDGYKPPSVLQIPGAKDIAIEFHSLSKSYNMTGWRIGFAVGNAYAIQGLSQVKTNVDSGVFKAIQKAAIAAYNTDEVELQAVMSVYQNRRDIIVKGLQSLGWPIEPPKATLYVWVPVPPGYTSTEFTTLLLDKCGIVVPPGVGYGVSGEGYFRIALTICEERLHEAIQRMQDAGIRYS

SEQ ID NO: 16178 - protein, 527 aa, Oryza sativa
MHSTNLLLEEPIRMASILEPSKPSFFPAMTKIVGTLGPKSRSVDTISSCLKAGMSVARFDFSWGDAEYHQETLENLKVAIKSTKKLCAVMLDTVGPELQVVNKSEASISLEENGTVILTPDQGQEASSQVLPINFAGLAKAVKPGDTIFVGQYLFTGSETTSVWLEVSQIKGDDVVCVIKNTATLAGSLFTLHCSQIHIDLPTLSDEDKEVIRKWGAPNKIDFLSLSYTRHVEDVRQAREFLSKLGDLSQTQIFAKIENVEGLNNFDEILQEADGIILSRGNLGIDLPPEKVFLFQKSALHKCNMAGKPAVVTRVVDSMTDNLRPTRAEATDVANAVLDGSDAILLGAETLRGLYPVETISIVGKICAEAEKVFNQDLYFKRTVKHVGEPMTHLESIASSAVRAAIKVKASVIICFTSSGRAARLIAKYRPTMPVLSVVIPRLKTNQLRWSFTGAFEARQSLIVRGLFPMLADPRHPAESTNATNESVLKVALDHGKVSGVIKSHDRVVVCQKVGDSSVVKIIELDD

SEQ ID NO: 16179 - protein, 549 aa, Lactobacillus sakei subsp. sakei 23K
MKWWQKATVYQIYPRSFQDSNGDGIGDINGIIQRLDYLQDLGIELIWLTPMYVSPGRDNGYDIADYYQIDPIFGDLADFERLLKEAHQRGIKIMMDMVVNHTSDQHRWFQESLKGKDNPYHDYYLWRDPVDGHEPNNWLSKFSGSAWEYVPALNQYYLHLYEKRMPDLNWRNPQLREEIYQMMQFWADLGIDGLRLDVINNISKDKDFPNDTFETPSDDGRNFYTNGPHVHEYIHEMYERVFGPNNFVTVGELSSTPVSEAIRYTNPEREELSMAFTFHHVKVDYTGGKKWTLGQYRLSDLKRILSQWQTEMAAGGGWNALFWSNHDQPRAISRFLDDGQYRDQSAKLLALVEFGLQGTPYIYQGEEIAMKNANFTSIDQYQDAESINAYHQMLADGISEDLAIKILQQKSRENCRIPMQWDMTANHGFTTGMPWLQPVVADDYSVATKAQAPDSVFAFYQQLVALRKTEPVLIEGQYQLLAPEDEAVYTYQRQLGDKKVRVIANFTDQTQQRANAAVKAVMMSNYPDQQLTTDQITLRPYEAVMLEIE

SEQ ID NO: 16180 - protein, 304 aa, Guillardia theta
MNENTKFLEEVIKKLTQSKKIKNIFLTEKEIGKLCYLSRKVFNNENSMLYLNSPIKICGDIHGQFYDLLRLFEFNGYPPTEKYLFLGDYVDRGKQSIEVISLLFAFKVRYPTKIFILRGNHESSKINRIYGFYDECKKKYNIKIWKIINETFNYLPLAAIIEKKIFCIHGGLSPFLNSIKQIEDIARPVEIPEKGLLCDLLWSDPNEDKQGWNLSDRGISYTYGDNIVKEFIEKFDFDLICRAHQVVDKGYKFFSNRMLVTIFSAPNYCGEFSNAGAVMNVDKLLVCSFQILKPYFGKKINSSK

SEQ ID NO: 16181 - protein, 460 aa, Lactobacillus sakei subsp. sakei 23K
MTQAKKIPSSFIYFFGSFGGILFGYDIGVMTGALPFLQHDWHLENNAGVVGWITSAVMFGAIFGGALAGQLSDKWGRRKMILLSSLIFAIGSLLSAFSPNDGQVYLIAVRVFLGLAVGAASALVPAYMSEMAPARLRGRLTGINQTMIVSGMLLSYIVDYLLKGLPEQLAWRLMLGLAAVPAIILYFGVLRLPESPRFLVKHNRLDEARQVLGYIRSKDEVETELTNIQTTAGMESNVQQSTSMKTLLSGKYRYLVIAGIGVAGFQQFQGANAIFYYIPLIVEKATGKAASSALMWPIIQGVILVLGSLLFLVIADKFKRRTLLTLGGTVMGLSFILPAIMNALIPNFNPMMIVVFLCLYVAFYAFTWAPLTWVLVGEIFPLAIRGKASGLASSFNWIGSFLVGLLFPMMIASMPQEGVFAIFGVICLLGVLFIRTCVPETMGHTLEEIEAQGTNKAHKA

SEQ ID NO: 16182 - protein, 962 aa, Idiomarina loihiensis L2TR
MSSTTLTQLEHHDEFISRHIGPSADEQKAMLAELGVDSLEALTKDTVPGAILREPFLQTGEPQTEREALARLKNIAKKNQICTSYIGMGYYDTVVPNVILRNVLENPGWYTAYTPYQPEIAQGRLEALLNFQQMTMDLTGLDLASASLLDEATAAAEAMAMAKRVSKNKKSNAFFIADNVYTQTIDVVKTRAEYFGFDIIVGPAREASDHDVFGALLQYPDKQGQLHNIEQLIGELQEKKAIVAVASDLMSLLMVKSPGEMGADMVFGNAQRFGVPMGYGGPHAAFFATRDKFKRSLPGRIIGVSKDSRGRPALRMAMQTREQHIRREKANSNICTAQVLLANMASFYAVYHGPDGLRRIANRIHRLTDIVALGMQDKGVKLVNSHWFDTLTFEMKENAADVLARSKALGLNLRVDGEGMFGISLDEAKTRDDVESLFAALFGDNHGLDIDVLDSRVAGGDVESIPADLVRQSQYLQHPVFNEYHSETEMLRYIKKLENKDLALNHSMISLGSCTMKLNATAEMIPVTWPEFGQLHPFCPAEQAQGYYELVSTLSEWLIDVTGYDAMSMQPNSGAQGEYAGLLAIQKYHESRGDGHRNICLIPSSAHGTNPASAQMMNMKVVVVDCDKHGNVDMDDLKAKAEEAGENLSCIMVTYPSTHGVYEEGIKDICDLVHNYGGQVYMDGANMNAQVGVTSPGYIGSDVSHLNLHKTFCIPHGGGGPGMGPIGVKQHLAEFLPNHSIVNIDGPKAGNGAVSAAQFGSASILTISWMYIAMMGGRGLREASETAILNANYLAEKLSKHFKILYRGRNNRVAHECIIDLRPMKDAAGIAEIDVAKRLQDYGFHSPTMSFPVAGTIMVEPTESESKAELDRFIEALVSIKAEAEKVAAGEWPKDNNPLVNAPHTLADITDAEWDRPYDRKTATYPVEAVGYDKFWPTVNRIDDVFGDRNLMCSCPSIEEYR

SEQ ID NO: 16183 - protein, 571 aa, Escherichia coli O157:H7 EDL933
MNVNSSSNRGEAILAALKTQFPGAVLDEERQTPEQVTITVKINLLPDVVQYLYYQHDGWLPVLFGNDERTLNGHYAVYYALSMEGAEKCWIVVKALVDADSREFPSVTPRVPAAVWGEREIRDMYGLIPVGLPDQRRLVLPDDWPEDMHPLRKDAMDYRLRPEPTTDSETYPFINEGNSGARVIPVGPLHITSDEPGHFRLFVDGEQIVDADYRLFYVHRGMEKLAETRMGYNEVTFLSDRVCGICGFAHSVAYTNSVENALGIEVPQRAHTIRSILLEVERLHSHLLNLGLSCHFVGFDTGFMQFFRVREKSMTMAELLTGSRKTYGLNLIGGVRRDILKEQRLQTLKLVREMRADVSELVEMLLATPNMEQRTQGIGILDRQIARDYSPVGPLIRGSGFARDLRFDHPYADYGNIPKTLFTFTGGDVFSRVMVRVKETFDSLAMLEFALDNMPDTPLLTEGFSYKPHAFALGFVEAPRGEDVHWSMLGDNQKLFRWRCRAATYANWPVLRYMLRGNTVSDAPLIIGSLDPCYSCTDRVTLVDVRKRQSKTVPYKEIERYGIDRNRSPLK

SEQ ID NO: 16184 - protein, 410 aa, Sinorhizobium meliloti
MTINATVKEAGFRPASRISSIGVSEILKIGARAAAMKREGKPVIILGAGEPDFDTPDHVKQAASDAIHRGETKYTALDGTPELKKAIREKFQRENGLAYELDEITVATGAKQILFNAMMASLDPGDEVVIPTPYWTSYSDIVQICEGKPILIACDASSGFRLTAQKLEAAITPRTRWVLLNSPSNPSGAAYSAADYRPLLDVLLKHPHVWLLVDDMYEHIVYDAFRFVTPARLEPGLKDRTLTVNGVSKAYAMTGWRIGYAGGPRALIKAMAVVQSQATSCPSSVSQAASVAALNGPQDFLKERTESFQRRRNLVVNGLNAIEGLDCRVPEGAFYTFSGCAGVARRVTPSGKRIESDTDFCAYLLEDSHVAVVPGSAFGLSPYFRISYATSEAELKEALERISAACKRLS

SEQ ID NO: 16185 - protein, 80 aa, Glycine max
MGVSKEQVELFLKATLIPYDLEVVDVSGGCGARVVAEFVSDQVDGNRVFERHIMDGAALQEVVILVHAVFITIAVYTGYV

SEQ ID NO: 16186 - protein, 340 aa, Glycine max
MFFLSSPFSSCFRASQRTNHDPTNLTTYIYHTEYGTVSLTWSRSLLGRSLHVNLHNRSSFHLLLKPWKKNGSKKLSHNTVFLWNLSNARFESGLEPRSRFYLAIEVEHGLSLLIGDLSPRSSKAKKPSKTNQLLVLKRDNVHVAPHRSRVYQTKAKLGGKVREIEIDCDVYNCCGYGYENENSSRLLFSVDGEKVLEVARLKWKFRGSERVEIDGVHVQISWDVHDWLFEKDKDIVNHRSSNNNNSNNNGIEGHAVFMFKFEEDEVRGSGGGKEEEQQWSMGSGGEWRNGKSWSSSSLSVSSTSGGSFGGSSSVMEWSSVEENELVVPLGFSLVVYAWRR

SEQ ID NO: 16187 - protein, 502 aa, Zea mays
MMMRTNTLFLLSLAILLGTSLAVTDVSQEAQLSKFMTTRALKRLTTKRPRVNGPEETDPWADPSAFAHLAERCKGPPSGSKEADRVLGLPGQPPRVNFRQYSGYVTVNEEHGRELFYYFVESPHDAASKPLILWLNGGPGCSSLGFGAMKELGPFRVNPDGTLRRNKHSWNNLANVIFLESPAGVGFSFSRNATDYDTVGDRRTAEDTYVFLAKWLDRFPEYKGRAFYVTGESYGGHYVPELATVILYMNRFPDLLTPINLQGIFFGNPLLDDYLNGKGELEFLWSHGVISDEVWARILANCTFTPSDDWPCFVAAHSFQRGNIDKYDIYAPVCLQSDNGTYYSSSHSLPGYDPCSYYYIEPYLNNHAVKQALHARVDTNWTGCSEDLAWNDAPEFMVPIIKRLINEGLKVWIYSGDFDSVCSITATRFSVNDLNLTVTTKWRPWYTPDSEVGGYVQQYKEGFTFASVRAAGHLVPTIQPKRSLVLLYAFLKNMLPPADISN

SEQ ID NO: 16188 - protein, 223 aa, Triticum aestivum
  misc_feature (30)..(30): Xaa can be any naturally occurring amino acid
  misc_feature (55)..(55): Xaa can be any naturally occurring amino acid
  misc_feature (82)..(83): Xaa can be any naturally occurring amino acid
  misc_feature (94)..(94): Xaa can be any naturally occurring amino acid
  misc_feature (96)..(96): Xaa can be any naturally occurring amino acid
  misc_feature (109)..(109): Xaa can be any naturally occurring amino acid
  misc_feature (123)..(123): Xaa can be any naturally occurring amino acid
  misc_feature (138)..(138): Xaa can be any naturally occurring amino acid
  unsure (1)..(223): unsure at all Xaa locations
ALVCSGNIFRPGLHTHIVARGGPGFCPRNXLGFLQRWKWGHVLSIWFPMFGGARXKRIPKGHPVPQVALMVLEGKFIWTLVXXLLNRYLFPINXKXFWGPNPGHYFLHXGCHHKIPMDGLRLXFPTMGAAILWYPFWXFVKLFTNTSTTPGVFGGGLLGYVIYDCTHYYLHHAQPSFDPAKYLKKYHLNHHFRIQNKGFGITSTLWDHVFGTLPSTKTADKSS

SEQ ID NO: 16189 - protein, 466 aa, Glycine max
MAVSAITGARLTLGMSLSSSTRSRTVAMAVSIDPKTDNKLTLTKSEEAFAAAKELMPGGVNSPVRAFKSVGGQPIVIDSVKGSRMWDIDGNEYIDYVGSWGPAIIGHADDQVLAALGETMKKGTSFGAPCLLENTLAELVIDAVPSIEMVRFVNSGTEACMGALRLARAYTGREKIIKFEGCYHGHADPFLVKAGSGVATLGLPDSPGVPKAATFETLTAPYNDTEAIEKLFEANKGEIAAVFLEPVVGNAGFIVPKPDFHSFLRKITKENNTLLVFDEVMTGFRLSYGGAQEYFGITPDITTLGKIIGGGLPVGAYGGRRDIMEKVAPAGPMYQAGTLSGNPLAMTAGIETLQRIKEPGTYEYLDKITGELVEGIIEAGKRAGHAICGGHIRGMFGFFFTEGPVYNFADAKKSDTAKFARFFWGMLAEGVYLAPSQFEAGFTSLAHTSDDIKKTIAAAEKVFREI

SEQ ID NO: 16190 - protein, 321 aa, Oryza sativa
IGFARYEKYHGYYGGKEEARKSNYTDMVNKYYDLATSFYEYGWGESFHFAHRWNGESLRESIKRHEHFLALQLGVKPGMKVLDVGCGIGGPLREIAKFSLASVTGLNNNEYQITRGKELNRVAGVSGTCDFVKADFMKMPFSDNTFDAVYAIEATCHAPDPVGCYKEIYRVLKPGQCFAVYEWCITDHYEPNNAHTRGSRMKSSLARGLPDIRSTQPCLQAAKDAGFEVIWDKDLAEDSPVPWYLPLDPSRFSLSSFRLTTVGRAITRTMVKALEYVGLAPQGSERVSNFLEKAAEGLVEGGKKEIFTPMYFFLVRKPISE

SEQ ID NO: 16191 - protein, 459 aa, Bacillus thuringiensis serovar konkukian str. 97-27
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFEKYMKNSMEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLVRK

SEQ ID NO: 16192 - protein, 589 aa, Bacillus subtilis
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPGVNDFFGGDLQGIVDKLDYLEDLGVNGIYLTPIFSAPSNHKYDTLDYFSIDPHFGDPEIFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLDGENDPLCRKCMVWEKEKQNQDMLQFMKRLIALRKQENTLLTEGHLEWNLLDDKNDFISFSRTLDEKILIYFFNQGNVVQHISLRELNIDRNNKICDAWTEQPLHYHDVIAVQPGEFLILSAAAPV

SEQ ID NO: 16193 - protein, 473 aa, Bacillus thuringiensis serovar konkukian str. 97-27
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFIDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTNTTEVESL

SEQ ID NO: 16194 - protein, 941 aa, Mycobacterium bovis AF2122/97
MSDHSTFADRHIGLDSQAVATMLAVIGVDSLDDLAVKAVPAGILDTLTDTGAAPGLDSLPPAASEAEALAELRALADANTVAVSMIGQGYYDTHTPPVLLRNIIENPAWYTAYTPYQPEISQGRLEALLNFQTLVTDLTGLEIANASMLDEGTAAAEAMTLMHRAARGPVKRVVVDADVFTQTAAVLATRAKPLGIEIVTADLRAGLPDGEFFGAIAQLPGASGRITDWSALVQQAHDRGALVAVGADLLALTLIAPPGEIGADVAFGTTQRFGVPMGFGGPHAGYLAVHAKHARQLPGRLVGVSVDSDGTPAYRLALQTREQHIRRDKATSNICTAQVLLAVLAAMYASYHGAGGLTAIARRVHAHAEAIAGALGDALVHDKYFDTVLARVPGRADEVLARAKANGINLWRVDADHVSVACDEATTDTHVAVVLDAFGVAAAAPAHADIATRTSEFLTHPAFTQYRTETSMMRYLRALADKDIALDRSMIPLGSCTMKLNAAAEMESITWPEFGRQHPFAPASDTAGLRQLVADLQSWLVLITGYDAVSLQPNAGSQGEYAGLLAIHEYHASRGEPHRDICLIPSSAHGTNAASAALAGMRVVVVDCHDNGDVDLDDLRAKVGEHAERLSALMITYPSTHGVYEHDIAEICAAVHDAGGQVYVDGANLNALVGLARPGKFGGDVSHLNLHKTFCIPHGGGGPGVGPVAVRAHLAPFLPGHPFAPELPKGYPVSSAPYGSASILPITWAYIRMMGAEGLRAASLTAITSANYIARRLDEYYPVLYTGENGMVAHECILDLRGITKLTGITVDDVAKRLADYGFHAPTMSFPVAGTLMVEPTESESLAEVDAFCEAMIGIRAEIDKVGAGEWPVDDNPLRGAPHTAQCLLASDWDHPYTREQAAYPLGTAFRPKVWPAVRRIDGAYGDRNLVCSCPPVEAFA

SEQ ID NO: 16195 - protein, 487 aa, Oryza sativa
  misc_feature (271)..(271): Xaa can be any naturally occurring amino acid
  unsure (1)..(487): unsure at all Xaa locations
MAHSLPLDVWGWITNLPPFSQWRSNAMSLCICPTPSASESSQPSVNLSVVKTPPTQPSFVTFSIFANYRVPISLWTSKPVHLKSYTQQSLDEQEMLELFVDIVDWVLRSGPNKKLSFQFPRAQIHGNLKDVFNIVFLSLAFLVCIYEAPHALRCRCLESLRTQLTGPKCKDAAKTFVRMLGANLEEQWMQTMNLAVTNWIVEQRSSHHSFGVPSPLFSYALSASGLWKVQLYCPLIAMSMEDPAVPTQDERLLFSLTYQQLEGVIQLAVDXLRCDVDSLVSEILMTERGHGSEEKHFPSRVMLQITPMQQSDVLSVSVSKSSDNPTHEFGLEKGIEGSFDPPNTFGLKASVSESLTLTMKPWKFEQSVHGNTTTLNWFLHDGVNGREVYSSKPSKLSLLQPRAWFRDRYSTVYRPFTKKGGVIFARDEYGDSVWWKICGAALGKTMDWEIRGWIWLTYWPNKQKTFHSETRRLEFRECLQLPLMKSP

SEQ ID NO: 16196 - protein, 570 aa, Candida albicans SC5314
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRSSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDVPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 16197 - protein, 233 aa, Zea mays
  misc_feature (155)..(155): Xaa can be any naturally occurring amino acid
  misc_feature (221)..(221): Xaa can be any naturally occurring amino acid
  unsure (1)..(233): unsure at all Xaa locations
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMLQSCYSILXKAWEGAGVVASARKLIGATNPLQAEPGTIRGDLAVQTGRNVVHGSDSPDNGKREIELWFKEGELCXKWESVQAPWLIE

SEQ ID NO: 16198 - protein, 140 aa, Anabaena variabilis ATCC 29413
MAQTQETTTKTHTLPLPTTITSRSVAATELRPWGSFTVLEEGRGYKIKRIEVKPGHRLSLQMHHHRSEHWIVVSGTARVVCGEKEILLSNNQSTYVPQCTAHRLENPGVIPLVLIEVQNGEYLGEDDIIRYQDDYSRTSN

SEQ ID NO: 16199 - protein, 399 aa, Bacillus cereus ATCC 14579
MDTLIFEVGTALVLVAIAAVIAGKFKFSVIPFLIVLGMLVGPHAPTIGVIDLKFIESASVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESRNVYKFLNKIFKWDTKTN

SEQ ID NO: 16200 - protein, 975 aa, Burkholderia thailandensis E264
MKLEHPDRLMKRTPLSLAALETHDAFAERHIGPDAASQQAMLDTLGFATRAALIDAVIPASIRRAETLPLGPFAQPLSEAEALAALRELADKNQVFRSYIGQGYYDTHTPAVILRNVLENPAWYTAYTPYQPEISQGRLEALLNFQQMVADLTGLEISNASLLDEATAAAEAMTLLQRVGKPQSNVFYVADDVLPQTLEVIKTRAKPIGIEVKSGPAADAAAANAFGVLLQYPGVNGDVRDYRALADAIHAAGGHVVVAADILALTVLTPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPRGLKTIALRVNRIAALVAAGVKQLGFATVNDTFFDTLTIDTGARTAQIHALANAKRINLRRVSDTRVGISVDETTTRGDLAELLGVFAQAAGGTAPDVDALDAGLADTAALPAGLQRTSAYLTHHVFNRHHSETEMLRYLRSLSDKDLALDRSMIPLGSCTMKLNATSEMLPVTWPEFGRIHPFAPAEQTVGYREMIDQLEQMLVAATGYAAVSLQPNAGSQGEYAGLLIIHAYHESRGESHRNVCLIPASAHGTNPASAHMAGMKVVVVACDAQGNVDIDDLKAKAEQHANDLAAIMITYPSTHGVFEQNVREICEIVHAHGGQVYVDGANMNAMVGLTAPGQFGGDVSHLNLHKTFCIPHGGGGPGVGPVAVGAHLAKFLPNQRSTGYARAEDGIGAVSAAPYGSASILPISWMYIAMMGAKNLTAATETAILNANYIAKRLAPHYPVLYSGPGGLVAHECILDLRPIKDSSGITVDDVAKRLMDYGFHAPTMSFPVPGTLMVEPTESESQEELDRFVAAMIAIRDEIRAVEEGRADREDNPLRHAPHTAAVVTANEWPHAYSREQAAYPVASLVANKYWPPVGRADNAYGDRNLFCSCVPVSDYA

SEQ ID NO: 16201 - protein, 404 aa, Yersinia pestis CO92
MSPIEKSSKLDNVCYDIRGPVLKEAKRLEEEGNKVLKLNIGNPAPFGFDAPDEILVDVIRNLPTAQGYCDSKGLFSARKAIMQHYQARNIRDLTVEDIYIGNGVSELIVQSMQALLNLGDEMLVPAPDYPLWTAAVSLSSGKAIHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 16202 - protein, 280 aa, Triticum aestivum
  misc_feature (193)..(193): Xaa can be any naturally occurring amino acid
  misc_feature (230)..(230): Xaa can be any naturally occurring amino acid
  misc_feature (253)..(253): Xaa can be any naturally occurring amino acid
  unsure (1)..(280): unsure at all Xaa locations
MHPTRWELSHMVDLQAAALVISSGRPGRSGILQYDGELKLPSKYLVSPPLIERTSGEYLVKNGVRTFACSETVKFGHVTFFWNGNRSGYFDETREEYVEIPSDSGITFNEQPKMKAPEIAERTRDAILSGKFDQVRINLPNGDMVGHTGDIEATVVACKAADEAVKMVLDAVEQVGDIYLVTADHGNAEDMVXRNKAGQPMLDKSGSIQILTSHTLQPVPVAIGGPGLHXGVRSGSDIQTPGLRNVCGTVMNXHGLQALADYRRPSSNRRQVKKHALFEA

SEQ ID NO: 16203 - protein, 548 aa, Aspergillus nidulans FGSC A4
MSYCHGQVIVRLEIDWDELDKTRNGALLRTHRESPFNSHPNYKDRQTLEVCYNKSHSAPLIVEIMAASARDIKTGKDTLSLNVSQSQSFSTSPNASFQSAPSSHSGSAFATRLGPIINAKHLKPFATEDIKVLLLENVNQTGRDILSKQGYQVEFLKSSLPEDELIEKIRDVHVIGIRSKTKLTERVLKEARNLIVIGCFCIGTNQVDLQYAAEHGIAVFNSPFSNSRSVAELVICEIIALARQLGDRSNEMHNGTWNKTPTPAHDQTDSFLKGIIGYGHIGSQLSVLAEAMGMSVIFYDVVNLMELGTARQVSTLDDLLSEADFITCHVPELPETKNMLGPRQFELMKDGSYLINASRGTVVDIPALIHAMRSGKIAGAALDVYPNEPAGNGDYFNNELNSWGTDLRSLKNLILTPHIGGSTEEAQRAIGVEVAEALVRYVNEGSTLGAVNLPEVTLRSLTMDEPDHARVIYIHHNVPGVLRKVNEILGDHNVDKQMTDSRGDVRHFITLPLVAYLMADISNVDNATIKDLYERLESLSCIETPSPI

SEQ ID NO: 16204 - protein, 363 aa, Triticum aestivum
MFVFCLCTRCRICRVSSFPVLLLFMFIHLSYFFLVLLLILGQFFFTRYEKYHGYYGGKEESRKSNYTDMVNKYYDLATSFYEYGWGESFHFAHRWNGESLRESIKRHEHFLALQLELKPGMKVLDVGCGIGGPLREIARFSSTSVTGLNNNDYQITRGKALNRSVGLGATCDFVKADFMKMPFSDNTFDAVYAIEATCHAPDPVGCYKEIYRVLKPGQCFAVYEWCITDHYDPNNATHKRIKDEIELGNGLPDIRSTRQCLQAVKDAGFEVIWDKDLAEDSPLPWYLPLDPSRFSLSSFRLTTVGRIITRNMVKVLEYVGLAPEGSQRVSSFLEKAAEGLVEGGKKEIFTPVYFFVVRKPLSE

SEQ ID NO: 16205 - protein, 223 aa, Idiomarina loihiensis L2TR
MSGNADALKKAAAEAAMQYIEDGTVVGVGTGSTVNFFIDALAERKHDIEGAVSSSEASTERLKSHGIEVFELNSVVEVPIYVDGADEITEHGQMVKGGGGALTREKIIAAVARKFVCVADESKMVGRLGQFPVPVEVIPMARSYVAREIVKLGGDPVWRQGFTTDNGNWILDVHNFDIMEPMKLEAELNNIVGVVTNGLFAQRGADIALIAREDGVQTLKVSG

SEQ ID NO: 16206 - protein, 408 aa, Idiomarina loihiensis L2TR
MQISLAKDKIKVLLLEGVHESAIQLFRHHGYHNLEILQTSLSEDELCEKIKDAHILGIRSRSQLNDRVFAAAEKLIAVGCFCIGTNQVDLEAAKKHGVIVFNAPFSNTRSVAELVLAEIIMLLRGIPEKNAVAHEGGWLKSAKQSYEARGKILGIVGYGHIGSQLSVLAEQLGMHIRYFDIEDKLPMGNAQSVATLDDLLAQSDIITLHVPENEQTQWMIGRRQIERMKPGSLLINASRGTVVDIDALAEALSSRHLAGAAIDVFPVEPKGNSDEFLSPLRGLKNCLLTPHIGGSTLEAQENIGVEVAGKLVRYSDNGSTLSAVNFPEVSLPTHATAQRLLHIHKNQPGMLNAINRIISDNEINVVGQYLQTDENVGYVVMDIDSDNGADVLQQLKDIPGTIRARRLF

SEQ ID NO: 16207 - protein, 347 aa, Bradyrhizobium sp. BTAi1
MAREWPMEQSPTLQAHLALQNADADCAAVIEALADAARELARQIAIAPLAGFDEGAATVNADGDVQKALDIVADNLMRDALRKAPVAGILSEEVDRPETVNAAAPLCVAIDPLDGSSNLQNNISVGTIFSIRPRGRDVLSSFFEPGTAQRAAGFFVYGPQTCLVLAIDHRVDLYVLHPTLREFVLARSGLRIPQDTPEFAINASNRRHWSGTVRNYVDECLAGAAGPRGRDFNMRWIASLVAEAYRILMRGGVFLYPADSRPGYREGRLRLVYEAHPMALIMEWAGGSASSGRSRILELSARSPHQRAPLIMGDVRLVRDVDQLHEGVEPLFETSDAPLFARRGLFR

SEQ ID NO: 16208 - protein, 559 aa, Oryza sativa
MGSSDFSWTLPDHPKLPKGKPVAVVVLDGWGEADADQYNCIHVAETPTMDSLKKGAPEKWKLVKAHGTAVGLPSDDDMGNSEVGHNALGAGRIFAQGAKLVDTALASGKIFEGEGFKYIKESFDQGTLHLIGLLSDGGVHSRLDQLQLLLNGASANGAKKIRVHILTDGRDVLDGTSVGFVETLENDLSQLRAKGIDACIASGGGRMYVTMDRYENDWDVVKRGWDAQVLGEAPHKFQNAVEAVKTLRSETKANDQYLPPFVIVDDSDKAVGPIVDGDAVVTFNFRADRMVMIAKALEYEDFDKFDRVRVPKIRYAGMLQYDGELKLPSHYLVSPPEIERTSGEYLVKNGIRTFACSETVKFGHVTFFWNGNRSGYFDETKEEYVEIPSDSGITFNVKPKMKALEIAEKARDAILSGKFDQVRVNLPNGDMVGHTGDIEATVVACKAADEAVKMILDAIEQVGGIYLVTADHGNAEDMVKRNKSGQPQLDKKGEIQILTSHTLQPVPVAIGGPGLHSGVRFRNDVQTPGLANVAATVMNLHGFEAPADYEPTLIEVVDK

SEQ ID NO: 16209 - protein, 168 aa, Avena clauda
VMASSATSVAPFQGLKSTAGLAVSRRSNAGLGSVSNGGRIRCMQVWPIEGIKKFETLSYLPPLSEEALLKQIDFLIRSKWVPCLEFSKVGFIFRVHGSTPGYYDGRYWTMWKLPMFGCTDASQVIKEVEEVKKEYPDAYVRIIGFDNIRQVQCVSFIAFKPPGCEESG

SEQ ID NO: 16210 - protein, 949 aa, Rhodococcus fascians
TDRMTSTASAFVDRHVGPDTTELARILDAIGVDSLDELARKAVPESILDTVVDGVPDGLATLPPALSEHDALAALADLAGCNTVATSMIGLGYYDTLTPPVLTRGILENPAWYTAYTPYQPEISQGRLEALLNFQTMVSDLTGMDVANASMLDESTAAAESMTLMRRANRGSKSPRLVVDSDIFPQTKAVLATRAEPLGIELVYADLADGLPEGDFFGVLAQLPGASGRLVDHTATIEAAHERGALVAVGVDLLAATLVTAPGEIGADVCFGTTQRFGVPMGYGGPHAGYLAVRSGHSRQLPGRLVGVSVDADGHRAYRLALQTREQHIRREKATSNICTAQVLLAIVAAMYASYHGADGLRAIARRVNTRARTVAAGLQAAGIDVVHAEFFDTVLAAVPGAAHTVVDAAKQRGINLRPVDDDHVAIACDEATTEAHIVDVLAAFGAEPAGPGAESVPADCARTSEYLTHPAFTRYRTETAMLRYLRALSDKDIALDRSMIPLGSCTMKLNATAEMESITWPQFARQHPFAPSTDVPGLLRVIADLEQWLVDITGYDAVSLQPNAGSQGEYAGLLAIRRYHQANGDTGRTVCLIPSSAHGTNAASAVMVGMRVVVVACRPNGDVDVDDLRAKIAEHADTLAAIMITYPSTHGVYEHEISDICAAVHDAGGQVYVDGANLNALVGLARPGRFGGDVSHLNLHKTFCIPHGGGGPGVGPIGVRSHLQPYLPGHPLAPQLGDGPTVAGAPYGSASILTITWAYIAMMGAQGLRRATLTAIASANYIARRLDEYFPVLYTGDNGMVAHECILDLRGLTKDTGVTVDDVAKRLADYGFHAPTMSFPVPGTLMVEPTESENLEEIDAFCDAMISIRREIDRVGSGEWTVEDNPLRGAPHTAQCLVADWNHPYSRELAAYPAGYDRPKVWPAVRRIDGAHGDRNLVCSCPPIEAFA

SEQ ID NO: 16211 - protein, 274 aa, Onion yellows phytoplasma OY-M
MNYKPRTKVIAGNWKMYKCKDEALEFIQKVSLQVPDQTQVQTLIFPQLTLLDSLAQLQGTNLQVGAQNMFYESEGAFTGEVSPQNLLSLGVKHVLLGHSERRTFFGETDQTVNLKLLSALKHKLVPTVCVGESLLTKENNQTQVFLDQQLTNIFAGVPEEALQNIIIAYEPVWAIGTGKSATPQDANKVIEQIRDKVTALYSSQASCAMRIIYGGSVSVANIKTILEQPAIDGILAGKASLQTEDFLFFAQIASKQALASTKDIFQKNDCPFCC

SEQ ID NO: 16212 - protein, 326 aa, Mannheimia succiniciproducens MBEL55E
MIMKVVISHRLHDNGMKVLEDANAQVAITNDGNPKIMLPELLDAEGLIIRIGSIDRETMLQAKNLKVIGRPGVGVDDVDVKTATELGIPVVIAPGSNTRSVAEHAFALMFACAKDIVRSDNEMRKGNFAIRSSYKAYELNHKTLALIGYGRIGSILAQMSKAIGMNVKVYDPFVKQGTIEQEGYIYCTELDDVIRDSHVISIHVPLTNETRNLIGEHEFSLMNEHTILINCARGEVIDEPVLTKVLQEGKIHSAGLDVFACEPVDINSPLFQLDNVIVSPHMAGQTKEAASGVATMAAEGVVAVINGEKWPYVCNPEAYNHPRWNK

SEQ ID NO: 16213 - protein, 193 aa, Arabidopsis thaliana
  misc_feature (29)..(29): Xaa can be any naturally occurring amino acid
  misc_feature (53)..(53): Xaa can be any naturally occurring amino acid
  misc_feature (76)..(76): Xaa can be any naturally occurring amino acid
  misc_feature (115)..(115): Xaa can be any naturally occurring amino acid
  misc_feature (131)..(131): Xaa can be any naturally occurring amino acid
  misc_feature (146)..(146): Xaa can be any naturally occurring amino acid
  misc_feature (151)..(151): Xaa can be any naturally occurring amino acid
  unsure (1)..(193): unsure at all Xaa locations
KTITVASSMVSSATMVASPAEATMVAPFXGLMSSVAFSATRKVNNEITSITTXNRRANCMQEWPPIVKKKFETLSXYLPDLTESELLNEVEYLIRNNCIPCVEFKLEHFFVYASXHGNSPVYYDGRHLNNXNLPLFSSTESDQVLXTVIEXNNRHPNGFITIIEIELMRQAESIIFIVYEPSSFTGEILSAFA

SEQ ID NO: 16214 - protein, 176 aa, Arabidopsis thaliana
  misc_feature (118)..(118): Xaa can be any naturally occurring amino acid
  misc_feature (125)..(125): Xaa can be any naturally occurring amino acid
  misc_feature (127)..(127): Xaa can be any naturally occurring amino acid
  misc_feature (135)..(135): Xaa can be any naturally occurring amino acid
  misc_feature (143)..(145): Xaa can be any naturally occurring amino acid
  misc_feature (149)..(149): Xaa can be any naturally occurring amino acid
  misc_feature (156)..(158): Xaa can be any naturally occurring amino acid
  misc_feature (163)..(164): Xaa can be any naturally occurring amino acid
  misc_feature (167)..(168): Xaa can be any naturally occurring amino acid
  misc_feature (170)..(173): Xaa can be any naturally occurring amino acid
  unsure (1)..(176): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYXGRYWTMXKXPLFGCTDXAQVLKGSXXXKKGXPGGFIRXXXWQKPXXQWXXLXXXXPQV

SEQ ID NO: 16215 - protein, 441 aa, Carboxydothermus hydrogenoformans Z-2901
MEEILEIIDLTEEGLGVGKKEKRVYFVSGDVTVGDVVKVKVTSEKRGVILGEALEILTNSPYRDVPRCPHFGYCGGCSLQNLDYEQQLVLKKTKVYNIMKKIGRIDAPINSVLPNFAFYRYRQKVHFTFGSSQNKLAIGYFDRKNNWFPVTDCLIADKSLVEVAHYVTEILDAFKLKAYFNDAGVLRHLVVRKSSTTGEIQVVITAVKLNFNVKEIAAKILLNPEIQSLTFHENPKKTREVFGKGTAVTFGTRYITEELLGISYRLTPLSFFQINPVQAEKIYRIALDYLDLGKTDMVFDGYSGVGSLTLPAARIAASVVGVEEIRDAVEVAKTNAKLNGIANVNFFAGKVEEKLPWLLKKGYRFNKIILDPPREGVKKEVLEEIIKLNPERIVYVSCNPATQARDLKILAETGYYPVEITPVDMFSQTMHVENVVLLKKK

SEQ ID NO: 16216 - protein, 325 aa, Solibacter usitatus Ellin6076
MTITLGATSTADDVLSGVNLHGKRILVTGVSAGIGVETARALAAHGAHVVGAARDLAKAEAATAQVQKDAAANGGGFELTALDLADLKSVRACADGLIAKGEPFDVVIANAGVMATPFGHTADGFETQFGTNHLGHFVLINRIASLIRTGGRLVNLSSAGHRISNVDVEDPNFERTPYDPMIAYGRSKTANILFAVAFDQRHRSRGVRATAVHPGAIQTELGRYMERAQLESMIDRINQQLAAEGKGPFEWKTIPQGAATSVWAGVLAPADEIGGRYCANCQVGRIVRGDAVITAAGEGVREYALDPHNAAALWKKSEELVGESY

SEQ ID NO: 16217 - protein, 279 aa, Bacillus cereus ATCC 10987
MSIQNISFLGAGSIAEAIIGGLLHANVVKGEQITVSNRSNETRLQELHNKYGVKGTHNKKELLTNTNILFLAMKPKDVAEALTPFKEDIHNNLLIISLLAGVSTHSIRSLLQKDVPIIRAMPNTSAAILKSATAISPSKHATKEHIQTAIALFETIGLVSVVEEEDMHAVTALSGSGPAYIYYVVEAMEEAATKIGLKEDVAKSLILQTMIGAAEMLKASEKHPSILRKEITSPGGTTEAGIEVLQEHQFQQALISCITQAAQRSHNLGKTLEQLTKEK

SEQ ID NO: 16218 - protein, 556 aa, Candida albicans SC5314
MSDINKSLSSNSKSKSTHLFVLIHGLWGTSSHMATIEKFIKENLPSSTDDKIATIKPACFRFWKTYDGLELNAKKIIADIFYEIESLKQNNDLEVTKISIIGYSLGGLISRYVIGLLNELDFFEKIEPIFFSTFATPHVGIQFFNDNIFDAVANRLGPYLFGKSGGQLFIADHDKILVKMADPQEKYMRGLKKFQKHILLANIKNDRTVAFFTSFITDVSPFEELDNIKIVYLDNLPQAKIANKLVRPKFVDLTKSHRLSLKDKKIFLGNQQEETPFIRKNRWAKILVIALLACLVVPFWVPFVLISSTTVSIYSFIKIKFVKGPLSPQHWSRVKKFVYGNAPIDPDDAKVGNVQRLKRRTLDRHESFKGDTSYLTEDTMDRVLYAEERYLNKSRKAGSIKNEDDEDALVAENTDYNTDSDGVDESSEADTLKSNFKSIEMDIEQNDKVISESIETLKSYESFPLFQDHKYKLPLNEDKSFIVKNLNTLDWIKIPVFLDVWNAHDGIVSRRGAKTNPKGASTIGLWVSILRNHLQENGRADASVNGNQESTIAHTS

SEQ ID NO: 16219 - protein, 168 aa, Arabidopsis thaliana
MLLGFGNSDLAQDREECTNQLIELSTCIPYVGGDAKAPTKDCCAGFGQVIRKSEKCVCILVRDKDDPQLGIKINATLAAHLPSACHITAPNITDCISILHLPRNSTLAKEFENLGRIEDNYNSTSPTQIHKDGTGGGKAEPVKSNGWKEKSWLGVELLIYLLVSLIFF

SEQ ID NO: 16220 - protein, 166 aa, Glycine max
  misc_feature (54)..(54): Xaa can be any naturally occurring amino acid
  misc_feature (68)..(68): Xaa can be any naturally occurring amino acid
  misc_feature (106)..(106): Xaa can be any naturally occurring amino acid
  misc_feature (134)..(134): Xaa can be any naturally occurring amino acid
  unsure (1)..(166): unsure at all Xaa locations
MRTKKKEVAYSMISCPVVTTRQRAHGDRYWTVPFTGLKSMAGFPTRKTNNDITXIASNGGRVQCMQVXWPPIGKKKIETLSYLPDLDDAQLAKEVEYLIRKGWIPXLEFELEHGFEYREHNGSPGYYQGLYWTXWKLPMSGCTDASQVLKEHQEAKTAYPNGFIRI

SEQ ID NO: 16221 - protein, 288 aa, Cystobacter fuscus
MSEVQYTAEGVGRYYDAMAQFYQTVWGDSIHMGFWPDPTDATVSMSQAQKNFTDLMISHMGLQPGQRALDVGCGTGRPAIQLARATHTHVTAISISQSQIATATGYARESGVAPRAQVQGTDDAPSVRFELADAMAMPFRDGTFDAAWAFESIFHMPSRLQVFREMARVVRPGGRVVVADFVTLRPLTPEERAIAYPAFAANDLASLEDYIRDLKQVGLTNINCRDVTANTFRPSNRATARELQTEAAQAHLRNAYGHEQADSFRNGWVHIEKVNETLGYVLIQADKP

SEQ ID NO: 16222 - protein, 244 aa, Burkholderia xenovorans LB400
MSVSTMSFATFPAPSTIADSAFLDLPLLDADAVPPRIAAALQAMREGRAVVLQDDHDRENEADLIVSAERLSVETMALLIRECSGIVCLCLPDEKIRALELPPMAVNNESRHGTAFTVSIEAREGVTTGVSALDRVTTIRAAIADTAKPADIVRPGHVFPLRAQPGGVLARRGHTEGTVDLAILAGLKPAGVLCELMNPDGTMTRGADVERFAAQHNLPMLTIAELVEFRQALAQARECVADEA

SEQ ID NO: 16223 - protein, 433 aa, Prochlorococcus marinus subsp. pastoris str. CCMP1986
MTDILKTTYSEEVFSSALELMPGGVSSPVRAFKSVGGQPIVFDRVKGPYAWDIDGNRYIDYIGSWGPAICGHAHPEVITALQEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPSGPVYQAGTLSGNPLAMTAGIKTLELLKQEGTYEKLESTTSRLIEGIIQSAENNGIAINGGSVSAMFGFFLCEGPVRNFEEAKTNNSELFGKLHREMLKRGVYLAPSPFEAGFTSLAHSEEEIDRTLEAFDQSFSVIKN

SEQ ID NO: 16224 - protein, 463 aa, Lactobacillus sakei subsp. sakei 23K
MSKHSLFAKKKIDASQFKNGLLERNLTAVGLTAMGVGAVVGAGIFITPGIIAAKYAGPGAMLSYLLAAVVCALAALCYSEFASTIPLAGSAYTYVYTVFGELVAWILGWALVSEYLFAVASVAVSWSAYFQNLMAGFGLHLPTALSAAWEPGKPAGVNLIAGIVVLIVGFLLSNGMRESTRINTIMVGVKIAVIVIFLGVAVFYVKPANFQPFLPYGASGVLSGAALAFYAYIGFDAVSTASEEVINPQRDMPIGIIASLLIASLLYAAVATVLVGVVHYTKLNVGDPVAFALQLMHQNWVAGIISLGAVAGMTTVLLVMTYGGTRLIFAMSRDGLLPAVFAKINPKTHVPVANTWIFAVVTSIVAALVPLDKIAELVNIGTLFAFATVSLGVIFLRRIPNYNELPQGFKVPLYPIVPILSCILCVLLMTQLQITTWIVFVIWLVIGLVIYFSYSYHHSQQRM

SEQ ID NO: 16225 - protein, 430 aa, Bacillus clausii KSM-K16
MGNWTKSIEAFKEAQPLMPGGVNSPVRAFKSVGMNPVYMKEGKGAKIKDIDGNEYIDYVLSWGPLILGHANDVVVEELKKATELGTSFGAPHEYETRLAKLVIERVPSIDVVRMVNSGTEATMSALRLARGYTGRNKILKFVGCYHGHGDSLLIKAGSGVATLGLPDSPGVPESVAQNTLTVHYNDVESVRYVFETFGDDLAAVIVEPVAGNMGVVPPEPGFLETLRTWTEENGTLLIFDEVMTGFRVGYTCAQGEFGVTPDLTCLGKVIGGGLPVGAFGGKREIMEQIAPSGPIYQAGTLSGNPLAMTAGYYTLSQLTKADYSEFARKAERLEAGLSAAAKQHGIPHSINRAGSMIGLFFTDERVYNFEKAQTSDLDLFAAYFRGMLAEGISLAPSQFEGLFLSTAHSNEDIEATIAAAERVFQAIATK

SEQ ID NO: 16226 - protein, 279 aa, Bacillus cereus ATCC 14579
MKNLQSKAVLNNGVEMPWFGLGVFKVEEGPELVEAVKSAIKAGYRSIDTAAIYGNEKAVGEGIRAGIEATGIAREELFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 16227 - protein, 515 aa, Paenibacillus polymyxa
MLTMFASSAMAEQDMNGHKPPNSAGSGVFYEIYINSFYDSNGDGHGDLKGITQKLDYLNDGNPRSGKDLQVSGLWLMPLNPSPSYHKYDVTDYYQVDPQYGNLNDFRTLTKEAKRKGVKVIIDLVINHSSSEHPWFKEASANPQSKYHDYYVWADENTNLDEKGSWGQQVWHKNPNGEGYFYGTFWSGMPDLNFDNPKVRKEMIKVGKYWLQQGADGFRLDAAMHIFKGQTKDGADKNITWWNEFRSEMEKINPNVYLAGEVWDKPETIAPYYESLHSLFNFDLGGTILNSVKNGRDQGIATFSEKTLKLYKSYNKAALDAPFLSNHDQTRVMSELGGDVRKAKLAASILLTLPGQPFLYYGEEIGMKGEKPDEYLREPMRWYKGEGLGQTKWEEPKYNKGEVSVEAQLRDNDSLLESYRTLIRLREEHEALRSDSLEPIQAGSASVTAYERSSGKETLYVYHNLSGEPVTIQMKDRDKEKRKVVFSTSKDAKVRKETVTIPAYSSLITQEDRKS

SEQ ID NO: 16228 - protein, 472 aa, Arabidopsis thaliana
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 16229 - protein, 392 aa, Legionella pneumophila str. Lens
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQQELKELGEVLKKHPQILIATDDMYEHILWSQAFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 16230 - protein, 170 aa, Zea mays
  misc_feature (25)..(25): Xaa can be any naturally occurring amino acid
  unsure (1)..(170): unsure at all Xaa locations
MAPTVMMASSATAVAPFQGLKSAAXLPVARRSTRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 16231 - protein, 1112 aa, Geobacter metallireducens GS-15
MARREPLRGGNPLWYRDAIIYQLHVKAFADSDGDGMGDFRGLMGKLDYLQSLGITAIWILPFYPSPLRDDGYDIADYYSVNPSYNTLREFREFLRAAHARRIRVITELVLNHTSDQHPWFQRARRAKPGSAHRDYYVWSDNPDRYQGTRIIFQDFETSNWSWDPVAKAYYWHRFYSHQPDLNYDNPKVQAEMLRVIDYWLGMGVDGVRLDAVPYLFEREGTNCENLPETHAFLKKLRAHVDASFPNRMLLGEANQWPEDAIAYFGEGDECNMLFHFPLMPRMYMAIEMEDRFPVIDIIDQTPAIPEGCQWAIFLRNHDELTLEMVTDEERDYMYRIYAADPKARINLGIRRRLAPLMERDRRKIELMNALLFSLPGTPIIYYGDEIGMGDNYYLGDRNGVRTPMQWSPDRNAGFSGANPQRLYLPVIIDPEYHYEAVNVEIQERNPTSLLWWMRRTIAVRRRHRAFSSGTLEMLYPANHRVLAFLRRHEDEVILVVGNLSRFAQAVSLDLKEFAGISPADLFSRNRFPVIREIPYPLTLGPHDHFWFILSRAESPRLPEGELPRINLPGGLPWWEALQHTGGDTRLERATTDYLNRSGWFRGKARAIIGYALRDTVLLRTSDQVFPLFFLEVRYQNGAPETYLIPVAFLRGPGAKRVDAESPQAAIASLSVGDEAGILCDALHDREFRDALLALALGRRRLHGKRESLVVPLHGRGGHAEGMRETEHLISELVTGEEASSVILYGDRHVFKLYRTVEPGVNSEVELVRFLTEKSRYPNIVPFQASLELRHPGTEPCTIGLVQEYVKNQGNGWRLALHLLGQYFERILSRRGEIPPPPKRFSSLIDGSACTVPEPVANLIGGFYLEMAGLLGRRTAELHLALAAGGNDPAWKPEAYSTIYQRSVYQSMRNQARRTLQLLSQNRNLLPIDDQGPADRVLGAEKEILSWLAQIVGRRIGTMKIRIHGNFHLGKVLFTGKDFVILDFEGEPDRTLSERRIKRSPLRDVASMIRSFHAATLTALARHGNGRSGDVQLLEPWADACYYHVSCRYLAGYLERMGNSPLVPADRNDLATLLRSFLLDRALRDLGFALGNRPETASSPLKGIETVLREYGE

SEQ ID NO: 16232 - protein, 336 aa, Candidatus Pelagibacter ubique HTCC1002
MSELNKIALKILSNGKGILAADESNGTMTKRLESVNVPSSPGNRLLFRETLFSSSGMKDFIGGVILYDETINQTSNSKQTIPELISKSGAVPGIKVDTGAKILAGSIEEKITEGLDGLRERLKDYYKLGARFTKWRGVFNISDKYPSKLSMHSNAHALARYSALVQECGMVPIVEPEVLMDGDHSAETCFNKTSEVIKRCFEELMINKIDLSGIILKPNMILAGTTADKKISSEEVAKLTLKCLKENVPTDVPGIAFLSGGQTEVEATENLNLINKYNDTNFIMTYSYGRALQQSALKFWSKDINNTSGTQKIFNHRANMCTLAAQGKWSKELEAE

SEQ ID NO: 16233 - protein, 389 aa, Ralstonia metallidurans CH34
MAESNLAPLNPPPSRLPNVGTTIFTVMSALAAEKNAVNLGQGFPDFDCDPRIVDAVTHAMRTGHNQYPPMAGVPQLRQAIAAKIAKLYEHTYDWNTEITVTAGATQGLLTAILCAVHPGDEVIVLEPCYDSYLPAIELAGATAVPVTLEAPLFRIPFDKLAAAITPRTRMIMINTPHNPTGTIWREEDMQQLADLLAGTDILLLSDEVYEHMVYDGQQHESVARHPELARRSFVVSSFGKTYHVTGWKVGFVAAPAALSNEFRKVHQFNVFTVNTPVQYGLADYMADPAPYLNLSAFYQAKRDYFRAGLAGTRFKLLPSDGTYFQCVDYSAISDMSEADFSMWLTREIGVAAIPVSAFYSTPRESGVVRFCFAKKEETLKLALDRLAKL

SEQ ID NO: 16234 - protein, 313 aa, Parvularcula bermudensis HTCC2503
MADKQFGSDGFTAEHLPDLTGKTFAITGANSGIGLEAARYLGGRNATVLMLCRNASKAESARNALRQSAPGGKYETISLDLADFSTLSPATDAIRQATDRLDGLILNAGVMMLPRRQITKDGFEMQYQVNVLSHFALAAALADLVETASGRFVWLSSIAHHYAKHPKLTDLGYAAGYSPTSSYAKSKLADLMLGLELHRRLSAAGKSAGSYIAHPGYSDTNLQSAGPGAILGTLIKPFTMIFSQPAEKGALPTVLAAAYPKAQPGVLYGPTGFQEMKGPVGEAAIKPWAKDPQVAKQLWSVCEEATGREWSMA

SEQ ID NO: 16235 - protein, 486 aa, Vibrio cholerae O1 biovar eltor str. N16961
MCKTKIVATLGPASQTRETLTQLIQAGVNVVRLNFSHGSAEEHIARAEMVREIAQQLNVSVGVLVDLQGPKIRIACFAEGAIQLSAGDTFILDGHLDGQAGTQERVGLDYPELIDDLNVGNILLLDDGRIQLEVTAVDMQARLVHTIALNSGKLSNRKGINLLGGGLSAPALTEKDKLDIITAAELQADFLAVSFPRNAEDIEYARQLATQAGCHAHIVAKVERAEVVASEEAMDSVIRASDVIMVARGDLGVEIGDARLPSVQKALIARAKHLGKPVITATQMMESMIENPLPTRAEVLDVANAVIDGTDAIMLSAESAAGRYPVETVQAMVRIAQGVEHETHCAQNCWDALQHLCSDAGKSFALSSMISASKVNKDLGVAIVTEQGETPLLMSRCQSQATIWAVSDKPALLRKLAILRGVTPTYFPHLDKQGDIATQLIHLLRKPAQEKKIASILVTQLESVEGVGHVNVCRLLNLAQQEALFA

SEQ ID NO: 16236 - protein, 331 aa, Glycine max
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 16237 - protein, 128 aa, Arabidopsis thaliana
MSWAAPDDIFFSTSLAPYLDKKLLVLLRDGRKLMGLLRSFDQFANAVLEEAYERVIVGDLYCDIPLGLYIIRGENVVLIGELDVEKEELPAHMLQVPEAEIKRAQKAEKEEMLLKGTMRKRMEFLDLD

SEQ ID NO: 16238 - protein, 426 aa, Yersinia pestis biovar Medievalis str. 91001
MSKSENLYAQAQQLIPGGVNSPVRAFTGVGGIPLFIERADGAYLFDVDGKAYIDYVGSWGPMILGHNHPAIRQAVIEAVERGLSFGAPTEMEVKMAQLVTDLVPTMDMVRMVNSGTEATMSAIRLARGYTGRDKIIKFEGCYHGHADCLLVKAGSGALTLGQPNSPGVPTDFAKHTLTCTYNDLASVRQAFEQYPQEVACIIVEPVAGNMNCIPPLPEFLPGLRALCDEFGALLIIDEVMTGFRVALAGAQDYYHVIPDLTCLGKIIGGGMPVGAFGGRREVMNALAPTGPVYQAGTLSGNPIAMAAGFACLTEISQVGVYETLTELTDSLATGLRHAAKEENIPLVVNHVGGMFGLFFTNADTVTCYQDVMNCDVERFKRFFHLMLEEGVYLAPSAFEAGFMSLAHSNEDIQKTVNAARRCFAKL

SEQ ID NO: 16239 - protein, 291 aa, Pleurotus ostreatus
MLTVLFTASLLTASSLAGPISEAGRSLRGLVDSPALFPRGNECSASGNLPTSCGNTTAVENLCCFEHPGGLLLQTQFWDTEPANGPADSWTIHGLWPDKCDGTYDSFCDPSRDYKDISQVLNSNDASDTLNFMKEYWLDRDGDHDKFWKHEWSKHGTCMSTIKPTCLSDTEHGADAAAYFDTTVKLFKDLPTHKWLADAGILPTDNQTFTYDALAEALKKGKGVSPRIDCKDQTLKEVVWYFNVKGSAMAGEFIPIDAPEGKKGSCPKDNIKYTPKSTKAKGKKPKKGKKN

SEQ ID NO: 16240 - protein, 469 aa, Yarrowia lipolytica CLIB122
MPEIRSNLPTTATSLNDGFTLPITKRNYNRQYAPIYYMRLHQLMSQVLDAATSKWADKNVKYLNKCLDVLVGDTVFVVGTLFKDMKYKPSMLEEVTRSHWGAPPGKKPKYVDPQGDCEDGGHKDDSSIQLEDSSGRITLVGPKVQEFMLITGVVCGVLGTAGENGRFTVVDVVWGGFPEQIYRPLSGVNDGEDVEMADNDTPEDTYICLASGLYIGQKKTDYKHVLLAEYLQGLLEEDGAKDGLVKPKNISRFIMAGNNCSLESERPVIDTLSRTVDLDAFKPMARVDEYIAQLLPSISVDIMAGNDDPGNMSLPQQPLHLSMFPQSRKFKKATFGSVSNPYWWDFSTDEAPLKVLGTSGQNVSDIYKYLIEGRDDILDIMEHTLAWRHLCPTAPDTLTCYPYGDDDPFIIKETPHLYFCGNQDEFQTSVVKHDGVSVRLVAVPRFDETGEVVLVNMRTLKAEVLRIVA

SEQ ID NO: 16241 - protein, 403 aa, Ralstonia solanacearum
MHAMLSSKVSTLAPSPIQLMAARTREAREAGRDVVDLTLGEPDFATPEHICEAARRAIADGLTKYTPISGLARLREAVARKFRDENGIECTAAETLVGCGGKQVIYQAFVATIDPGDEVLIPAPYWSSYADIVTLCGGIVKPLPTTPESGYALQPQTLAAGISARTKWLVLNAPSNPSGTAYTAAQLEAFAEVLRRSGNPRLLILADDIYEHIVFDGLRFASFTAVAPDLRHRTLTVNGVSKAYAMTGWRVGYGCGPKPLIDAMANVQMQVNSHTASISQAAAIAALEGPQDELARRRAIFEQRRDSLLSRLGGIAGLRTPRPQGAFYLFPDAQAFIGRRTPEGCAIDDDQALAAYLLDSGVAVVPGSGFGMPGCLRLSYATSEARLELAATRLAGALRRLGD

SEQ ID NO: 16242 - protein, 255 aa, Lactobacillus sakei subsp. sakei 23K
MVADQLEAALINRGLAKPKRLEIHNLVTSTNQLAKQYLLNASVMPDVIIANQQSAGYGRLKRKFYSPQQTGIYMSLLLPDIPLNEEATLLTPLSAVAVVRAIRTICQIETQIKWVNDIYYEGRKVVGILAESIPNHGIVIGIGIDFKNDGQLKQLVEKAGVLLPNTSPITRNQLISQILLEFDCLLPVYRQKAFMAEYREASLLISKKIVVRLNEEKILTGYVQDITNNGELVIQTEKQRLQIIRAGEVERVLSW

SEQ ID NO: 16243 - protein, 96 aa, Zea mays
  misc_feature (35)..(35): Xaa can be any naturally occurring amino acid
  misc_feature (44)..(44): Xaa can be any naturally occurring amino acid
  misc_feature (70)..(70): Xaa can be any naturally occurring amino acid
  unsure (1)..(96): unsure at all Xaa locations
MGVHQEDVGAAITSDLKPYNLVETDTSGRCGRELXIEVVLGQGXGKRLLKRHRMGNTSAGRVTWLEIHAXSIIEVLTPHQALSIAQPEPAADKPQA

SEQ ID NO: 16244 - protein, 347 aa, Bacillus subtilis subsp. subtilis str. 168
MQSGKMKALMKKDGAFGAVLTEVPIPEIDKHEVLIKVKAASICGTDVHIYNWDQWARQRIKTPYVFGHEFSGIVEGVGENVSSVKVGEYVSAETHIVCGECVPCLTGKSHVCTNTAIIGVDTAGCFAEYVKVPADNIWRNPADMDPSIASIQEPLGNAVHTVLESQPAGGTTAVIGCGPIGLMAVAVAKAAGASQVIAIDKNEYRLRLAKQMGATCTVSIEKEDPLKIVSALTSGEGADLVCEMSGHPSAIAQGLAMAANGGRFHILSLPEHPVTIDLTNKVVFKGLTIQGITGRKMFSTWRQVSQLISSNMIDLAPVITHQFPLEEFEKGFELMRSGQCGKVILIP

SEQ ID NO: 16245 - protein, 138 aa, Gossypium hirsutum
  misc_feature (106)..(106): Xaa can be any naturally occurring amino acid
  unsure (1)..(138): unsure at all Xaa locations
GAKTNFKDYKKFPFKKLYLSKGKEIQTNLQIMSSAAATTTKGGRGKSKAKAVSRSSKAGLQFPVGRVARFLKKGRYAERVGSGSPVYLSAVLEYLAAEVLELAGNXARDNKKNRIIPRHIQLAVRNDEELSKLLGGVT

SEQ ID NO: 16246 - protein, 227 aa, Halobacterium sp. NRC-1
MLCLPSDHVVGDGFQETAETAVDVAARTDGLVTIGIEPDRPATGYGYIEPGDDHGDHSEVAVFREKPDAETASRLVDRGCLWNAGMFAWTPTAFLDAARSGPLDPLVDALATDADPATAFERVDPVSVDYAVLERAADVRVVPAAFDWDDLGAWNALGRLLDGENAVLGDATTIDATGNVLASDDKHVSVVGVDDLVVAAYDDRVLVVPRADAQRVRDVVAALDAPF

SEQ ID NO: 16247 - protein, 165 aa, Capsicum annuum
MASQREENVYMAKLAEQAERYEEMVEFMEKVVAALDGGDELTVEERNLLSVAYKNVIGARRASWRIISSIEQKEESRGNEDHVTSIKNYRSKIEIELTSICNGILKLLDSKLIGSAATGDSKVFYLKMKGDYYRYLAEFKTGAERKEAAENTLSLISLLRILLMP

SEQ ID NO: 16248 - protein, 312 aa, Solibacter usitatus Ellin6076
MTRICIPDDAPAVLAPSPVFPALQARAQLDYYDTLPGTEDLLIERLREAEVALNIRSSSRFTERVFAACPKLRMVSIWGTGTDHVDLAAAARHGVTVANTPGVAARSIAEHTLALLFAVARQIPHMDAATRRGAWERGQSMELYGKTCGVIGYGAVGRHFARLATAIGMRVMQWTLHPSAYPDVEFASLEDLYRASDVISVHLRLSPDTQDFIAAPQFALMKSEAILLNTARGAIVSEPALLDALIAGNLAAAGLDVFTTEPLPPNHPLTTLPNVVLTPHCAGITPEALHAGLQLAVDNIWAKCIRPPGQST

SEQ ID NO: 16249 - protein, 233 aa, Brassica napus
  misc_feature (98)..(98): Xaa can be any naturally occurring amino acid
  misc_feature (125)..(125): Xaa can be any naturally occurring amino acid
  misc_feature (147)..(147): Xaa can be any naturally occurring amino acid
  misc_feature (182)..(182): Xaa can be any naturally occurring amino acid
  misc_feature (194)..(194): Xaa can be any naturally occurring amino acid
  misc_feature (205)..(206): Xaa can be any naturally occurring amino acid
  unsure (1)..(233): unsure at all Xaa locations
MASASFVKLNALSSPRISHRSFAHPSASPPPRVSFAIRAGAYSDELVKTAKTIASPGRGILAIDESNATCGKRLASIGLDNTEENRQAYRQLLLTTPXLGDYISGAILFEETLYQSTKDGKKFLXLLERCQDRSPGIKVDKGLVPFXGSNEESWCQGLDGLASRSAEYYKQGARFAQWRTVXSIPCGPSALAVXEAAWGLARYAXXAISSGQPGCGPILGVQRILFGWGTPPH

SEQ ID NO: 16250 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 16251 - protein, 349 aa, Zea mays
MGKIKIGINGFGRIGRLVARVALQSEDVELVAVNDPFITTDYMTYMFKYDTVHGQWKHSDIALKDSKTLLFGEKPVTVFGISCELVFEPLRVYRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 16252 - protein, 540 aa, Zea mays
  misc_feature (336)..(336): Xaa can be any naturally occurring amino acid
  unsure (1)..(540): unsure at all Xaa locations
MGVISTVLGFFGFGFGLSAGIVIGYFFFIYVQPTDVKDVKVRPLVEYDSKSLEGILPEIPLWVKNPDYDRIDWLNRFLELMWPYLNKAICRTAQDIAKPIIAENTAKYNIDTVEFETLTLGSLPPTFQGMKVYITEEQELIMEPSLKWAANPNITVVVKAYGLKATIQIVDLQVFASPRITLKPLVPTFPCFAKILVSLMEKPHVDFGLKLLGADVMAIPGLYIFVQETIKEQVASMYLWPKTLEVPIMDPSKASKRPVGILLVKVVRAQNLRKKDLLGKSDPYVKLKMSDDKLPSKKTTVKRSNLNPEWGEDFKFVVTDPENQALEVNVFDWEQXVGKHEKMGMNMIPLRELLPEGTKVTTLNLLKTMDPNDVQNEKSRGELTLELTYKPFKEEDIEKEDTQGADVIEKAPDGTPAGGGLLYVVVHEAQDLEGKHHTNPYAKIIFKGEEKKTKVIKKNRDPRWEDEFEFVCEEPPVNDKLHVEVISKAPKAGLIHGKETLGYIDISLADVISNKRINEKYHLIDSKNGQIQIELQWRTS

SEQ ID NO: 16253 - protein, 233 aa, Oenococcus oeni PSU-1
MDAELQNKLKKEAARKAASYVKNGMVVGLGSGSTVKMLVDELGRRVKEEDLQFTGVATSIFTAQQAKSLGIKIVDLDMVDSIDLTIDGADQVDSNFNGIKGGGGNLLWEKIVAINSKKIVWVVDKSKVVDTIGAFPLAVDVIPFGSQHVMQNFDKAGYEPVLRLDKEGKPFKTDSNNLIIDLHLHKIEEPTQLADNLIQTVGVVEHGLFLNMVSEVVVGKEGQPEILVNPNIG

SEQ ID NO: 16254 - protein, 409 aa, Oryza sativa (japonica cultivar-group)
MALHAAPPPPPPFTAGRLPTTSRRPCFSAGRIFRCSLPAAAARPRNAAFLAPLRTSSAARSGSQALPKGWDTAAGVVEIDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 16255 - protein, 603 aa, Erwinia carotovora subsp. atroseptica SCRI1043
MESSALLTAGVLFLFVAVVAVPIAARLGIGAVLGYLIAGIAIGPWGLGFIRDVEAILHFSELGVVFLMFIIGLELNPGKLWTLRRSIFGVGAAQVGLSALILGGALYLTDFSWQSALIGGVGLAMSSTAMALQLMREKGMNRNESGQLGFSVLLFQDLAVIPALALIPILAGVQGDFGDWERIGLKVAAFLGMLIGGRYLVRPLFRFIAASGVREVFTAAALLLVLGSALFMEALGLSMALGTFIAGILLAESEYRHELEIAIEPFKGLLLGLFFISVGMALNLGILYTHIVKIMIAVLVLVAVKGAVLYFLARINRMRRSERLQFAGVLSQGGEFAFVLFSAAASFNVLKGEQLPLLLVTVTLSMMTTPLLMQVIDRVLARRYNVQDVPDEKPYVEDDEPQVIVVGFGRFGQVISRLLMANKMRITVLERDISAVSLMRSYGYKVYYGDATELELLRSAGADKARSIVITCNAPEDTMEIVHLCQQHFPNLEILARARGRVEAHELLQTGVRHFSRETFSSALELGRKTLVTLGMHPHQAMRAQQHFRRLDMRMLRELMPQLTGDVAQISRVKEARRELEDIFQREMLRERRRPSVWDEDDE

SEQ ID NO: 16256 - protein, 174 aa, Oryza sativa
FFFFFLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSDETGTLRISSTSRAATSELHNVILIVCILARKLHIAGDVDLVCMMISSSC

SEQ ID NO: 16257 - protein, 582 aa, Oryza sativa (japonica cultivar-group)
MAASQRQSRLFRSPSTSRDPSTSRISTPRRRRCCRGGGGGSSSLPSPAMSVMPSIRRLLLAGAAVAVVVVSCAVVCAEASVHEYAGERFAGVGNGFVLHGGSEGVYASATAESFVRFEKVAFRRTPEAASVAEEDGNRTVTVAAVIFEAGDRDAVGAVSDVVGGERALCCTPGMARRGGCTEGAVVYRAPASSNATGRWPKVLAASFLPGSLVAAFPDETVAVARTGMYSLHFVHCDASLAAGQVVAAEGKTIWKNSRGYLPGRMAPLKPFYGAMSLAFAALAALWFARYARFWREVSPLQNFATAAIALGMVEVTTWYLDLAEFDASGVRPAGTTFWAATSGAVRAAACRVLALLVAMGYGVTRPALGCGNARVAALGAAFLAAAEVLDVGDNVGIVSDHSPARRLFFILPVAALNTVFIYWIFTSLSRTISKLKARRMTAKLEMYRKFANSLTIAVALSLGWITFEVHFKTTDEHNERWRVAWVIPAVWELISFFLLCTICILWTPSQNSMRFAYSREECEDDTEHNDEDDDVEDTRPLIRAGPLSYVDNWACYVTQDAKIILRTDSGVYAKAGEEYKRV

SEQ ID NO: 16258 - protein, 361 aa, Mycobacterium avium subsp. paratuberculosis K-10
MSQTVRGVISRKKGEPVELVDIVVPDPGPGEALVDVIACGVCHTDLTYREGGINDEYPFLLGHEAAGRVEAVGPDVTAVQPGDFVVLNWRAVCGQCRACKRGRPHLCFDTFNATQKMTLTDGTELTPALGIGAFADKTLVAAGQCTKVDPAADPAVAGLLGCGVMAGLGAAINTGAVARDDTVAVIGCGGVGNAAIAGAALVGARRIIAVDTDDTKLDWARGFGATHTVNARQADVVAAIQDLTDGFGANVVIDAVGRPETWKQAFYARDLAGTVVLVGVPTPDMTLEMPLVDFFSHGGSLKSSWYGDCLPERDFPTLIELYLQGRLPLEKFVSERIGLGDVEAAFHNMHDGKVLRSVVML

SEQ ID NO: 16259 - protein, 501 aa, Xylella fastidiosa 9a5c
MLLWLASVKEAFFMSERQRRTRILATLGPATDPPGVLDALFKAGVNVVRLNFSHGDASDQARRAAEVRAAAAHVGVEIGILADLPGPKIRIGRFTEGKVRLVADARFDLLADSNAPLGDATQVGVSYLGLPQDVAAGDVLLLDDGLMQLQVVQVQGARIVTTVLNDGVLSDRKGLNKQGGGLSLGALTDRDRELIGIVSRMGVDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGGVSGLWEL

SEQ ID NO: 16260 - protein, 334 aa, Xylella fastidiosa 9a5c
MSIEQLAETAQAMVASGKGIIAIDESAGTIAKRFSSVGIENIEENRRAYRELLLTTPKLSDYISGAILFDETIRQSTKAGVPFPKYMADHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQLDPLPWPLSFSYGRAMQQAALKLWSQDMKGNFAKAQQVVYERAKENGLAALGKWKG

SEQ ID NO: 16261 - protein, 338 aa, Prochlorococcus marinus subsp. pastoris str. CCMP1986
MIEKNNLFDLKKDIDLIGLGNAIVDIIVNVDDEFLEINTLKKGSMNLINSNESEALLKNCTVIKKISGGSSANTVVCLAELDNNVQFIGRVKNDNFGNFFSTDIKRSNTIFNTPPIDKGPSSAHSIIFITPDAQRTMCTYLGASIEFEPKDVNYKLIANSKYLYLEGYLWDSDLAKNAFLQAAKLAKESDTKIILSLSDSFCVDRHRESFLELIENYIDIVFCNESEVLSLFQENDLQRCQESISSICELVIITLGSKGSLVVNKDKSEEIKPKLLGKIIDTTGAGDLYAGGFIHGLINNYSLKKCGEIGSICAGQIITQLGSRSNINLQNLLRKHLI

SEQ ID NO: 16262 - protein, 477 aa, Medicago truncatula
MTEVLQFPSPSSCSSSPFNDVSHSQHHQTNSSPFNNSDNETVMTHYQIQQQQQQQQQSEDEEEEEKDQLSILTLLIATFRKSLIGCTNTGSELSSSMEIGWPSNVRHVAHVTFDRFHGFLGLPVEFEPEVPTRPPSASTSVFGVSTESMQLSFDARGNSVPTILLLMQRHLYAQGGLQAEGIFRINAENSQEEFVREQLNRGVVPNGIDVHCLAGLIKAWFRELPTGILDPLSPEQVMQSQTEEECAQLVRLLPATESALLDWAVNLMADVAQMEHLNKMNARNIAMVFAPNMTHMVDPLTALMYAVQVMNFLKTLVAMTLKEREESITKSNPSSNLNSFDDDGHQSDSPLLFKDESEYGNDYSDEDTVFVTAEPSQQSPTHLFKDDCETESGSKSLQTSTENFIPSGNRLLVDSCPCGVVSQICSMAIGDQTKNCKSLQLNTSDTDKCSAGSVEKNRGIALIGRINSRSELAEAWR

SEQ ID NO: 16263 - protein, 265 aa, Bacillus cereus ATCC 14579
MYENNVKDTKDFYNDIGHISWSVAPSQHYHVGIFELEKDSMEDAQNRTVEYMARKVAASDLDVLLDIGCGSGLTAVQISKKENCKIVGINISEKQLAIGKKLISKEKINSRVKLMNMDAHQLNFKSGMFDGAYALESIMHMNREKVLSEVHRVLKNGAPFSLCDWYVKKSLTPVEKRFLETITLGKYITKEQYFSLYQTQNFMDIEIEEWSNKILPTYKYWTTITDEMKEKLPDHLLYVIEENSKVLSDIAIEKLGYLQVNGIKR

SEQ ID NO: 16264 - protein, 514 aa, Triticum aestivum
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGVASVIKICTVK

SEQ ID NO: 16265 - protein, 422 aa, Rickettsia conorii str. Malish 7
MSSCDLIAGSRKNTKDWTPWSSELGDSRKNTMTNNTKTITLNIGPQHPATHGVLRLILEMDGEVVNNADPHIGLLHRGTEKLIEHKTYLQAIPYFDRLDYVSPMCQEHAFALAVESLLECEVPRRAQFIRVLFSELTRILNHTLNIGSQALDIGATTPLLWLFEEREKIMEFYEHVSGSRMHSNYFRPGGVAADLPEGLLEDIDKFIEQFPPKLHDIESLLNENRLWKQRLVDIGVASQKEAMDWGFSGPMLRGSGIAWDLRKSNPYDVYDEMDFKVPIGKNGDCYDRYFVRMLEMYESIKIIKQCIEKMPKGAIKTDDPKLTPPTRAKMKESMEAMIHHFKLYTEGYDVPAGETYKAVEAPKGEFGVYLYSQGGNRPYRCRIKAPGFAHLQGLDFMSKGHLMADVITIIATLDIVFGEIDR

SEQ ID NO: 16266 - protein, 454 aa, Haemophilus influenzae R2866
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVADALKVVRS

SEQ ID NO: 16267 - protein, 216 aa, Legionella pneumophila str. Lens
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFITDNGNIILDVFNLNFSTPMALEDSLNVIPGVVENGVFAKRLADKVLVASASGVNNLK

SEQ ID NO: 16268 - protein, 264 aa, Brassica napus
RFLWLCWSSGDIHGQYQDLLRLFEYGGYPPSANFLFLGDYVDRGKQSLETICLLLAYKIRYPSKIYLLRGNHEDAKINRIYGFYDECKRRFNVRLWKIFTDCFNCLPVAALIDDKILCMHGGLSPELDNLNQIREIQRPTEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPALASSSGHPLKKVPKMGKS

SEQ ID NO: 16269 - protein, 423 aa, Corynebacterium ammoniagenes
MNAPLNSAVRLDSIEEAIADIAAGKAVVVVDNEDRENEGDLIFAAELATPELVAFMVRYSSGYICVPLLPEDCKRLNLPPMMGRNEDVRGTAYTVTVDANTGTTGISATSRAETMLRLADPMSVVDDFTRPGHVVPLAARPNGVLERDGHTEAAIDLARLAGLRPAGVLCEIVSEEDPTTMARSEELRRFSDEHDLKMISIEQLIEWRRHNETQVRRTVETQLPTDFGSFTALGYKHEIDGQEHVALIAGGVEELNGAEDVFVRVHSECLTGDVFHSRRCDCGQQLHQSMEIIQEAGQGIIIYLRGHEGRGIGLLAKLKAYSLQDSGLDTVDANLEQGLPEDAREYSVAGQILRDLGIKSANLLTNNPHKGEGLRGFGVEASAHTPVEIEPNADNIDYLRTKRDRMNHDLPQVARWDAAHALK

SEQ ID NO: 16270 - protein, 312 aa, Saccharomyces cerevisiae
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQAGGRKKK

SEQ ID NO: 16271 - protein, 931 aa, Mesorhizobium sp. BNC1
MTATFSTRHIGPRSDETKAMLAFLGLPSLETLISQAVPKSIRLDRPLNLPEAASEAEALAELQAYMRENKVLKSFIGAGYHGCHVPPVIQRNLFENPAWYTAYTPYQSEISQGRLEMLFHFQTLVTELTGLPVASASLLDEASAVAEAVGIAWRHHKSKRNRIVIAGALNPQTRDVVETRAEPLGIEIATNIELDGDTFALIVPWGDTYGAYEDHSALIGEAKAKDAIVIFVADPLGLLLSDTPAALGAEIAVGPMQRFGVPMGFGGPHAAYCAVSDRLTRLMPGRLVGQSVDAHGRPGYRLALQTREQHIRRDKATSNICTAQALLANMAAAYAIWHGPEGLKAIATHVHGLAARLHAGLKAAGLELAGEKIFDTVTVTVPGKAAAIAAEAEKTGSLLRVIDADRVGITFDEISTEADLESIAKLFGITVPAAAPAIAPSQPRGEHFLTQPVFHEHRSETEMMRFLRRLSDKDLALDRAMIPLGSCTMKLNAAAEMMPVSWPEVNGLHPFAPDAHTVGYRRMVGELEGWLAEITGFDAVSLQPNAGSQGEYAGLLAIRRYFRERGEDHRDVCLIPSSAHGTNPASAAMAGMRVVVVRCLEQGDIDPEDLKAKAEEHSSRLAALMITYPSTHGVFEEGVRDMCALIHEHGGQVYLDGANLNALVGLARPGDLGADVCHMNLHKTFCIPHGGGGPGIGPIGVKAHLQPFLPGHVELGSAHAVAAAPFGSASILPITWMYIRMMGAAGLKRATEMAILNANYIAGRLEAYYPVLYRGRNGRVAHECILDTRVFKERAGIGVEDIAKRLIDYGFHAPTMSWPVAGTLMVEPTESEPKSELDRFCDAMISIAGEAGRVEKGEWPKDDNPLVNAPHTAAELMADTWSHPYSRAEAAFPSGSMDWAAKYWPPVSRVDNVAGDRNLVCACPPIEALAS

SEQ ID NO: 16272 - protein, 993 aa, Xylella fastidiosa 9a5c
MFSVSHFCSGSLMMSHTLSSLRDLEYQGAFVERHIGPNDVEIAQMLRVVGYDSLESLTDAIVPEKIRSTVALDLPKGITEEEALAKIRVIANKNRVFRSFIGQGYYGTHTPKVILRNVLENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDAVAIHCAAAAAGMNLRMIDNAQLGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPAVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDSLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRPLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKEDSEIQHLIEEDASRC

SEQ ID NO: 16273 - protein, 472 aa, Desulfovibrio vulgaris subsp. vulgaris str. Hildenborough
MNAQSPACHAIILAGGSGTRLWPISRSLFPKQLIALNGDLTLLQETLKRALTHFRPDHIHVVTNEEHVFEVRAQARTLDPRLEAGVIAEPRGRNTLPAILLGLDAAWRATGGETPPTIAVFPSDHMLGDIPRWQAALDEATRLADDGWFVTFGVPPTHPETGYGYIRRGDSIADRSFEVEGFVEKPDHATATAYLKDGRYFWNSGMFVFNGQSLIEAVHAHQSDLGHWWESRGDRPLIEGYTSIPSISVDYGIMEHASRIAVVEADFGWDDLGSWEALYRLGKKDESGCVRRGDTMALDCENSMLFSRGGKLVGIGLKDIVAVQTRDATLVCALDKTQRVKDVVELLKAESSSLAEVHLTVHRPWGSYTVLEEGKLFKIKRITVLPGARLSLQMHHHRSEHWVVVSGAALVQVGETETLLTENQWAVIPRGAMHRLSNPGKIPLELIEVQSGPYLEEDDIVRFEDVYGRKPK

SEQ ID NO: 16274 - protein, 396 aa, Mesorhizobium sp. BNC1
MAETSIRNFNINFGPQHPAAHGVLRLVLELDGEVVERVDPHIGLLHRGTEKLIEYKTYLQAIPYFDRLDYVAPMNQEHAFALAIERLLGIDVPIRGQLIRVLYSEISRILNHLLNITTQAMDVGALTPPLWGFEEREKLMVFYERASGARMHAAYFRPGGVHQDLPEKLVEDIGKWIDPFLKTVDDLDELLTENRIFKQRNADIGIVSLEDAWAWGFSGVMVRGSGAAWDLRKSQPYECYPEMDFDIPVGKNGDCYDRYLIRMEEMRQSAKIMRQCVERLLGKERVGPVSNMDGKVVPPKRAAMKRSMESLIHHFKLYTEGYHVPAGEVYAAVEAPKGEFGVYLVADGTNKPYRCKLRAPGFAHLQAMDFMCRGHLLADVTAVLGSLDIVFGEVDR

SEQ ID NO: 16275 - protein, 375 aa, Arabidopsis thaliana
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPEKETLTSSLRRIYLCHPLGNENVMILLDIIKMVDLYLNRMVQAMLSLRPNFECDAFRITSIGDRKVPRDFFSSSSKIPQVDGPMPDPYDEMLSTPNIYSYQGPSEEFNEARTPAPNEYQTSTPVAVQNDIIEDDEELLNEDDDDDELDDLESGEDMNTQHLVLAQFDKVTRTKSRWKCSLKDGIMHINDKDILFNKAAGEFDF

SEQ ID NO: 16276 - protein, 393 aa, Solanum tuberosum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGVAEYQKLITRNPIFLERVEGVGIIGRDEAVNWGLSGPMLRASGIEWDLRKVDHYESYDEFDWQVQWQREGDSLARYLVRIGEMTESIKIIQQALEGIPGGPYENLEMRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 16277 - protein, 129 aa, Brassica napus
  misc_feature (32)..(32): Xaa can be any naturally occurring amino acid
  unsure (1)..(129): unsure at all Xaa locations
RTSGEYLTHNGVSTFACSETVKFGSGYFNEKXEQYVEIPSDSGISFNVKPKMKALEIAEKARDAILSGKFDQVRVNLPNSDMVGHTGDIDATVVACEAADVAVKMILDAIEQVKGIYVVTADHGNAEDM

SEQ ID NO: 16278 - protein, 502 aa, Nitrosomonas europaea ATCC 19718
MPDDPAENCHFPSDQTNTYMKHTLIPVILSGGSGTRLWPLSRQQYPKQLLPLVNRYSLLQETVRRLDGLEDIAVQSSIIVSNEEYRFVIAEQLRVLGKIGKIILEPYGRNTAPALTIAALAAMQDSDDPVLLVMPSDHVITDISVFQAIIHKGMTLAESGMLVTFGITPNAPETGYGYIQYGTALHEPGTFRIARFVEKPDLATAQNYLEEGSYLWNSGMFMMRASIWLTAIDTCRRDILEACRAAWQSGSIDGDFYRIDKTAFAACPSDSIDYAVMETLSARPDMLPPGAIIPLSAGWSDIGAWDALWRTLQKDESGNVVRGDVLLHACHDTLAFSEHRLVACIGVENVVIVETSDAVLVAHQDKTQEVKHIVDILKQRNRPEIRSHRKIYRPWGWYDSVDRGERFQVKRIVVNPGAALSLQMHHHRAEHWIVVRGTAQVTRADKTFLVSENESTFIPLGTPHRLENPGRVPLEMIEVQSGSYLGEDDIVRFEDKYGRKEN

SEQ ID NO: 16279 - protein, 371 aa, Aquifex aeolicus
MIKEFSDPLYGFVRVGEAGLRLIDSFPFQRLRYVKQLGLAYLVFPSAQHTRFEHSLGVYHITERICESLKVKEKELVKLAGLLHDLGHPPFSHTTEVLLPRERSHEDFTERVIKETEIYEILKQDYSHEDIERLVRITLGKPEDEEEKLLSEIITGEFGSDRMDYLRRDAYFCGVSYGFFDYDRLISTLRVYENKVVVDESGLRALENFLISRYFMYVQVYFHKVVRILSIHLVEFLKKLISQEDFTDINNFLRLNDAFVISELFKRKAFREDFERIFQRKHFKTLLSTENYEKFSETKERLLEKFPQEKVRFDEVEKEVYGGNIYVLSSEGLKKAHELSPLIASLKPIKLYRIYVDRQLWEKARSELKLS

SEQ ID NO: 16280 - protein, 288 aa, Kineococcus radiotolerans SRS30216
MTPAPPPTPSPAPPLRGRTVVVTGASSGIGAAAARRFARAGARVVPVGRDPERTRALAAELGVEPLLVDAARLDDVRRLAGDLLERCDRIDVLANNAGGSSARRTETPDGHETTFQVNHLAPFLLTALLRERIEATPGARVVTTSSAANLLGRVDLDDLDSRRGRYRGFRVYATTKLENVLFTRALSRRLGGTATASCFHPGVVATRFARDSVVAGVLYRTPLRRVLAVTPEEGAEPLWRLAVRPDPETVDGAYLDRLAPGRVNRQADDVELAEQLWVRSAQLVGVPA

SEQ ID NO: 16281 - protein, 954 aa, Bordetella bronchiseptica RB50
MSRAPDTHSDFIPRHIGPSDEDQATMLAAIGAASLDALIDEVVPPRIRSRAPLALPAARSETDVLQDLKRMAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMSCRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLLLETGVATPAILAAADCARINLRQVDGARLAVSLDETVTLADLQALVNVFAAGLGKDEVALPAPQASLDGIPAAVRRQGPILSHPVFSSVQSETDMLRYLRKLADKDLALDRTMIPLGSCTMKLNATAEMIPITWPEFALIHPFAPASQTPGYRELIDGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDAQGRLDPEAKVGPVSAAPYGSAGILPIPYVYIALMGAEGLRRATEVAILNANYIAARLRDHYPVLYAGRNGRVAHECILDVRPLKETSGISAEDIAKRLMDYGFHAPTMSFPVAGTLMVEPTESEGLAELERFIEAMIAIRAEIAQIESGERDRDDNVLRNAPHTAQMLLAEEWHHDYPRQQAAYPVASLRENKYWPPVARVDNAYGDRNLVCACLPVEAYA

SEQ ID NO: 16282 - protein, 245 aa, Xylella fastidiosa Ann-1
MEIATVTRVNSTQPANACAPSHIPIIIDNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 16283 - protein, 501 aa, Glycine max
MATRVVAEQKPKTKIVCTLGPASRSVPMIEKLLRAGMNVARFNFSHGSHEYHQETLDNLRAAMENTGILCAVMLDTKGPEIRTGFLKDSKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 16284 - protein, 171 aa, Rhizobium tropici
NSLVMSHSLHVAVQGLEDVAVIASEDAVYVGHLKDSQEVGKLVKLLASEKKTAKLTETHPTSYRPWGGYTSVLNGERFQVKRIFVLPGKKLSLQKHHHRSEHWIVVKGTAEVTVGENVQMLRENESIYIPLGEVHRLANPGKILLELIEVQTGSYLGEDDIIRLVDEFGRS

SEQ ID NO: 16285 - protein, 526 aa, Aspergillus oryzae
MAASSSLDHLSNRMKLEWHSKLNTEMVPAKNFRRTSIIGTIGPKTNSVEKINALRRSGLNVVRMNFSHGSYEYHQSVIDNAREAARVQTGRPLAIALDTKGPEIRTGNTTDDKDIPIKEGHELNITTDEKYANASDDQNMYLDYKNITNVIAPGKLIYVDDGILSFQVLEVVDDKTLRVKCLNNGNISSRKGVNLPGTDVDLPALSEKDISDLKFGVKNGVDMIFASFIRRGSDIRHIRDVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGSYPCEAVKMMSETCLLAEVAIPHFNVFDELRNLAPRPTDTVESIAMAAVSASLELNAGAIVVLTTSGNTARLLSKYRPVCPILMVTRNPRASRYSHLYRGVWPFLFPENKPDFNVKIWQEDVDRRLKWAISHGIKLGIINKGDNIVCVQGWRGGQGHTNTVRVVPAEENLGLIE

SEQ ID NO: 16286 - protein, 479 aa, Desulfitobacterium hafniense Y51
MKKEIRESLFIDGEWQEAINKEVKGVINPATGKVFCEIGYGEVDDALSAVDAADRAFGAWSKTSVRERADILNRTADLLRQRADHIGLILAAESGKPLPQAVGEVKFSAEYFQWFAEEIRRPYGQSIPSDAANKRHHVYTQPAGVALCLSPWNFPVSIQARKLAPALAAGCTVVARGSEVAPLSLIELFQCLQDAGIPKGVANLIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIYEAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 16287 - protein, 534 aa, Staphylococcus aureus subsp. aureus Mu50
MKQFNVLVADPISKDGIKALLDHEQFNVDIQTGLSEEALIKIIPSYHALIVRSQTTVTENIINAADSLKVIARAGVGVDNININAATLKGILVINAPDGNTISATEHSLAMLLSMARNIPQAHQSLTNKEWNRNAFKGTELYHKTLGVIGAGRIGLGVAKRAQSFGMKILAFDPYLTDEKAKSLSITKATVDEIAQHSDFVTLHTPLTPKTKGLINADFFAKAKPSLQIINVARGGIIDEKALIKALDEGQISRAAIDVFEHEPATDSPLVAHDKIIVTPHLGASTVEAQEKVAISVSNEIIEILIDGTVTHAVNAPKMDLSNIDDTVKSFINLSQTVGELAIQLMYNAPSSIKITYGGDLASIDSSLLTRTIITHILKDDLGPEVNIINALMLLNQQQVTLNIENNKAETGFSNYLEVELSNDSDSVKVGASVFTGFGPRIVRINNFSVDLKPNQYQIVSYHNDTPGMVGKTGALLGKYNINIASMTLGRTEAGGDALMILSVDQPVSNNIIDELKQVGEYNQIFTTELTVQS

SEQ ID NO: 16288 - protein, 287 aa, Listeria monocytogenes str. 1/2a F6854
MTIQWFPGHMAKARREVTEKLKLVDVIFELVDARIPLSSSNPMLEEIIHQKRRVIILNKADTADEKTTKEWIDYFAEKGLPAVAVNAQEGKGLFKIEQAAEKLMAEKFDRLRSKGMKPRAIRAMILGIPNVGKSTLINRLAKKNIARTGNKPGVTKAQQWIKVGKTLELLDTPGILWPKFEDQEIGYKLALTGAIKDDLLQMEEIAGYGLRFLENHYPDRLQTWLKVETVSEDPIETLAFIAEKRGLLDRYNDPDYSRAAETVVREIRQQKLGRMSFDFPNWEDEVE

SEQ ID NO: 16289 - protein, 678 aa, marine gamma proteobacterium HTCC2207
MKKVLIIVQARMGSSRLPGKVLKKINGATVIEILLSRLAKIKSDKQIVVATSTRPENDILEQHLKYLGIPCERGSENDVLGRFHQVSMKYSSDAIIRITGDCPLIDPDLIDDMISRYFTENVDYLSNTMPPSYPDGLDAEIFSSDSLSLANENATDSFDREHVTPYIRNSNDFKSSAFTFYEDLSNLRWTLDEPQDFDVIKRVFDHFHPNLFFNWMEVLDYQRTNPEAFKSNSMINRNEGSDLCSGQKLYKRAKTVIPGGNMLLSKRPEMFLPNLWPSYFSKASGCTVWDLDGKQYTDMSVMGVGTNILGYGHAEVDDAVVGAVKTGNMSTLNCPEEVYLAEKLVEMHPWADMVKFARSGGEANAVAIRIARAASGRDKVAVCGYHGWHDWYLAANLNKDSNVGLDGHLLPGLEPKGVPETLRGTVYTFRYNDFDELERLVNQENIGVIKMEVVRNLGPKDDFLSKVRQLATEKNIVLIFDECTSGFRETYGGIHKKYGVEPDIAMFGKALGNGYAISAVVGRKEVMESAQSTFISSTFWTEKIGPTAALKTLEVMHRERSWEKITSAGLKIRTGIESIAKTHHLKIENSGIPALTGYSFLSENALFYKTLITQEMLKKGYLAGTSTYVSVSHDSEIIDGYLNCLDPIFALISECENGRDVRSLLDGEVCHSGFKRLN

SEQ ID NO: 16290 - protein, 665 aa, Rubrivivax gelatinosus PM1
MASSLELALLYLVAAVLSVAACRSLKLPPMLGYLAAGVLIGPNALALARDSVGVQYLAEFGVVFLMFVIGLEFNLPKLRSMRTLVFGLGLSQVSLTIAATVAGNALLAWVFSMAGKSWGLGWQSAIALGAALAMSSTAIVVKMMAERIELETPHGRRVMGVLLFQDLAVVPLLVLIPALGESAGDMTRALLFAGLKAAVLLTLLLVGGQRVMRWWLTLVARGRSEELFILNLLLVTLGLAWLTEHAGLSLALGAFIAGMLIAETEYKHQVETDIRPFHDVLLGLFFITIGMKLDWRAIWDQWMVVAAMTVLPVLFKFGLVTLLARVFGAPAGVALRTGLYLAQAGEFGFVLLALATQSQLLPERLQSPVLASMVLSMLATPLLIVYSNRIVMRLAASDWLLQSVALTSIATKSIHAEAHVIICGYGRSGQNLAQLLSTEQIPYVALDLDPDRVRQAAAAGQNVVFGDAARLQSLMAAGLARATAVVISYHDTPSALKILRLVREHAPTVPVIVRTLDDSDLEPLQAAGATEVVPEAIEGSLMMASHVLALVGVPMRRVIRLVQDQRDARYGLLRGYFHGADDDTVEELQQRRLQSVTLSESSASLGRTIVEQALTELQVQVVSLRRAHGNVVHPDDALVLAAGDTLVLSGRPETLARAEARLLRG

SEQ ID NO: 16291 - protein, 426 aa, Thermoplasma acidophilum
MDTISKENAPMACQGNAPGPEGSNDTLDSRCWRGAGVRGNRGYLTGRPDRTGCVWLLIGMNSKIIQDPVHGPIRASDAILEMIDTPEFQRLRYIKNLGLCYLVFPSANHSRFEHSIGTFHLAGMYLDHLGIKSEETAMAALLHDVGHFPFSHTIEDFYRKNRGVDHLEEGIKIIRGERESNIPSILEKYSIDVKKVVSILEGRENVLSEIVSGPIDADELDYLRRDSFYCGVSIGFVNPARVISVSGIYDGRMIIEEKGLSDIESLLISRFLMYQAVYFHKTCRIANRMLERAAIMSEAYDTYRLSDQEFTHLLMSDPRSEDMMRNILDRRLMKVLYKVKYDESLAHDILNAVSEKFIVDIIPPLSFRGKDRLKTQVGVLLENRIATGEESSPLVNALNSAIDRRYIYVYGYHEDERDLKRDLAGI

SEQ ID NO: 16292 - protein, 131 aa, Arabidopsis thaliana
  misc_feature (47)..(47): Xaa can be any naturally occurring amino acid
  unsure (1)..(131): unsure at all Xaa locations
GILSSGPDQRVRKKQEEVWVSFLSSSTVGVTSRVKATMVVPLTGWKXSVFFRATRRANNDITSITGNGGGVSCMKGGPPIGKKKLGTLFYLPDLRDVEWAKEVDYLFRTRGIPGVEFKWKHGFVYRKHGNT

SEQ ID NO: 16293 - protein, 119 aa, Musa acuminata
ESLKKTLKETRKDIPIKPKQAPLGKPLKSSGVLLDEKAEFEEVEPEEEDSEGEEPSFWKSNPKLPKMIRMANLCVVGGHGVNGVAEIHSEIVKQDVFNSFYKLWPEKFQNKTNGVTPRR

SEQ ID NO: 16294 - protein, 423 aa, Xylella fastidiosa Ann-1
MVWGAVRWADVWWMLRSMGRYSDAHSVDFAFFYVLTRDKSFMQVTSKLPQVGTTIFSVMSQLEDVYGAVNLGQGFPDFPVPLRLQEALEGAVREGHNQYPPMIGVAVLRQGIAVKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALATLLDGTDILLISDEVYEHIVFDGCGHESVLRWPQLRARAFVISSFGKTYHCTGWKIGYAIAPPALSAEFRKVHQYNTFTSFGPAQYAFAAMLHEEPGYVDQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 16295 - protein, 598 aa, Glycine max
MGKKQNEIQKTGLGRALVKQHNQMIQQSKDKSRFYRKKFLESFTEVSDIDAVVEQSLEPLPELAAAASTTLISLEPGSVPDETTTPEEARKQQKQEEALHASSLRVPRRPPWTPDMSADELNASETQAFLTWRRSLARLEENKKLVLTPFEKNLDIWRQLWRVVERSDLLVMVVDSRDPLFYRCPDLEAYAREVDEHKRTLLLVNKADLLPVSIREKWAEYFRAHDILFIFWSAKAATAALEGKKLGSSWEDDNMGRTNSPDTKIYGRDELLARLQSEAEEIVDRRRNSGSSDAGPSNIKSPAENTAGSSSSSNVIVGFVGYPNVGKSSTINALVGQKRTGVTSTPGKTKHFQTLIISDELILCDCPGLVFPSFSSSRYEMIACGVLPIDRLSEHRESVQVVADRVPRHVIEEIYKIRLPKPKSYESQSRPPLASELLRAYCTSRGYVASSGLPDETRAARLMLKDYTDGKLPHYQMPPGASDEEQALEEPAGHDLVDLDASDSSGTEESSDDKSELAPNLEHVLDDLNSFDMANGLAPKNTTTVKKPKASHKHHHKKPQRKKDRSWRAGKAGNEDADGMPVARFFQKPANTGPMKVG

SEQ ID NO: 16296 - protein, 410 aa, Triticum aestivum
AYLGDTIEQVCTKKQAGTGPEFPGYRRPTRPDESRENEGDLILAASLVTPEAMAFIVRHSTGIVCVSMKENDLERLNLPLMVSTKENEEKLCTAFTITVDAKEGTTTGVSAKDRAKTVMTLASPYSKPEDFNRPGHIFPLKYRDGGVLKRAGHTEASVDLAVLAGLPPVGVLCEIVDEDGSMARLPKLRLFAEKNNLKIVSIADLIRYRRKRDRLIERASVARIPLRWGNVRAYCYRSVIDGIEHIAMVKGEIGDGQDILVRVHSECLTGDIFGSARCDCGDQLAMSMERIEKAGRGVLVYLRGHEGRGIGLGHKLRAYNLQDDGRDTVEANEELGLPVDSREYGIGAQILRDLGVRSMKLMTNNPAKYVGLKGYGLSIVGRVPLVTPITTENQRYLETKRTKMGHVYSN

SEQ ID NO: 16297 - protein, 504 aa, Flavobacteria bacterium BBFL7
MNKKTILMILDGWGITQDPKVSAIAQAQTPFIDSLYDQYPHATLRTDGEHVGLPEGQMGNSEVGHMNLGAGRIVYQDLAKINKAIKEDTLKDEQVLVDALAFAKANSKKVHFLGLLSDGGVHAHIDHLKALLDVAESHEIEDVFIHAFTDGRDVDPKSGASHVANLEKHISGTNAQLATVTGRYFAMDRDQRWERVKKAYDVIVHGMGQPSHDATDSIKEFYNQGVTDEFIEPIVVLNGTEPVATVEDGDVIIFFNYRTDRGRELTQMLSQQDYHEQNTHALDLYYVTMTKYDDSYNNVKVIFEKDNLKNTLGEVLADAGKTQIRIAETEKYPHVTFFFNGGQEKPFKGEQRIMCNSPKVATYDLQPEMSIDCVSSSIIPEINRQVADFICLNFANPDMVGHTGSMEAAVKACEAVDQAAHDVITAAMEQDYTIIVIADHGNCEVMLNPDGSVNTAHTTNPVPIILVDKDLKEVKDGILGDIAPTILKLIGVKQPEEMTQNSLL

SEQ ID NO: 16298 - protein, 336 aa, Desulfitobacterium hafniense Y51
MSVRVAINGFGRIGRLTLRAILKQSLPVEVVAINDLGNPDLLAHLFKYDSLHGILPNSVEIDGNTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSIIPTTTGAAQAVTLVIPELAGKMNGLAVRVPTPNVSLVDFVANLTKSTTKEEVNAALRESAEGKLKGYLEYTELPLVSRDFNGNSASSIVDGLSTMMIGERMVKVLAWYDNEWGYSNRIVDLVKLIVMKGL

SEQ ID NO: 16299 - protein, 509 aa, Arabidopsis thaliana
MMDSALYHPRIFFAHSFINGLYSSPRFANTCWRLVSRSSWEIKASENSDRNVFDENPVRKTDGSLFDSASFETVDAEITPETDDFFVSDAEGDPDCPTQGYSSIELALQALRKGKFVIVVDDETGDVEGNLIMAATLTSPKDIAFLIKNGSGIVSVGMKKENLERLSLTLMSPEMEDEDSSAPTFTITVDAKSGTSTGVSASDRAMTVLALSSLDAKPDDFRRPGHVFPLKYRDGGVLRRAGHTEASVDLMILAGLRPLSVLSAILDQEDGSMASLPYMKKLATEHDIPIVSLTDLIRYRRKRDKLVERITVSRLPTKWGLFQAYCYRSKLDGTENIALVKGNVGNGEDILVRVHSECLTGDIFGSARCDCGNQLDLAMELIEKEGRGVVVYLRGHEGRGIGLGHKLRAYNLQDEGHDTVQANVELGLSIDSREYGIGAQMLRDIGVRTMRLMTNNPAKFTGLKGYGLAVVGRVPVVTPITKENRRYMETKRKKMGHIYISDNNDQPLA

SEQ ID NO: 16300 - protein, 423 aa, Bacillus thuringiensis serovar kurstaki
GLAIEVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWEQYPYEWDRIEAMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPATCRP

SEQ ID NO: 16301 - protein, 160 aa, Zea mays
  misc_feature (45)..(45): Xaa can be any naturally occurring amino acid
  misc_feature (60)..(60): Xaa can be any naturally occurring amino acid
  misc_feature (91)..(91): Xaa can be any naturally occurring amino acid
  misc_feature (150)..(150): Xaa can be any naturally occurring amino acid
  unsure (1)..(160): unsure at all Xaa locations
MAGGGVDVGVEGDEKLGRKTLQCEHEVLYFDVHDNACGRYCLDLXEKTSATCSTIIASVXHGASCLLDLFDYYIRTDDRDGFRKEVRVHTXAIYFDIGENHMSRFAAGLRGLLSMRNRQIPYIVPAGSSDDKGWEAFTSVLLDIYNDATXMRVLPNHPRP

SEQ ID NO: 16302 - protein, 274 aa, Mesorhizobium sp. BNC1
MFALAASASAAGYRLEAHESVGSTNVLALERAVSGDPGKLWVVSKNQTSGRGRRGRTWETPAGNLAATLLLADRIEPGAAATLGFVAGLSLSDALRQAAPSARLGIGIDGGEGKAERTRFELKWPNDVLADGAKLAGILLESSVLGEGRFAVAIGIGVNIVSHPVDTPYPAISLQGLGADCDAERLFEALSAAWVENFALWQGPRGMSAIRDRWLENAAGLGSTVSVRADGRVVRGIFETIDEQCRFVVREDNGSRLLIAAGDVHFGAVASARD

SEQ ID NO: 16303 - protein, 413 aa, Xanthomonas oryzae pv. oryzae KACC10331
MSPKRTSFPKQDIRVLLLEGISPTAVDVFRAAGYSQIELHAKSLPEDELIARIADAHIVGIRSRTQLSAEVLAHAKRLIAVGCFCIGTNQVDLDAAEVAGIPVFNAPYSNTRSVAELVIAEAILLLRGIPQKNAECHRGGWSKSAAGSHETRGKVLGIVGYGHIGTQVGVLAESLGMQVIFHDIETKLSLGNARAAIDLDDLLARADVVTLHVPETPSTKDMIGAAEIARMKHGAHLINASRGTVIDIDALDAALTSGQIGGAAVDVFPIEPKGNGDAFASPLTAHDNVILTPHVGGSTLEAQDNIGIEVAAKLVRYSDNGSTLSAVNFPEVTLPEHPDSLRLLHIHRNVPGVLSQINELFSRHNLNIDGQFLRTDPKVGYVVIDVSASEELAAILKDGLAQITGTLRTRVLY

SEQ ID NO: 16304 - protein, 369 aa, Shewanella sp. ANA-3
MILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRSLFEQYPTEISCIIIEPVAGNMNCIPPIPGFLEGLRAMCDEFGALLIIDEVMTGFRVSRSGAQGHYGVTPDLTTLGKVIGGGMPVGAFGGRKEVMQFIAPTGPVYQAGTLSGNPIAMSAGLAQMEALCEEGLYEALSAKTKRIAEGFKAAADKHGIPMAINYVGGMFGFFFTEQEQITRFDQVTKCNIEHFRTFYHGMLDEGVYLAPSAYEAGFLSMAHGEEELRLTLEAADRVLGRMKAAM

SEQ ID NO: 16305 - protein, 850 aa, Pseudomonas aeruginosa PAO1
MKKVWFQLHWFFGISAGLVLALMGVTGATLSFQDELMRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGGSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPANSAIQWRAGDLLEIVPHQAPVRIREWLQRHNLDGQARVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 16306 - protein, 508 aa, Theobroma cacao
MANPKILYPFSVSLLFLISISSAAASSFLDERRLGGSSFPSIHAKKLIRELNLFPKEEVNVVDGGQVSLPEDSRLVEKRFKFPNLAVPGGVSVEDLGHHAGYYKLANSHDARMFYFFFESRNSKKDPVVIWLTGGPGCSSELALFYENGPFTIAENMSLIWNQYGWDMASNLLYVDQPIGTGFSYSSDRRDIRHNEDEVSNDLYDFLQAFFAEHPEFEKNDFYITGESYAGHYIPAFAARVHQGNKAKDGIHINLKGFAIGNGLTDPAIQYKAYTDYALDMGVIKKSDYNRINKLVPVCEMAIKLCGTDGTISCMASYFVCNAIFTGIMALAGDTNYYDIRTKCEGSLCYDFSNMETFLNQESVRDALGVGSIDFVSCSPTVYQAMLVDWMRNLEVGIPALLEDGVKLLVYAGEYDLICNWLGNSRWVHAMEWSGQKEFVASPEVPFVVDGSEAGVLRTHGPLGFLKVHDAGHMVPMDQPKAALEMLKRWTKGTLSEAADSEKLVAEI

SEQ ID NO: 16307 - protein, 394 aa, Nicotiana sylvestris
MTTKNRQIKNFTSNFGPQHPAAHGVSRSVLEMNGEVVERAEPHIGLLQRGTEKLIEYKTYLQALPYSDRSEYVSMMAQEHAHSSAVERLLNCEVPLRAQYIRVLFREITRISNHSLALTTHAMDVGASTPFLWAFEEREKLLEFYERVSGARMHASFIRPGGVAQDLPLGLCIDIDSFTQQFASRIDELEEMSTGNRIWKQRLVDIGTVTAQQAKDWGFSGVMLRGSGVCWDLRKAAPYDVHDQLDPDIPVGTRGDRYDRYCIRIEEMRQSVRIIVQCLNQMPSGMIKADDRKLCPPSRSRMKLSMESSIHHFEPYTEGFSVPAPSTYTAVEAPKGEFGVFLVSNGSNRPYRRKIRAPCFAHSQGLDSMSKHHMPADVVTIIGTQDIVSGEVDR

SEQ ID NO: 16308 - protein, 247 aa, Kluyveromyces lactis NRRL Y-1140
MPKLVLVRHGQSEWNEKNLFTGWVDVKLSAKGEQEAARAGELLKENNVNPDILFTSKLTRAIQTANIALEKADRLWIPVVRSWRLNERHYGALQGKDKAATLEQYGEEQFTTWRRSFDIPPPVIEDDSPFSQSNDPRYGDVDPSVLPKTESLALVIDRLLPYWQDSISSELLQGKTVMITAHGNSLRALVKHLEHISDADIAKLNIPTGIPLVFDLDENLKPTKPSYYLDPEAAAAGAAAVAAQGKK

SEQ ID NO: 16309 - protein, 812 aa, Kluyveromyces lactis NRRL Y-1140
MTYTIETCRDEKKRFEGTIVRFNNVIVLLDPGWNGEGSYEECEEFWTQYISEVDIVLISQPTIECLGSYAMMFKQFLPHFRSRIQVYGTLPVSNLGRVNSVDLLTSVGILGPFSNAVMDLEDIESSFDLIETVKYSQTVDLKNKFDGLSLEAHNSGYAPGGTIWTIITSSEKILYAPRWNHTRDTILNSADLLDNTGNPTSSMMHPTSVITNLSIIGSAEPQRKRVEHFTDTMKRAIQMNNSLLVPVEVGGKLLEVLVLVNNFLYENMRGGLKYDIPVFLISYSRGRSLTYAKSMLEWLSSQVIKTWESRDNRSPFDVVSRLRIITPEELGGYTGQKICLVSEVDDILSQTINKLCSKDKVTIILTERHPNTPAQHPLRKLNDKWQQAIKNGSRSALDGNPISISDSMSLRIMKRTILNKKDAEKVREMIKTRNEVREKIIEEYTAKTNDKAQTKTILFDVDDESSDEEGVDSMDARGKNGSGNVKVEIPVDITSNDSVSTNEKHLMFPFHPAKLKSDDYGDVVNLKRFLPQEESYDQAQSLKQSYSNNDYDEDDDDDTYEVLDSRINKSKKRKTDHNPRKQENNDDISYLDPLKSDIYKRAIVETKVNIRCSLVYIDLTSIVNARSIAIIWPAIKPRKVIVLPSAAPVDNQVVVNLTKRNIDILVTEFNNSVEMDTSVKAIDISIDPSLDQLLNWQRISKSFTVAHVVGKLLTETDPKAPHREKVILKPLSNPLALHSGSSLRIGDVRLPELKRRLTAENHKAEFQGEGTLVIDGKVLVRKINDAETIVDGSPSDVFYKVKSAVSDMLANV

SEQ ID NO: 16310 - protein, 337 aa, Gibberella zeae PH-1
MGKAEVGSTKFVANRMKAKGLQRLRWYCQPCEKQCRDANGFKQHTMSESHVRQMLLVGEDPKKYINDYTKQFLSDFILLLRTGHGEKQVHINRFYQEYIANKEHIHMNSTKFGSLTELAKHLGREGICRVEETEKGIHISWIDKSPEALRRQDALRRKEAQDQGNEELEQRMIREQIKRAQAAAGNDEEKEEDPEARELKRQEGEKIKLSFGAKPAAPDTKASESPAPDTATAEADTLKTEEIATEKRKEPDTAPAKPSGFGGISMKLAGKPQTKNVFTQAKKNALSSGSKKPAKIEQPKKMSEAERIMKEEMEKKRPRDSTGFSFGMGSNKKQKNN

SEQ ID NO: 16311 - protein, 1126 aa, Coccidioides immitis RS
MGPIKRTHNLSESPDVPSGQQRENRKRARLSGASVSEEVHPFLLSTPSTSSLDHTDDEHEYKRATQALRDKYEMLGENRPVENGIIERVDCYNFMCHEHLSMELGPLINFIVGKNGSGKSAVLSALTICLGGKASATNRGQSLRKFIKEGKESATIVVRIKNQGDSAYLPNEFGRSITVERHFSKSGTSGFRIKNASGRVVSTKRSDLDSITDYFALQIDNPMNVLTQDMARQFLSSSSPAEKYRFFVKGVQLEQLDQDYHLIEESIEHLNTKILTHSGELKDLEAKRDKARARLALSNRHEGIRARLRNLRAQMAWVQVEEQERIRDSFDEEIIKATQKITVLEGEVERSDALYQDADSACGIAVNLVREAKSELDTLHHSKKEIQSRYDSDVQERHELQATQRTIRDHIKAAEVRIEDVKQQIAQEIQRLEDINGGSKAQRLSELEEMNAAVEAARNRHLEHKKDISRLQREIVQAENKVKDTGEPITKQRQEIHQAEHHLRILMKDRLQQENALPETMSKLIRAIQGENSFCQKPIGPLGIHVTLLKPQWSSVLEKSFGNTLSGFVVTSKRDMNILSGIMQRVDCTFPIFIGNEAGTMDTSAHEPETKFDTALRILKIDNDLVRRQLIINHSIEQMLLIEDLREASSVMFTNAPPKNVRRCYCIDARDRRRGIHLGFSRTGDPTQSPLGAYTGRARMKTDIEIQIRMQHDVINTLKDALRELESEHRNALNNLQKCKQALVRHERRERDLHLEVQKAEDFIEQLKEAIERDSVEDGRLDWLKVALTESEDDKRVAEASYEDGINALDAMMEKLKSIKRELAAKDAEIVAIDRKVRILESEESRASARRRKALDEKNAAISQVEAAIRDKIEIERNRQETVARVIDFSEKASMVAPRVNIDDGETPRSLDKKLEKLTQSLQQYEKEMGASREEIATAAAEADAKCERSKEQITDFKQLSEMLFDTLRNRRERWDKFRSHISARAKLQFTYLLSERSFRGKLLTNHKEKLLDLQVEPDSTKKTSGRGTKTLSGGEKSFSQICLLLALWEAMGSPIRCLDEFDVYMDSVNRKITIELLMNAARRSVGRQFILITPGSRAEIRVAPDVRVIELAEPERGQSTISFGR

SEQ ID NO: 16312 - protein, 291 aa, Arabidopsis thaliana
MEKNQSDDDGTALIFLGTGCSGAVPDFRCLLQPSDPPCHVCSQSLSLLPHLNPNYRCNTSLLIDYCSKEEDGRHKYILIDVGKSFREQIILTHEHADAVHGLDEIRSLQPRGATIVDTDPLPVFLSQFTMESIATRFPYLVEKKVKEVPRRVSLLDWKNIEENCDEPFAASGLSFTPLPVMHGEDYIALGFLFGDKSKVAYISDVSRIPPSTEYAISKAGAGQLDLLILDTNIPWKALEILKRLCPKRALLTGMTHEFDHHEYNEILAEWSLREGIHVQLAHDGLRLPIDL

SEQ ID NO: 16313 - protein, 253 aa, Arabidopsis thaliana
  misc_feature (139)..(139): Xaa can be any naturally occurring amino acid
  misc_feature (156)..(156): Xaa can be any naturally occurring amino acid
  misc_feature (173)..(173): Xaa can be any naturally occurring amino acid
  misc_feature (193)..(193): Xaa can be any naturally occurring amino acid
  unsure (1)..(253): unsure at all Xaa locations
MEKKREGVIEGMSRIVSDPYYFLHFMAFFSYLPIRSSAAPYTSHRLFDREIQAFLAFLMFSAIKMVREETWEAFVADSLLYAKIFLIAVSLIMDYRVAVWFSIIFSVIYLLAQQPAFSKLGTAKKLTPMQLEDLLSGSXNLEIKISASPFVSFFRXMASRCRSLAIPAFPAFXICNEQATFLALFVILIHSRXIFRADCRGQLARCILFEKGFDVSRFPDFYVDAAASLPITKKLLCQHFELDRLLLDYINGT

SEQ ID NO: 16314 - protein, 1191 aa, Podospora anserina
MPSRTINNLGAESSRKRHHRGEDDESEEPVRPRSHLNGESVSALAFSHTSGSASFFIYNVLILTQRKRARLSDVRDETRANNPDDEAEYQGAASPDTPPRTQYELMRDNGFEHLRTEAADDQKATQRLRMRPNRLGENVVAENGILEQVICINFMCHTRLNCELGPLLNFVVGENGSGKSAVLTAITLCLGGKASSTNRGGSLKSFIKEGEDKAILTVKIKNQGPDAYQHDIYGDSITVERWFNKTGGSGFNLKTATGSIHSKKKEEVDQIVEYYALQVDNPLNVLSQDNARQFLNASSKAQKYKFFIEGVQLQQLDNDYKLTAEYVSQIDTKIPDQEQKIELLKVQRANAERLLETLEGERSLRDKINTMRLKLAWSRVDTCEKRLAQKEANLAEISTKLISAEEKFGLKSRALEQADQEVETTKAKLERAKEEEPELQAKVEEAKAHKEAMVADLMKVQAEEREAHQNWKAMTDQVKDFERKIAQEERSLREAHGGLQTLKMKERDEARARVQELEQKIDDNKQLIPRIKSQMSDSARALNPIKERVTKKQEEIHNLKKEIEKTQAQIGVPLAAYHKNMPRLLKAIDGDKRFQQKPIGPLGTVVHLHKPEWGAILESYFGNNLNGFVVFSKADMNVLADLMRRCDIDSNRNPIFVGQRNALNLAGKEPDADFDTILRVLKIDNQAVRDTLVINHAIEQVLLIHKRTTAQSVMMDGTAPPRNVKRCITFHDSKNEGLSIEMKPSGISTSPVRIGTQPKRLKTESASQMAFLKESLSKLESELQALRVEYKRVQDENSHHKTALAKAEKEGAVLAQQLRETELELAEIEVALDEWDGSDARLQSLREQLAQALEQKAHHGQQVTGLIVAKDQKNVLAEEAYKALKAQKLQLKDCEASVNKAEEKAKSAEAHRHIVLREKLDSEDAYKQLKAEQKEAEESIGREKDRIAEREAEAIQVCPERVHLLDGETEKSVNTQYFALRARYDKMTSRRQLNEQEVIEQAEKVRKKYDEAVNGLNSMVESSERLKHSLSLRLDKWRKFQRYISAQSRVNFIYLLSERGYRGRLLLDHKRRLLDVHVEPDHTEKRASGRSTKTLSGGEKSFSSICMLLAIWEAMGSPLRCLDEFDVFMDNVNRAVSQNMLVAAARRSVNRQYIFITPNAIDPKIIAEKDVKLIRLVDPRQQRLTSMQTIP

SEQ ID NO: 16315 - protein, 137 aa, Campylobacter jejuni subsp. jejuni NCTC 11168
MEKTLSIIKPDAVKKGVIGKILDRFESNGLRIAAMKKVQLSKEQAENFYAVHKERPFFKDLVEFMISGPVVVSILEGEGAVLKNRDLMGATNPKEAKAGTIRADFAESIDANAVHGSDSLENAKIEIEFFFKPNEIC

SEQ ID NO: 16316 - protein, 466 aa, Myxococcus xanthus DK 1622
MRKAKIICTLGPASDTPEVIEGLIRAGMNMARLNFSHGTHEEHRRRVETIRKVAKRLGTPVAILQDIQGPKIRLGRFDGGQLLVKQGQSVTVTTRNVLGQDGVIPTPIKSLVKDVAKGHEILLDDGRVRLRVLRVHGQDVQCRVEVGGVLKNHKGLNLPGSPMSVPTITRKDAVDLAFGQEVGVDYVALSFVRTPEDIKKARAHVAKLKTPLIAKIEKPQAVERVEEIAAVADGIMVARGDLGVEMPLERLPAIQKHMVSAVNRMGGLVIVATEMLESMVANARPTRAEVSDVANAILDGADAVMLSGETAAGKYPVEAASTMACIVEETERGVVKHQHHSPFERSEDLGTGVAAAAVAAATQLGIGTIVAYTESGHTARLISEFRPHARIIALTPSETAVNRMALYWGVTGMQVARVSTTDAMLTQVRQLCRKEKLCAPGTPVVVVAGVPLNVPGNTNLMSIHRI

SEQ ID NO: 16317 - protein, 255 aa, Glycine max
MAAYSSHALKTIPFSSFVKPVSTKPTSFFTPSPTKPFLPFTSPNHSLTKNLKLNSTLPHFCLSSVPKKSFTCRSQAEPVDSEKVQELSVYEINERDRGSPVYLRLSYKSVNSLGDLVPFSNKLYTGDLQKRIGITSGICILIQNKAEKKGDRYEAIFSFYFGDYGHIAVQGPYLTYEDTYLAVTGGSGIFEGVKGQVKLRQIVYPFKILYTFYLKGIKDLPQELLVKTVEPIPSVEPSPAAKALEPNATIAGFTD

SEQ ID NO: 16318 - protein, 528 aa, Zea mays
  misc_feature (195)..(195): Xaa can be any naturally occurring amino acid
  unsure (1)..(528): unsure at all Xaa locations
MYSDHKPRNREADLVELTIGFTDQSSSSPNSHCIESGSMLPLSLFVSLLVLHLPHASADGDICIIGGGISGASTAFFLTSYTSTLGGAQLRVFERRQKVGGRLGTVTLAGDSFEAGGSIIHPRNLHARRFADLLGLAVKTGGDDWLGIWDGKSFVFQTARPPPVGSSWWRRKLHSLVNSLLLLRRYGLSLLKMGXFVQEMLRRFMLFYNGMESRPVFATVEEMLQWTGLYGLTRRTLEEELLDAGLNTRMIAELVTVITRINYGQSTHISGLAGAVSLAGSESGLWAVKGGNWQLAAGLLKTSNATLHLQEGIDSITDAGDHYVLRSNSGSEYECMVTVVATPLDELNITFSPPISIPPRKMQHTHATFVRGILNPGYFGLNSASDIPELIGTLELPDIPFSCISVLKRYSEGDMAAYKMFSRAKLDDGLLDQIFRARIETIRINWAAYPHYQAPEEFAPIVLDGKQLYYVNTFESAASAIETGAVAAENVARLIISRLSLLPQAQQQQPHIIKSFAEQESQRRHVDL

SEQ ID NO: 16319 - protein, 510 aa, Idiomarina baltica OS145
MAHDKKPLVLMILDGWGYRDSAPDNAITAANTPVMDRLWNEYPHCLVDGSGGAVGLPDGQMGNSEVGHVNLGAGRVVYQDFTRISQSIKTGEFFDNPVLTENVEQAVAKNGAVHIMGLLSAGGVHSHEEHLMAMVELAHKKGAQRIYVHGFLDGRDTPPKSAGPSIEKFEALFERLGVGRFASLSGRFYAMDRDNRWERIEGAFNAVYHGRAEHRANNAHNALADAYERGESDEFVSPVVIGEPAAIEDGDAVFFMNFRADRAREMTRAFIDNELDTFERGIRKQLSGFVMLTQYADEFDTPCAFPPVRLDNVLGEWLAKHDKTQLRISETEKYAHVTFFFSGGREQAFDGEQRKLIPSPKVKTYDLQPEMSSKQLTDAIVEAVDNQEYDVIICNYPNGDMVGHTGNFDAAVKACEAVDHSVGRVVEALQKVGGECLITADHGNAEQMSDPSTGQAHTAHTSELVPFIYVGRHATPRNGILSDVAPTMLHLMGLEQPNEMTGKTLMQLDG

SEQ ID NO: 16320 - protein, 148 aa, Capsicum annuum
MEQTFIMIKPDGVQRGLVGEIIGRFEKKGFSLKGLKLITVDRAFAEKHYADLSAKPFFNGLVEYIVSGPVVSMVWEGKGVLTTGRKIIGATNPLESAPGTIRGDYAIDIGRNVIHGSDAVESARKEIALWFPEGVAEWQSSLHCWIYE

SEQ ID NO: 16321 - protein, 397 aa, Nocardioides sp. JS614
MKVLLLENIHPAAVEILEGHGFEVELRSRSLSEAELIEELPGVSVLGIRSNTHLTAPVLEAATDLMAVGCFCIGTNQVDLSAASRRGVAVFNAPYSNTRSVVELVIGEIIALGRRLTEKTQRMHEGVWDKSAKGSHEVRGRTLGIVGYGNIGTQLSNVAEALGLRVIFFDTADRLAHGNAQRMRSLDELLAEADVVSIHVDGRPGNAGLFGAEEFAKMKPRSLFINASRGMVVDDVALREHVLSGHIAGAAIDVFPIEPKAQGDPFESVLRGLDNVILTPHVGGSTQEAQEEIGHFVSGKLAAFTRQGRTELSVNLPTVQAPELEVGHRIGFLHDNVPGVLASVNDLLADANANVTGQYLSTRGQQGYVVTDTLDPLPQDALAKLAEADHTIWLRTW

SEQ ID NO: 16322 - protein, 400 aa, Silicibacter pomeroyi DSS-3
MSFLSATLSRVKPSPTVAMTAKAAELKAGGRDIIGLSAGEPDFDTPQNIKDAATAAIAAGKTKYTAPDGIIELKQAVCAKMQRDHGLSYTPAQVSVGSGGKQTLYNALMATLNPGDEVIIPAPYWVSYPDMVLLGGGTPVVVETALESAFKLTPAQLEAAITPRTKWFIFNSPSNPTGAGYSRDELKGLTDVLMRHPHVWVMSDDMYEHLAYDGFAFCTPAQVEPGLYERTLTCNGTSKAYAMTGWRIGYAAGPVGLIAAMRKIQSQSTSNPCTISQWAAVEALNGTQEFLAPNNALFKRRRDLVLSMLNAIEGIDCPTPEGAFYVYPSIAGLIGKTTPKGTRIDSDETFCTALLEEADVAVVFGAAFGLSPNFRVSYAASDAALTEACTRIQRFCASLT

SEQ ID NO: 16323 - protein, 218 aa, Brassica napus
MGSSGDVNWKLEDHPKLPKGKTIGLIVLDGWGESEPDQYNCIHKAPTPAMDSLKNGRPDTWRLIKAHGTAVGLPSEDDMGNSEVGHNALGAGRIYAQGAKLVDLALESGKIYEDEGFKYISESFEKGTVHLIGLLSDGGVHSRLDQVQLLVKGFAERGAKRIRVHILTDGRDVLDGSSVGFVETLESELAELRSKGVDAQVASGGGRMYVTMDRYEND

SEQ ID NO: 16324 - protein, 506 aa, Prunus mume
MASTFSHISLSLLSLVLLAFFSAAFPNNGPLQLSSTPKLQAEKFIRGLNLFPTDEINTVPHKTSLDEAFAGPMLVEKQFKMPFLGAASGPSVQELGHHAGYYRLPNSKAARMFYLFFESRTDKNNPVVMWLTGGPGCGSEIAVFYENGPFQIANNLSLAWNDYGWDKASNLLFVDQPIGNGFSYTSDEGDIRHDEEGISNDLYDFLQAFFAQHPQFAKNDFYITGESYAGHYIPAFGSRIHKGNKAKEGMYINFKGFAIGNGLTNPEIQYKAYPDFALQTGLIKKADYDRISKTIPDCEQAIKTCGSEGGEACASSYEVCNSIFEKIINIIGGTNYYDIRKQCEGDMCYDFSNMETFLKKKQVRDALGVGDIDFVSCSSTVYDAMLMDWMRNLEVGIPALLEDGIKVLLYAGEYDLICNWLGNSKWVHAMEWSGQKAFGASSTVPFKVGATEAGLLKSHGPLTFLKVHNAGHMVPMDQPEAALQMLTSWMQGKLAIAESVERIAPK

SEQ ID NO: 16325 - protein, 326 aa, Bacillus subtilis
MKAVTYQGIKNVVVKDVPDPKIEKSDDMIIKVTSTAICGSDLHLIHGFIPNMQEDYVTGHEPMGIVEEVGSGVTKLKKGDRVIIPFNIACGECFFCKNQLESQCDQSNDNGEMGAYFGYSGQTGGYPGGQAEYLRVPFANFTHFKIPESCEEPDEKLSVIADAMTTGFWSVDNAGVKKGDTVIVLGCGPVGLFAQKFCWLKGAKRVIAVDYVNYRLQHAKRTNKVEIVNFEDHENTGNYLKEITKGGADVVIDAVGMDGKMSDLEFLASGLKLHGGTMSALVIASQAVRKGGTIQITGVYGGRYNGFPLGDIMQRNVNIRSGQAPV

SEQ ID NO: 16326 - protein, 315 aa, Rickettsia conorii str. Malish 7
MFYWIPAFTGMTYPMLPSIAKHAALHQVNPLKKHGQNFIFDSSLCDKIVRASNLAENSRVLEIGPGTGGLTRSILQKNPESLTVIETDARCLPLLNEIKEYYPNLNIIKQDALKINLTDLSYDIVNSVGFAYKKREVKPITNRRANDIGESKSIDYKVTIISNLPYHIGTELVIRWLKEARLITSMTLMLQKEVVERICAIPSTKAYGRLSVICQLIAKVEKCFDVAPTAFYPPPKVYSAIVKLIPLENPPSIALINKVEQITKLAFAGRRKMIKSSLKNLVPNIYEVLTQLKINDNYRAENLAPQDYLRIAEIL

SEQ ID NO: 16327 - protein, 412 aa, Shigella flexneri 2a str. 301
MKALTYHGPHHVQVENVPDPGIEQADDIILRITVTAICGSDLHLYRGKIPQVKHGDIFGHEFMGEVVETGKDVKNLQKGDRVVIPFVIACGDCFFCRLQQYAACENTNAGKGAALNKKQIPAPAALFGYSHLYGGVPGGQAEYVRVPKGNVGPFKVPPLLSDDKALFLSDILPTAWQAAKNVQIQQGSSVAVYGAGPVGLLTIACARLLGAEQIFVVDHHPYRLRFAADRYGAIPINFDEDSDPAQSIIEQTAGHRGVDAVIDAVGFEAKGSTTETVLTNLKLEGSSGKALRQCIAAVRRGGIVSVPGVYAGFIHGFLFGDAFDKGLTFKMGQTHVHAWLGELLPLIEKGLLKPEEIVTHYMPFEEAARGYEIFEKREEECRKVILVPGAQSAEAAQKAVSGLVNAMPGGTI

SEQ ID NO: 16328 - protein, 447 aa, Oryza sativa
MEASLVLLCLCVFLASGGEGRSPAGTVLPLQVRVQEVELEAPAANRLRFRHNVSLTVPVAVGTPPQNVTMVLDTGSELSWLLCNGSYAPPLTPAFNASGSSSYGAVPCPSTACEWRGRDLPVPPFCDTPPSNACRVSLSYADASSADGVLATDTFLLTGGAPPVAVGAYFGCITSYSSTTATNSNGTGTDVSEAATGLLGMNRGTLSFVTQTGTRRFAYCIAPGEGPGVLLLGDDGGVAPPLNYTPLIEISQPLPYFDRVAYSVQLEGIRVGCALLPIPKSVLTPDHTGAGQTMVDSGTQFTFLLADAYAALKAEFTSQARLLLAPLGEPGFVFQGAFDACFRGPEARVAAASGLLPEVGLVLRGAEVAVSGEKLLYMVPGERRGEGGAEAVWCLTFGNSDMAGMSAYVIGHHHQQNVWVEYDLQNGRVGFAPARCDLATQRLGAGA

SEQ ID NO: 16329 - protein, 437 aa, uncultured crenarchaeote DeepAnt-EC39
MKNNIEIYKSKTRKSSKLFEKSKKYHVNGVHHNIRFFEPYPFVTKSANSKFLVDIDSNKYVDYWMGHWSLILGHKPKKIINVIKKQLNYDWMHGVLNKNSIELSEKISKVVPVAEKIRYASTGTEATMYAVRLARTVTKRKIIAKIDGGWHGYTTDLLKTVNWPFSKSESSGLTDEKYIISLPYNDLENSIKILKSKKNELAAVIIEPVLGGGGCIPATKEYMFGIQEFCRKNKTVFILDEIVTGFRFRFGCLYNTMKLDPDLLTLGKIVGGGLPIGVICGKDELMKYANTEIYSKIERAYIGGGTFSANPLTMIAGNSMLSTIKNKSNQLYRKLNSFGTETRKMLDKKFDGKVITTGMGSLFLTHFLNDSICEINNATDVAKCNIKKLHDYHFHMIANDDIFFLPGKLGAFSDVHTKSDIKTMERSTDEFLTKFKK

SEQ ID NO: 16330 - protein, 300 aa, Gloeobacter violaceus PCC 7421
RIGRLVLRAGLDNPDLEFVGINDLVPPDNLAYLLKHDSTHGRFKGTVEAHPDGMVVNGRFIPCTAIKNPVELPWGSLGVDYVVESTGLFTGYDGASHHLAAGARRVVITAPTKDPEKVPTLLMGVNHDQFDPDQDLIVSNASCTTNCLAPVAKVIHERFGLAEGLMTTVHAMTATQPTVDGPSKKDWRGGRGAAQNVIPSSTGAAKAVTLVLPELKGRLTGMAFRVPVPNVSVVDLTFKTEQPTSYKAICAAMKEASENELAGILGYTEEQVVSSDFIGDAHSSIFDAGAGIELNSQFFK

SEQ ID NO: 16331 - protein, 274 aa, Halobacterium sp. NRC-1
MPTVNSVRRAGNTDEETDPVTMLTAYDAPTASVVDDAGVDMILVGDSVGNAKLGYDTTLPVSVDEIASATGAVARATADAVVVADMPFLSFGADETESVRNAGRMLKEEDADAVKLESGPHTVSLTETLTSLGIPVMAHLGLTPQHVNQLGGYFRQGTDQDSAERMLDLARDHEAAGAFALVLEHVPANVAADITDAIDIPTIGIGAGPDTDGQVLVISDVIGMSERSPPFSKQFGDVNREMAAAVDDYVDAVESGSFPAAEHSHVADDVDDVY

SEQ ID NO: 16332 - protein, 254 aa, Chlamydophila abortus S26/3
MERKRYIFGNWKMHKTAKEAKDYLSVFCPLLEEVAPVSCVGITPAFTALHACCESIKFFHSPLWLGAQNVHQDTSGAFTGEISLPMLKEFDVNFVLLGHSECRHIFHEEDTTIALKVGAAAREGIIPVLCIGETLEVREKGATEAMLSNQLMLGLAQLPETASVIIAYEPVWAIGTGKVASAVDVQEAHAFCREVLANIFSKEKAEEISILYGGSVKADNAEGFARCPDVDGLLVGGASLDPKVFADVVANFHR

SEQ ID NO: 16333 - protein, 492 aa, Xanthobacter autotrophicus Py2
MAAPQPLSRPATARFPLLRDKMLIGGAWVDADSGATIEVNNPATGEIIGTIPKAGAAETRRAIEAASEAFKTWRATTAAERAAKLHKLADLITQNADELAAILTTEQGKPLAEAKGEIGASAGYVRWFAEEARRLYGDVIPSPWGNRRILVTKEPVGVVTAVTPWNFPSSMLSRKIGAALAAGCTVVAKPSELTPYSGLAWGVLAEMAGIPAGVVNIVVGEAPAIGGEMTSNPLVKKVTFTGSTPVGKLLMKQSADTMKKISMELGGNAPFLVFDDADLDLAVEQAIASKFRNVGQTCVCANRFYVQAGIYDAFAAKFAEASKKLKVGNGLDEGVVAGPLIDDRALAKVERLLKDALDKGATVLTGGKQPALGGTFFEPTVLAGATQDMAFARDEIFGPLAPLFKFETEEQAVSYANDTEYGLACYFFTKDLGRAFRVAEKLEYGQVGINAGVITTEVAPFGGVKESGMGREGSKYGCDDYLNIKYMCVGGL

SEQ ID NO: 16334 - protein, 320 aa, Magnetospirillum magnetotacticum MS-1
AGGDRGGGRVALRPLFHLVARTRSPELFMAACLLVIVATAVVAAGSGLSMTLGAFVAGLLLAETEYRRAIEATIDPFKGLLLGVFFVSVGMNLDPAQLVAAPGAILGLSVGLLAIKGAVVLAGARIMGLPRPVAFETALLLGPGGEFAFVLIGGAMAAGLVPEPVGGAALIVTTVTMIAIPGLAAFARRIGGRVSREQLGRARAEPVPDPQQNRVIVAGYGRVGRLVGEMLKRHAIPYLALDSDPGRVGEHGRSAIPSIRRSGNPRMWPREFARPASCNSIPGGRAAGPASGHTGRRAERAKRRNGRKAHTGGTQGSQGK

SEQ ID NO: 16335 - protein, 540 aa, Leuconostoc mesenteroides subsp. mesenteroides ATCC 8293
MSFQDSNNDGIGDLAGITQRLQYIHNLGADVIWLNPIYVSPNKDNGYDIADYRNINPNYGTMQDFEDLLQQAHRLDLKIMMDLVVNHTSDQHVWFKESRKNQTNEYANYYIWRDPVDGHEPNNWLAAFGGSAWTYVPERKQYYLHMFAEGQPDLNWENLEVREAVFDIERFWLDKGVDGFRMDVINLISKPEGLPDVTEPVTAGTTMDFVADGHRLNEFLRQMNDEVLSKYDTITVGEMPSSTPEDAIKYTGLDSHELNMVFQFEHVSLSPNPDVRLGKWNDEPINLVELKASLNRWQIGLDGKGWNSLYWNNHDQPRAVSRFGNDQPEFRVLSAKMLATTLHMMQGTPYVYQGEELGMTNGHFESLEQYEDIESVNFYHEFVDEQKIVDSATMLKYLANMSRDNARTPMQWNNQQNAGFSNVTPWYAPNKNYTAINAENVLSDNDSVYYHYQKLIQLRHDSEIVRYGTFEAIDSEDNQVYAYLRHYKEQSVLVLSNFTDKVVTRDYGQTKFSELLINNYLDDQGTILRPYESKVYLLTK

SEQ ID NO: 16336 - protein, 462 aa, Candida albicans SC5314
MKPMQNVKEWSEKLKQEGKDVPLDLKVYEDLIRKDKEFVGKLNKQLHDNKFIMENINRDIKSYNQIKQLRMNSIALSNKGQYNNSIWGEGYQGYGNGITNSSTKLFIPNRDLTDRIINERVMKNKNKPKHYVPIRLEFDQERDQFKLRDTFLWDLNEEIIKVEDFTAQLLEDYKFISKVHYETILSSIKEQIADYSQKPSKTMGELRIPIKIDITINNTQLTDQFEWDILNSQEGDAEEFSSYMCDELCLPGEFCTAIAHSIREQSQMYYKALNMVGYGFDGSPVHEDEIRNHLLPPLRLVSSDSGIVDDFFSILRNPSSLPDFSPTLGKLSQLEVERLDKEMERESRRKRRHNYNEDQQQGSGRGFTSRRIAAHAGRGNTIPDLSDIPKTFRTPAPSSILPGAVDMGVPEVYEYNEVLINRTQVRNPDYRPPTPIRVENELVDYNHDPIEGTFMVTIKLPV

SEQ ID NO: 16337 - protein, 117 aa, Triticum aestivum
  misc_feature (39)..(39): Xaa can be any naturally occurring amino acid
  misc_feature (47)..(47): Xaa can be any naturally occurring amino acid
  misc_feature (58)..(58): Xaa can be any naturally occurring amino acid
  unsure (1)..(117): unsure at all Xaa locations
MQRPELTNMPSLQKPLPPQLADNALTSLPECLRRAKFIXGNQLATDXLLSSMATQQFXKNMHETDPEKIRNMDDYATRGLISLILYESEKMTRRKFSGEDSAGLGWPLPSVFAVYTV

SEQ ID NO: 16338 - protein, 533 aa, Anabaena variabilis ATCC 29413
MTKAPVAPVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRIQRAYDVMTQDGAGDGRKAVDVLQASYAEGVNDEFIVPVRIAPGTVESGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIQAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQPAEYDVQSPRTRIPVGLN

SEQ ID NO: 16339 - protein, 251 aa, Aspergillus oryzae
MPRQFFVGGNFKMNGTAESITAIIKNLNEAKLDETTEVVVSPPALYLTLAQQVADEKKKVAVSSQNVFDKPNGAFTGEISVSQLQDAKIPWTIIGHSERRVILKETDEFIARKVKAAIDGGISVIFCIGETLEEREADKTIEVVTKQLNAAAKELTKEQWSKVVIAYEPVWAIGTGKVATTQQAQEVHAAIRKWLADAISPEASENTRIIYGGSVSEKNCRELAQERDVDGFLVGGASLKPAFVDIINARL

SEQ ID NO: 16340 - protein, 562 aa, Arabidopsis thaliana
MARFAVIGLTFLLLLGTSLSARSDEETRERFYGNVVNSTAPGNGEGSIAKMFDRVLEKEFSENDSPEGSDGASFNSSVADQQAEIETVAKVTHEKGKRNDTQENNGTRPFQLQDVFSLENEDSDDMTLIDKKNNVFVMSNKKSKYPILQVDLRLISDLVVIIVFAAIGGIVFSCLGQPVIVGYLLAGSIIGPGGLKFISEMVQVETVAQFGVVFLLFALGLEFSMTKLKVVGPVAVLGGLLQIVLLMFLCGVTALLCGARLSEGIFVGAFLSMSSTAVVVKFLVERNSTSSLHGQVTIGILIFQDCVVGLLFALLPVLGGNSGLLQGIISMGKLLLILSIYLTVASLLTWSFVPRFLKLMIQLSSQTNELYQLAAVAFCLLSAWCSDKLGLSLELGSFVAGVMLSTTEFAQHTLEQVLILNSGRFCFASTCIGMLINVHFLWNHVDILLASVILVIVIKTAIAAVVVKAFRYNMRISFHVGVLLAQIGEFAFVLLSRASNLHVIEGKMYLLLLGTTALSLVTTPLLFKLIPSAMNLGVLLRWFPSENSSPNEVILFSRSIYI

SEQ ID NO: 16341 - protein, 510 aa, Listeria monocytogenes str. 1/2a F6854
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLEKAISDLNYGAIATVSGRFYAMDRDKRWERVEKAYKAIVSAEGEKFEDPIELVKASYANDKNDEFVVPAIITKDGKPVATVKDNDAVIFFNFRPDRAIQLSNAFTDKEWDHFDRGADHPKNIKFVTMTLYNPSVDAEVAFKPIEMKNVIGEVLSNEGLAQLRIAETEKYPHVTFFMNGGRNEEFPGESRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 16342 - protein, 251 aa, Listeria monocytogenes str. 1/2a F6854
MRKPIIAGNWKMNKTAAKAGQFAEDVKNNVPSSDAVESVVAAPALFLQELVRLTEGTNLRVSAQNCYFEDEGAFTGEISPFALADLGVSYVIIGHSERREYFHETDEDINKKAHAIFKHGMTPIICCGETLDQREAGQTDTWVRGQIRAALAGLTEEQVIKSVIAYEPIWAIGTGKSSTSADANETCAVIRAEVADAVSQKAADAVRIQYGGSVKPENIADYLAESDIDGALVGGASLEPASFLALLEAVK

SEQ ID NO: 16343 - protein, 353 aa, Synechococcus elongatus PCC 6301
MSKIRVGINGFGRIGRLCLRAGFDDPQLDFVAINDLVPAKNLAYLLHYDSTHGRLQQTVRAEEDRICAGDRCIQCFSETDPAAIPWGELGVDVVIEATGRFTDYAAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNEWGYSNRMLDLIRYMRSVEQQPAWAPRSLTPA

SEQ ID NO: 16344 - protein, 844 aa, Synechococcus elongatus PCC 6301
MSDSTAQLSYDPTTSYLEPSGLVCEDERTSVTPETLKRAYEAHLYYSQGKTSAIATLRDHYMALAYMVRDRLLQRWLASLSTYQQQHVKVVCYLSAEFLMGRHLENCLINLHLHDRVQQVLDELGLDFEQLLEKEEEPGLGNGGLGRLAACFLDSMATLDIPAVGYGIRYEFGIFHQELHNGWQIEIPDNWLRFGNPWELERREQAVEIKLGGHTEAYHDARGRYCVSWIPDRVIRAIPYDTPVPGYDTNNVSMLRLWKAEGTTELNLEAFNSGNYDDAVADKMSSETISKVLYPNDNTPQGRELRLEQQYFFVSASLQDIIRRHLMNHGHLERLHEAIAVQLNDTHPSVAVPELMRLLIDEHHLTWDNAWTITQRTFAYTNHTLLPEALERWPVGMFQRTLPRLMEIIYEINWRFLANVRAWYPGDDTRARRLSLIEEGAEPQVRMAHLACVGSHAINGVAALHTQLLKQETLRDFYELWPEKFFNMTNGVTPRRWLLQSNPRLANLISDRIGNDWIHDLRQLRRLEDSVNDREFLQRWAEVKHQNKVDLSRYIYQQTRIEVDPHSLFDVQVKRIHEYKRQLLAVMHIVTLYNWLKHNPQLNLVPRTFIFAGKAAPGYYRAKQIVKLINAVGSIINHDPDVQGRLKVVFLPNFNVSLGQRIYPAADLSEQISTAGKEASGTGNMKFTMNGALTIGTYDGANIEIREEVGPENFFLFGLRAEDIARRQSRGYRPVEFWSSNAELRAVLDRFSSGHFTPDQPNLFQDLVSDLLQRDEYMLMADYQSYIDCQREAAAAYRDSDRWWRMSLLNTARSGKFSSDRTIADYSEQIWEVKPVPVSLSTSF

SEQ ID NO: 16345 - protein, 481 aa, marine gamma proteobacterium HTCC2207
MPRRTKILATLGPATHHEQGIRGLILAGVNVFRLNFSHGSAEEHSMRAAMIREIALELETPVGILCDMQGPKIRIGSFTNDMKIDLAENDSFVLNSQIGVDAGDQNGVHIDSDLLNDIDAGDTLLLDDGRMTFIVESRNSHSVTCRVAQGGVLSSKKGVNKFGGGLSAPALTEKDKADIKTAASLKTDYLAISFVRSKDDIEETRELLVAAGSGAHIIAKIERAEAITGEFLPGIIASADGVMVARGDLGVEIGDANLVAVQKQLIEAANAANKVVITATQMMESMITASTPTRAEVFDVANAVLDGTDAVMLSAETAVGMYPAETVKAMVRIIEGAELHPLAQRSKHRIDQTFSSIDESLALAAMYVANHLEGVKAVICMTATGFAPLIMSRITSSLPIYAMAEKHGTCEITALYKGVVPVPFHASALDPSEVNHRAVETLRAHNAVADGDLVLITKGDFVNVHGGTNTLKIVRVGDVIQ

SEQ ID NO: 16346 - protein, 379 aa, Oryza australiensis
MATAGKVIKCKAAVAWEAGKPLVIEEVEVAPPQAMEVRVKILFTSLCHTDVYFWEAKGQTPMFPRIFGHEAGGIVESVGEGVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 16347 - protein, 383 aa, Streptomyces avermitilis MA-4680
MTPTTETMVGIGGAAESTDMVLNIGPQHPSTHGVLRLRLVLDGERIQHAEPVIGYMHRGAEKLFEARDYRQIIMLANRHDWLSAFSNELGVVLAVERMLGMEVPERAVWTRTLLAELNRVLNHLMFLGSYPLELGGITPIFYAFTEREELQHVMEEISGGRMHYMFNRVGGLKEDLPAGWATRARACVAALRSRLDVYDDLVLGNEIFRGRTRGVGVLTPEAVHAYGVSGPIARGSGVDFDLRRDEPYLAYGELQDTLKVVTRQEGDCLARFECLLEQTHNALDLADACLDRLAELPPGPINQRLPKVLKAPEGHTYAWTENPLGINGYYLVSKGEKTPYRLKLRSASFNNIQALTELLPGTLVADMVAILGSLFFVVGDIDK

SEQ ID NO: 16348 - protein, 193 aa, Brassica napus
  misc_feature (60)..(60): Xaa can be any naturally occurring amino acid
  unsure (1)..(193): unsure at all Xaa locations
MALGDLSSSSTSELHVLAVDDSIVDRKVIERLLRISACKVTTVESGTRALQYLGLDGDKXSSGLKDLKVNLIVTDYSMPGLTGYELLKKIKESSAFREIPVVIMSSENIQPRIEQCMTEGAEDFLLKPVKLADVKRLTELIMRSGEPQEEDKAKHSYPNRILQNNTDSSSSSHDYVSSVYDDTPSSKRMKLES

SEQ ID NO: 16349 - protein, 186 aa, Brassica napus
MAFSFSFTALALLISSLAAAFLLLFRRTRYRRMGLPPGSVGFPLIGETLQLIKAYKTEDPEPFIDERVARYGSVFTTHLFGEPTVFSADAETNRFVLQNEGKLFECSYPDSISNLMGKHSLIRMEGSLHKRMHSFTMSFANASAMKDHLMVDIDRLVRFNLGSWSSRVLLMEESKKMTFDVAVKQL

SEQ ID NO: 16350 - protein, 451 aa, Salinibacter ruber DSM 13855
MPQTQKPDFPGNDLGDQFRFWPKHNEKIYERLENKHAWLEEKRAAAQGDGKPPATQRSEVDPLENEMILNIGPQHPATHGVLRCVVKMDGETIEKSVLDIGYLHRGIEKLAEHKTYQEFMPYTDRMDYLSPYSNNVAWCLAVEKLADIEVPERAQWIRMIMSELARISSHCLWLGVGMMDAGAVSGFVWTFQEREEIYSIMDEVAGARFTVSHSRIGGVANDFSPRAIEMIRDFVDTFPDRIAGWEGLLNKNRIWVERNKGVGRVTKEEALELGLTGPNLRGSGVPYDVRRFEPYLKYDEVDFTIPVREEGDCLARYFLRLDEMKQSVRIIEQCLDRMTEGPIRSDDAKEAYPSKEEVYYSMEGMIHDFMYTDVGTVPPKGAHSYHAIEGPKGELGFYLTSDGTGRPWRVRINAPSFTNLQAMEHMLEGEMVADTVVIIGSLDPVMGEADK

SEQ ID NO: 16351 - protein, 133 aa, Triticum aestivum
  misc_feature (37)..(37): Xaa can be any naturally occurring amino acid
  misc_feature (62)..(62): Xaa can be any naturally occurring amino acid
  unsure (1)..(133): unsure at all Xaa locations
IGTAPQDAAIVHPSRAQIALPSTQRRSCGEVRLGGAXATEKLGVRVGRNPPESRLSELGVRXWPKGGLRIGAKFPWTYSAKETCYLLQGKVKVYPDGEEGFVEIAAGDLVVFPKGMSCTWDVTEAVDKHYKFE

SEQ ID NO: 16352 - protein, 437 aa, Medicago truncatula
MVSTPSLPSKETQSEQKEVENGPARRAKWWYSTFHTVTAMIGAGVLSLPYAMAYLGWGPGILMLLLSWCLTLNTMWQMIQLHECVPGTRFDRYIDLGRHAFGPKLGAWIVLPQQLIVQVGCDIVYMVIGGKCLKQFVEIACTDCTQIKQSYWIMIFGGIHFFLSQLPNFNSVACVSLAAAVMSLSYSTIAWVACLPRGRIDNVSYAYKPISKTDLLFRVFNALGQISFAFAGHAVTLEIQATIPSTPEKPSKIAMWNGAICAYFINAICYFPVAIIGYWTFGQDVNDNILMSLEKPSWLIASANLMVFIHVVGSYQVYAMPVFDLIERMMMRRLNFPPGVALRLVARSAYVAFTLFFGVTFPFFGDLLGFFGGFGFAPTSYFLPSIMWMIIKKPKKFSINWFINWAGIYIGVCIMLASTVGGLRNIIADSSTYSFYT

SEQ ID NO: 16353 - protein, 694 aa, Zea mays
  misc_feature (614)..(614): Xaa can be any naturally occurring amino acid
  unsure (1)..(694): unsure at all Xaa locations
LPRGWTADRLKSLLQDQGISYATAKKKKGMTVRGVTFQSVEQLTNAVQVLKENPSGGKQIKIVDANRRSHQKAHAGAPVSNTGTATENGSSPTTPAEETSVPESVSSSKKGARDAVTPLAHMTYIDQLEHKKQSMAQILKKLTRNARKACPPAIPHPDWVFKSKEIGGLPCKFEGILESPVVNGYRNKCEFSVGYSLEGKKTVGFMLGNFREGVTAVEEPENCPNVSEISCKYAQMFQDFLQSSSFPLWSKIDNSGFWRQLTVREGRCPAEAVVSQNAESQISEVMLIVQVCSTSVDEALMKEEFDKLSAALVQGAATCSPPLPLTTIAAPEPPPPPNAAPTDCPLSPLLVPKGDKLDGTSEDKTRIHDHISNLKFSISPTAFFQVNTLAAERLYTLAGDCANLNSDTLLFDVCCGTGTIGLTLAQRVGMVVGIEMNESAVSDAHRNALINGIKNCRFVCGKAEDVMGPLLTEYLGSPQQQAAASKSNSEIDDTSKTEDMIGCASYDGENIDSSKQRNDNAEGQQPMGASVDHPTCASEVDENNVASGEQNCGEASLVNDKPIETASDNSLEQGKAWEDGSSSPNNNVLAANACQFKNVVAIVDPPRVGLRPTXYVSCNPDSLVANAIELCTPTSEKQEKNKGNRGWRSMSSAGLARQRTKSMPNFEPFIPKRAMAVDLFPHTPHCEMVMLFER

SEQ ID NO: 16354 - protein, 133 aa, Coccidioides immitis RS
MTGGKSGGKASGSKSSQSRSSKAGLAFPVGRVHRLLRKGNYAQRVGAGAPVYLAAVLEYLAAEILELAGNAARDNKKTRIIPRHLQLAIRNDEELNKLLGHVTIAQGGVMPYIHQNLLPKKTPKTGKNPSQEL

SEQ ID NO: 16355 - protein, 343 aa, Vibrio angustum S14
MKIKALSKLKPEEGIWMTEVDKPEVGHNDLLIRIKKTAICGTDVHIYNWDEWSQKTIPVPMVVGHEYVGEVVGMGQEVRGFAIGDRVSGEGHITCGHCRNCRGGRTHLCRNTIGVGVNREGAFAEYLVIPAFNAFKIPDDISDDVASIFDPFGNAVHTALSFDLVGEDVLITGAGPIGIMAAAVAKHVGARHVVITDVNEYRLDLAREMGVTRAVNVAKESLTDVMAELGMKEGFDVGMEMSGNPAAFNSMLSSMNHGGKIALLGIPPSDMAIDWNQVIFKGLIIKGIYGREMFETWYKMATLIQSGLDLSPIITHHYKIDDFQQGFDVMRSGQSGKVILDWE

SEQ ID NO: 16356 - protein, 492 aa, Mycobacterium tuberculosis H37Rv
MMSASWLRHRVSERGLIATAEQLWADSFRLALVAAHDDGDSLRVVYLFLAGYPDRRVELEYVVPADNPEIRSLAYLSFPAGRFEREMADLYGIRPVGHPKPRRLVRHAHWPDWHPMRTDAGPAPEFTDTGAFPFLAVEGPGVYEIPVGPVHAGLIEPGHFRFSVAGETIVRLKARLWFVHRGIEKLFHGRPATAAVDLAERISGDTSAAHALAHSLAIEDALGIELPHEVHRLRALIVELERLYNHAADLGALANDVGYSLANAHAQRIRENLLRRNAAVTGHRLLRGAIRAGGVALRALPDTDELAALAVDLAEVATLTLANSVVYDRFAGTAVLHPDDASALGCLGYVARASGLRSDARVEHPTIVLPITEIGAPDGDVLARYTVRRDEFAASAALAQHIVESHTGPIEYAATLHPVGAPSSGIGIVEGWRGTIVHRVEIDVDGRITRAKVVDPSWFNWPALPVAMADTIVPDFPLANKSFNQSYAGNDL

SEQ ID NO: 16357 - protein, 209 aa, Rickettsia conorii str. Malish 7
MKVDSLHNLSYKEEFEGDMKRSTAAYKKVSEDASIGSTYIADISEVGSQISGEPVQRIKIPEHRQILKRSLIKPVIMAGGNGKRLWPLASKDKPKQFKKILSDLTLLQQTLNRNKFLGQPTIITSKKYESITKEQATEIDVEIALITEPLQKNTAVCAIITALSATALGFDIVVLLPSNHHIADDINYLNTINKALHYVNECGICTIFL

SEQ ID NO: 16358 - protein, 175 aa, Rickettsia conorii str. Malish 7
MRHLHYIPINVISAKYGYINTGLSIAENVYLVDHLIEQPILEQANKHFQSNEYFWNSGICVYDVNFFLNLAMNLQPDLFCIAEKAFNTAVKNENSLAIDNEAYNEIAAISIDNTIMEYISGMVMIKADFAWNDLGTWHSLLQVKHRNINYNYCEGNVVTSNTTNSFISSNNKLRS

SEQ ID NO: 16359 - protein, 372 aa, Candida glabrata CBS 138
MSESELRQRQAEFTKELHGEGAESRTGLTALLSKNRNAQREAVSKYLRHWDGKTDKEAEDRRLEDYNEATHSYYNVVTDFYEYGWGSSFHFSRFYKGENFQAAMARHEQYLAYMAGIKKGDLVLDVGCGVGGPARTIARFTGCNIIGLNNNDYQIQKAKYYAKKYNLQDHMDFVKGDFMNMEFEPNSFDKVYAIEATCHAPKLEGVYGEIYKVLKPGGTFAVYEWVMTENYDENNEEHRKIAYEIELGDGIPKMFTVDVAKQALKNVGFEVEVSKDLADEDDEIPWYYPLTGEWKYVQSLSDIATFFRTSYFGRKFTNCMVSIMEKVGVAPQGSVEVTAALENAAVGLVEGGRKKLFTPMFLFVAKKPEDAK

SEQ ID NO: 16360 - protein, 392 aa, Carboxydothermus hydrogenoformans Z-2901
MNLEEKINPVLRQIPPSGIRKFFDLVANTKGVISLGVGEPDFVTPWYIREEGIYSLEKGYTMYTSNQGLLELREEISRYLLRLTGVAYDPVQEVLVTVGVSEGVDLALRALVSPGDEVLIPEPSYVSYGPTTMLAGGKPVYIRTRPENGFKLTPELLEEAITPKSKILLLCYPNNPTGAVMTADDLAKLLPVIAEHDLLVISDEIYAELTYEGKHVSVASFPGMKERTVILNGFSKAFAMTGWRLGYAAGPKEIIAAMTKIHQYTMLCAPITAQKAAIEALKNQNDAVKKMVEEYNYRRRILVEAFSEMGLWLFEPKGAFYAFPDISATGLSSEEFAERLLFEEKVAVVPGSAFGPSGEGFIRISYATARKDLIEALKRIKRFVRKKSLKKQ

SEQ ID NO: 16361 - protein, 455 aa, Synechococcus elongatus PCC 6301
MSSSAVLTWRQGDRLSLTIESLCDSGDGLGRVEGRVVFVPDTVPGDRIQAKLLQVRSRYARAELEGVLEASPDRIRPACIVADKCGGCQWQTVDYPAQVEAKTVIVQDAMQRLGQLETEVQPTIAAPYPLGYRNKVSYPLRRSDRGEVQAGYFRKGSHRLINLNQCPVQDDRLNPLLAGIKADIAARDWPIYDEQTRSRGLRHLGLRIGQRTGEILITLIATDDQLPEVEAQAEQWLTDYPNVVGVCLNLNPSHGNRILGDETHCLAGRPYLIECLDDLEFAIGPETFFQVNTEQAERLLPILKDFLRGSDRLFDLYCGVGTLTLPLASEVGSVLGLEILPESVVQAQQNADRNGISNVEFRAGAVEILLAQIPESPDAVLLDPPRKGCEPAVIEVLRDRQPQRIAYVSCNPATLARDLQALCAGDRYRLLLVQPLDFFPQTAHVETVALLELQD

SEQ ID NO: 16362 - protein, 281 aa, Ralstonia solanacearum
MARSTSGVHQGHQARKRFGQNFLVDDGVIHAIVAAIDPQPDDVLVEIGPGLGALTVPLMERVPTLQVVELDRDLVARLQRRFGDKLIVHAGDALAFDFGTLHVPGRSLRIVGNLPYNISSPLLFHLSAFADRVRDQHFMLQKEVVDRMVAAPGSKAFSRLSVMLQVRYYMELVLEVPPGSFNPPPKVDSAVVRMIPWPADKSPYAPVDMRALGTVVTLAFSQRRKVLRNTLGSLREVIDFDALGFDLGRRAEEVPVADFVAVANALPAERIAGGAPDLNED

SEQ ID NO: 16363 - protein, 358 aa, Oenococcus oeni PSU-1
MFGAIFGGALAGQLADRLGRRKMILISAIIFAVFSVLSAIAPNNGSYYLIIMRIFLGLAVGAASALVPAYISELAPAAIRGRLSGLNQTMIVSGMLISYIVDYILKGLPNQIAWRLMLGFACIPAIILYLGVMKLPESPRYLIKNGRLDEARKVMSYVRSSEGEINNEINQIKETAHKEQEAQKTSWSALFSGKYRYLVIAGVGVAAFQQFQCANAIFYYIPLIVQKATGQAATSALMWPIIQGVILVIGSLVFMWIAEKFNRRTLLMFAGTIMGLSFILPAIIRWIDPHASQMMIVVFLCLYVAFYSATWAPLTWVLVGEIFPLAIRGRAAGLASSFNWIGSWAVGLLFPIMTASMS

SEQ ID NO: 16364 - protein, 313 aa, Arabidopsis thaliana
MGANSLPTDATLDLDEQISQLMQCKPLSEQQVRALCEKAKEILMDESNVQPVKSPVTICGDIHGQFHDLAELFRIGGKCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMDGFNWAHEQKVVTIFSAPNYCYRCGNMASILEVDDCRNHTFIQFEPAPRRGEPDVTRRTPDYFL

SEQ ID NO: 16365 - protein, 502 aa, Zea mays
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 16366 - protein, 138 aa, Triticum aestivum
  misc_feature (68)..(68): Xaa can be any naturally occurring amino acid
  misc_feature (96)..(96): Xaa can be any naturally occurring amino acid
  unsure (1)..(138): unsure at all Xaa locations
MAPTVMASSATSVAPFQGLKSTAGLPVSRRSNGASLGSVSNGGRIRCMQVWPIEGIKKFETLSYLPPXLNTEALLKQVDYLIRSKWVPCLEFSKSXIFREHNASPGYYDGRYWTMWKCYFGCTDATRYQEVEEVKKDT

SEQ ID NO: 16367 - protein, 411 aa, Zea mays
MAALSAPLRAVAAGSRVAASDPVKVSCVRSTGSAHFGCAFPYIRASSSAARNLEPLRAIATQAPPAMPQYSSGEKTKIGINGFGRIGRLVLRIATSRDDIEVVAVNDPFIDAKYMAYMFKYDSTHGPFKGSIRVVDDSTLEINGKKVTITSKRDPAEIPWGNFGAEYVVESSGVFTTTDKASAHLKGGAKKVVISAPSADAPMFVVGVNENSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKTASEGALKGILGYTDEDVVSNDFVGDSRSSIFDAKAGIGLSSSFMKLVSWYDNEWGYSNRVLDLIAHMALVSAKH

SEQ ID NO: 16368 - protein, 485 aa, Mesorhizobium loti MAFF303099
MKTLKDKNLFREAGLIGGEWVAAGSGKTVDVIDPATQAAIGTVPDMAGSDTRAAIDAAASAYGDWKKKTNAERADLLEAWHGLMLAHLDDLALILTTEQGKPLDEAKGEIRYGASFVKWFAEEARRINGHTIPSPTQDRRIIVLKEPVGVCGIITPWNFPNAMITRKVAPALAAGCTVVIKPSEFTPYSALALGVLAERAGIPAGVINIVTGMPAEIGNEIMANETVRKISFTGSTRVGSLLMRGAADSVKRLSLELGGNAPFIVFDDADLDLAVEGALVSKFRNGGQTCVCANRILVQAGVYEAFAAKLSARVNAMTVGPGTQPGVAIGPMINMAAVEKINRHVEDALAKGAAIITEKPALPEGPQYVAPLVLSGATKDMQLAGEETFGPVAPLFRFETEEEAIALANGTPYGLASYFYTENLKRAWRVGEALEFGMVGLNTGSVSMEVAPFGGIKQSGLGREGAQAGIEEYLEMKSFHIGGLG

SEQ ID NO: 16369 - protein, 277 aa, Chlamydophila pneumoniae CWL029
MTRSSPAQLSRFLSEIQNKPKKSLSQNFLVDQNIVKKIVATSEVIPQDWVLEIGPGFGALTEELIAAGAQVIAIEKDPMFAPSLEELPIRLEIIDACKYPLDQLQEYKTLGKGRVVANLPYHITTPLLTKLFLEAPDFWKTVTVMVQDEVARRIVAQPGGRDYGSLTIFLQFFADIHYAFKVSASCFYPKPQVQSAVIHMKVKETLPLSDEEIPVFFTLTRTAFQQRRKVLANTLKGLYPKEQVEQALKELGLLLNVRPEVLSLNDYLALFHKMQAG

SEQ ID NO: 16370 - protein, 309 aa, Thermoplasma volcanium GSS1
MKVSAVLPNFLPVGEIRKLAASVLPDINIITDLDFKSDESDILIVTAFTKVDKALLDKFPRLKFIQVASTGYDNVDVTEVKSRNILMCNSPSSNKESVAEHVIGMALYFLKDFGHLDREIRNGNWPILTFSRDLMGKVFGIIGMGAIGRKLAERLIQFGVGIIYYDVKRLPEEVEDELGITYVTLDELISSADIISIHVPLTETTKGMIGRKEFEKMKDGCIFINTSRAEVVVTKDLVWALKQGKIKAGIDVYDREPPDFSSELFQMDNALFSPHIAGVTVESQRRFIEETVANVIRYMQGVDPLNRVL

SEQ ID NO: 16371 - protein, 134 aa, Arabidopsis thaliana
  misc_feature (32)..(32): Xaa can be any naturally occurring amino acid
  misc_feature (38)..(40): Xaa can be any naturally occurring amino acid
  misc_feature (44)..(44): Xaa can be any naturally occurring amino acid
  misc_feature (46)..(46): Xaa can be any naturally occurring amino acid
  misc_feature (53)..(53): Xaa can be any naturally occurring amino acid
  misc_feature (55)..(55): Xaa can be any naturally occurring amino acid
  misc_feature (81)..(81): Xaa can be any naturally occurring amino acid
  misc_feature (116)..(116): Xaa can be any naturally occurring amino acid
  unsure (1)..(134): unsure at all Xaa locations
KNRPAHASQKRRETTRIFFSSSILSSAAVNTXPGPATXXXPFTXLXSSPSFPXTXKTNKDITSISSNGGRVSCMKVWPPIXKKKFETLSYLPDLSDVEFAKEVYYLLRNKWIPFVXFQLKHRFLYREHGNTSGY

SEQ ID NO: 16372 - protein, 288 aa, Synechococcus sp. RS9917
MSSPPIQWYPGHIAKAEQQLRRHLDKVDLVIEVRDARIPRATGHPHLNRWINGKQHLLVINRRDMVTAEARDAWQQWFKGQGQSTVWCDAKAGTGVKQLQQAAIRAGDQLNERRRNRGMRPRAVRALTLGFPNVGKSALINRLVKQKVVASARRAGVTRTLRWVRLGQDLDLLDAPGVLPPRLDDQRAALHLALCDDIGQAAYDGEWAAQSFLRLLAVLEPRQGSGVSLPLLETRYGIPLAGDTADPALWIQAAAARHTSADTARMSQRLMDDFRKSVLGSIALELPV

SEQ ID NO: 16373 - protein, 334 aa, Salinibacter ruber DSM 13855
MSIKLGINGFGRIGRLCFRALLEREEDEIEIVGINDLTDAETLATLLKYDSVHGQFPGDVHLEDSTLVVDEQEFPVFSKKDPTNLPWGDHDTDVVIESTGVFRTYDKASQHLEAGADQVVISAPAKSEVDAMVVLGVNDEILTGDEKVVSNASCTTNCLAPLVKVLDDAFGVESGLMTTVHAYTASQNIVDGPHGDLRRARTAAESIIPTTTGGAKAVGKVLPHLDGALDGMAMRVPTPDGSVTDLTAVVEQDVTVEDVNEAFYEAANGALDGILAYSDDPIVSRDIIHDPHSCIYDAPWTKVAGSQVKLVGWYDNEWGYANRTVDLVERLMNV

SEQ ID NO: 16374 - protein, 263 aa, Vibrio angustum S14
MKKITIADLNNWKKLGEKFASITAYDASFAKIFEEQGLPVIVVGDSLGSVIQGKPTTLDVSIDELVYHTKCVRAGSPNTFIISDLPFMSYHTPDAACESAAKLMKAGANMVKIEGGSWLTDTVKMLTERAVPVCAHLGLMPQAVNLYGGYKVQGRTEEQATEMLETAKELQRAGAQTLVLECIPAKLAQQITLELDIPVIGIGAGNDTDGQVLVMHDILGVSANYIPRFSRNFLAETGSIEAAVIKYIDEVKQQTFPEEKHSF

SEQ ID NO: 16375 - protein, 319 aa, Alkalilimnicola ehrlichei MLHE-1
MRSAFLDRDSLDQGDLDLAPLEQALPDLRHYERTGAHEVADRIADLNAVVVNKVVLDEAALAAAPDLRLILVAATGTNNVDLAAARQRGITVCNCRGYGTDAVAQHTLGLMLALSTRLLDYHNAVQAGEWGRSEQFCLLDYPIQELSGRTLGLVGHGELGQRVAELARALGMTVKVAARPGGGPPALGRVPLEQLLPQVDVLTLHCPLTDATRNLIGAEALQRLPRHALLINCARGGIVDEQALADALRAGEIGGAGVDVLSEEPPVNGNPLLAGDIPNLIVTPHSAWGSREARQRIVMQLAEAARGYLDGHPVRVVSE

SEQ ID NO: 16376 - protein, 443 aa, Crocosphaera watsonii WH 8501
MNLPPTLSQPRLLRLFKLIFYPLDYLEDNYQRYGDIFVAGKSETPFVYISNPQGIQTILTRDKTDFKTGGGSGFLSTLLGDNSLLFLQGERHRRERKLLMPPFHGERLKSYANLIYSISDKVTDKLQINRSFNVRDIMQEITLKVILKAVFGITEGERYQRLQELLKSWLSFFDSPANAILIFFPWLRKNWGNWTPWGRFLQIKAEIQELIYTEIRERREQKKYEGTDILTLLMLAKDEEGKPLSDQELHDELITLLIAGHETTASALTWALYWIHFCPDVEDKLRFHFSNLNNNTDLLDIVKLPYLDAVCKETLRIYPVLLTTFIRVLQTPLELMGYQFKPGTVFAPAIYLVHHREDIYPNSQQFRPERFLERNFSPYEYFPFGGGSRRCIGMELAKMEMKIVLYTILSKHKLKLPSSRPLKAVRRGLTVAPPSNFKMILSN

SEQ ID NO: 16377 - protein, 251 aa, Pseudomonas fluorescens PfO-1
MRRPMVAGNWKMHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 16378 - protein, 582 aa, Candida glabrata CBS 138
MGNTTSIESKIDFGQNRHVKPHLKNNNHVDDIYKRDTLPPSMAQMEPRSPILVVNGKHLTDIKEIANISSQIPETMMAANAEAASLQESLSNEERAAYLPTFSKSSSYVSSLHSRKSSLLSNSTTLGTPATSPGLNESSSSLANDYFASKRRPSLPDQTLGQHLTRPSLLDSHRSYSSDNCLSTINSNSTELQNTTTHHNDRLRDIFPFSRPKSPNGFEIRIPLSSDDVSSSSESKLSLHRHHSSKDIPGDQTGYVMINGKRKKQVNIDEAIQRLLDVGYSGKKNKAFCLKNSEIIQICIQAREVFLNQPALLELSAPVKIVGDIHGQFQDLLRLFTKCGFPPSSNFLFLGDYVDRGKQSLETILLLLCYKIKYPENFFLLRGNHECANVTRVYGFYDECKRRCNIKIWKYFIDTFNTLPLTAIVAGKIFCVHGGLSPVLNTMDEIRNMSRPTDVPDFGLINDLLWSDPIDSPNEWEDNDRGVSYCYNKVAINKFINKFNFDLVCRAHMVVEDGYEFFNDRTLVTVFSAPNYCGEFNNWGAVMSVSQELLCSFELLDPLDSNSLKQVMKKGKQERDLANSFD

SEQ ID NO: 16379 - protein, 345 aa, Candida glabrata CBS 138
MPVATERRASMDDFDTDIITLPRFIVENQKTVKTARGDFSLVLNALGFAFKFISQTIRRAELVNLIGLAGASNSTGDEQKKLDVLGDEIFINAMKGCGFIKLLVSEEQEDLIVFPTETGTYAICCDPIDGSSNLDAGVSVGTIVSIFKLLPGSTGSIKDVLRSGHDMVAACYAMYGASTHLMLTMGNGVDGFTLDTNLGEFILTQPNLRIPQLRPIYSVNEGNRLYWDELIVSFIDSLKEGQESNKGKPYSLRYIGAMVADVHRTFLYGGLFSYPGDRLKPDGKLRLLYEAFPMAFLVEQAGGKAVNDQGERILDLVPKHIHDKSSIWLGSSGEIDKFLKHIGKE

SEQ ID NO: 16380 - protein, 840 aa, Erwinia carotovora subsp. atroseptica SCRI1043
MSDSSNKSGSSEKSGLSKRSVAAKKSDALTQPVSPTHSAIAFDAPQFAASLLRQQRLGGVASLKAMTPVQCWRAVSLALAEQLLTHTASPTPPASNTPQRHVNYLSMEFLPGRLTGNNLLNLGWYDAVATALAEQGLNLSDILEQETDPGLGNGGLGRLASCFLDSMATVGQPATGYGLNYQYGLFRQHFAQEQQQETADDWQRDTYPWLLPRADLAVDVGFGGRLQPQTDGSLRWLPDTVFRGEACDLPVIGYHNGAAQPLRLWRATHRDPFDLTLFNEGHYLRAAQAGISAASLTSVLYPNDNHTAGKRLRLMQQYFHCACSVADILRRHLNAGRALSALPDYEVIQLNDTHPTLAIPELMRLLLDEHQMSWDEAWSITGRTFAYTNHTLMPEALERWDERLFSRLLPRHLSIIRQIDTQFRAQVEDKWPGDRLVWAKLAIRHQRQIRMANLCVVSCFAVNGVAALHSELVVTDLFPEYHQLWPTKFHNVTNGITPRRWLKQCNPALSALIDDTLHTPWVNDLPALQGLEPYADDAGFRERYRQIKADNKTQLATYLRQQYDIVVDPQALFDVQIKRLHEYKRQHLNLLHILALYRQLRDNPHLDIVPHVFLFGAKAAPGYVLAKNIIYAINRVAAVINQDRRVNDRLKVIFPADYRVSLAERMIPAADVSEQISTAGKEASGTGNMKLALNGALTVGTLDGANVEMAQQVGEDNLFIFGHTVEQVKALQAQGYKPSDYLAVTPLLREILSELASGAFSQGDKDAFAPLLDSLLKQGDPYMLMADFAPYCEVQQRVDALYREPDEWTRRCVLNTARMGMFSSDRAIHDYQTRIWQAHR

SEQ ID NO: 16381 - protein, 485 aa, marine gamma proteobacterium HTCC2207
MQLHDNSLLKTQAHIDGQWVDADSGETLAVVNPANGETIAEVVKCGTAETRRMIEAAAVAQKQWAKSTIKERAAVLRRWFDLVMENQEDLAQILTAEQGKPLAEARGEVAYGANYIEWFSEESKRVYGDTIPQPSNDKRIVVIKQPVGVVACITPWNFPNAMLTRKIAPAIAAGCAVVCKPANATPLSALALMELAVRAGFPRGLMNIVTGRTAQIGAELTGNPLVRKVTFTGSTPVGKQLMAECAQTVKRTSMELGGNAPFIVFDDADIDAAVQGTLVSKYRNAGQTCVCSNRIIVQAGIYDEFVRKLTVATQNLVIGNGTEEGVTVGPLIDEKAANNVCDFIDDAVTKGAKVALGGGRSDLGGAFVLPTILTDVSRDMRVFSEEIFGPVAPVFKFETEAEVVAMANDTEFGLAAYFYSRDIGRVWRVAEQLEYGIVGVNEGVISNEMAPFGGVKESGSGREGSKYGMDDYMDLKYICMGGIDQ

SEQ ID NO: 16382 - protein, 268 aa, Desulfovibrio vulgaris subsp. vulgaris str. Hildenborough
MTQASIARTVLIIEDSPVQAKIIRKQIQAYTQFDVRVAHSLADAEDVLREAHDTIFVAVIDLNLPDAPDGEAVDLCLHWQMPSIVLTATFNEDIRRRFIERRVVDYFFKGSIQDMDPMVTSIERVFKNRFVHALVVDDSRTQRGIIRQLLEVQCVNVLEAENGVEGLAVLEANPQVTLVITDYQMPEMDGIELVRELRQRHRMDKIAIVGVSAVGSGPLTAQFLKHGANDFLTKPFEVEEFYWRVNQTLEGLDLMCDLRSCREQLESR

SEQ ID NO: 16383 - protein, 254 aa, Chlamydophila pneumoniae CWL029
MTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 16384 - protein, 485 aa, Thermoplasma acidophilum
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 16385 - protein, 903 aa, Lycopersicon esculentum
MEVDNCWNIRLVNCVIICLVIYIQSAFAQEGFLSIQCCATANFTEPRTNLSWISDGIWFPENQSCISRPVYKSEHYERARSFSSDISHKWCYSLPTRKEHDYLVRGTFLSVKQEKTLPHSSFVVLIGVTPIATVKSSDELKVEGIFRATRSYTNFCLLKKKGNPYISKVELRPINSDYLKKEPSEILKLVHRVDAGNKAAEIRYPYDQYDRIWRPASNLESQVTQTPPSIIKHVFARKHSLLPPAFVLRTALTHPERLDFLHEDLDTGYYTYSLFLYFLEPNDSVQAGERVFYIYINNEKRLKVDILASGSRYLDVVLNFRANRSVNLTMIKASNLSQLGPICNGYEILKALPRVKETATEEVDIMANVKKELLQQNKNNEIWKSWSGDPCLPLPWPGLTCDRVNGTSVITQIDLSSGGLSGPSPPSIQKLMHLRKLNISINGSSGTNSLFTSYFTYSTRYLSSRIHISNKLSRSIKESNITTDKGMANVKQNSSSTHKLVIGAAVGTALLVILAIVISVVCLFKRRVMAGPKFLMRNYSITRNAVYSVPSMDTTMMKSISSRNFKLEYIEAITQNYKTLIGEGGFGSVYRGTLPDGVEVAVKVRSATSTQGIREFNNELNLLSAITHENLVPLIGYCCENEQQILVYPFMSNSSLQDRLYGGAAKRKILDWPARLSIALGAARGLLYLHTFSERCLIHRDVKSSNILLDQSMCAKVADFGFSKYASQEGDSGTSLEVRGTAGYLDPEYYSTQRLSAKSDVFSFGVVLLEILTGREPLNINKPRNEWSLVEWAKPLIRSSRVEEIVDPTIKGGYHGEALWRVVEVALACTETYSTYRPCMADIVRELEDALIIENNASEYLKSLDSFGGSNRFSVERSIVLPPIKSQTEPSSLLSKPAPPQPR

SEQ ID NO: 16386 - protein, 109 aa, Triticum aestivum
MASSSNPVSMDMDPPVVSIAVEHGPPESRLVQLGVRSWPKWGCPTGKFPVKFDARQTCYLVKGKVRAHIKGSSECVEFGAGDLVVFPKGLSCTWDVVAAVDKYYKFDSS

SEQ ID NO: 16387 - protein, 548 aa, Ustilago maydis 521
MSYSPNEKEKTDSLKGEVVATLEDGVGTNTTNAFDQRKGEELKHALLPRHMAMISIGGVIGTGLFLGTASSLHNAGPLGLWLGYLIMGSVCYAMMMCLGEMISYLPVPGGHIKLSERFVGRPLSFAMGWNYWYNWVIVLPAELSAAAVLMSYWSDASPAIWISVFLVVVVAINLLGTRAYGEAEFWFASIKIITIIGLIILSICIDLGAGKQGRIGFRYWKNPGPFTQYHGIKGSLGQFLGCFSVLINASFSYIGTEIVAIASAEAKNPRKSVPSAIRKVWIRICVFYFLGTFMIGLICASNTPELTAGKKTAARSPFVIGIQQAGWRVIPSIINGALVTSAVSAASSDLFTSSRALYSLAISGSAPRVFARTTRGGLPYVSVAVSVVFSFLSYMSVRDGASTVFGYFANMTSIAGMVTWFCIGIMYLRFHKAMKVQGMSRDVLPYQSWLQPFCGYWTVSSTFVVMLFSGWSIFLNGNWSTSDFITNYIPIPFFIILYLGNWFYNRNNRAHIPANEVDLITGLREILDAEQPDEKPTTIGGKIWAFIS

SEQ ID NO: 16388 - protein, 923 aa, Lupinus albus
MEHQHSWILRLVSYIICLYIFIRSASATEGFESIACCADSNYADPLTTLNYTIDHSWFSDKGSCSQISKNVTNYGSNENVRLFDIDEGKRCYNLPTTKNGVYLIRGIFPFGELSNSSFYVTIGVTQLGSVISSRLQDLGIEGVFRATKNYIDFCLVKEKVNPYISQLELRPLPEEYIHGLPTSVLKLISRNNLKGEGDDIRYPVDKSDRIWKGTSNPSYALLLSSNATNFDPKTNMTPPLQVLQTALTHPEKLEFIHNDLENEGYEYRVFLYFLELNSSLKAGQRVFDIHVNSEAKVERFDILAEGSNYRYTVLNFSATGLLNLTLVKASGSENGPLMNAYEILQVRPWIEETNQTEVEVIQKLRKELLLQNQDNKVIESWSGDPCIIFPWQGIACDNSSVITELDLSSSNLKGTIPSSVTEMINLKILNLSHSSFNGYIPSFSMSSLLISIDLSYNDLMGSLPESIPSLPHLKSLYYGCNQHMSEKVPANLNSSLIKTDCGKCQADNPKFGQIIVIDAVTCGSILITLAVGLILVCCYRLKLTPSEGFGEKNYPMATNIIFSFPASKDDFFIKPLVVTIQIFTLEYIEVVTERYKTLIGEGGFGSVYRGTLEDGQEVAVKVRSATSTQGTKGFDNELNLLSAIQHENLVPLLGYCNEKDQQILVYPFMSNGSLQDRLYGEPAKRKILDWPTRLSVSLGAARGLAYLHTFPGRSVIHRDVKSSNILLDHSMCAKVADFGFSKYAPQEGDSYVSLEVRGTAGYLDPEYYSTQQLSEKSDVYSFGVALLEIVRGREPLNIKRPRNEWSLVEWAKPYIRASKIDEIVDPGIKGGYHAEAMWRVVEVALQCIEPMSAYRPCMVDIVRELEDALIIENNASEYMKSIDSLGGSNHYSIVMEKRVLPSTSSSTAESTITTQTLSQPQPR

SEQ ID NO: 16389 - protein, 688 aa, Zea mays
MAMPSLLRFLVLLTAGAAVSQVVAAWVDCGDASPSPPPYSSSPSPSPSSTPANGSSNAPFRANLMTLLDALPRAAAPTGFASLSLGAGRDRAFVRGLCRGDFDPPRCLAELQEAVRTLGGSCPSSSRRGAVWLDVYVAYADTNVSTPREDDVRMVLYDTRLVAHPAAYLQAYSALMGTLVARAVGGGGGEAGTSRQFFATGEANYASDDPNGTMPRCRSCRACKGNQGGVVLAYNCYLRIQVYTYYDLALDAPPPAAEPAPPVPSPPPAGETSGTGTRPRNTIVLLAVVVPLGTLLLLAFVVAGVYLRRRRGVVVEERGRERGCTAVEDEPSMTYVHPEKFTLAALRVATGNFAAGNKLGEGGFGEVFKGRLEDGHPVAVKRLSKGSSQGFDELKNELILAAKLKHRNLVQLLGVCLEESEKLVVYEYVPNRSLDTVLFDAGRRPQQALEWSERYKIIRGIARGLLYLHEESRLRIIHRDLKPSNVLLDSDMTPKISDFGLARAFWGDESRGVTRRPVGTLGYMAPEYAYYGHVSTKSDMFSFGVIVLEIMTGQRNSSPSVEDGSSNRNLLSYVWDQWRRGSVAEVVDASPCAGGQCAGTEALSCVQIGLLCVQKDPRSRPDASEVVLMLEGRCAIQQKPSRPAFYSGHISVASARRAARGSAVSYGRLSAIGTVSENGVTVSELDPR

SEQ ID NO: 16390 - protein, 618 aa, Methylobacillus flagellatus KT
MAEPQISSLLLQSAIYLGAAVIAVPVFRRIGLGSVLGYLFAGVVIGPWGLGLVADAEAVMHFSEFGVVMMLFLIGLEIEPDKLMALRLPIFGMGGLQVVLTAALVYGAGIAIGLDWRLSLVAGMGVAMSSTAIAMQILTEQGALNRPSGRSAFSVLLFQDLAVIPIMILLLVIAPGAHTAHGVHMDWFAILKAVSLVVLLVLGGRYLLRPVLRYTANTKLREIFIAFALFLIIGVSILMTLVGLSMALGAFIAGVLLADSEYRQELELDIEPFKGLLLGLFFISVGMSINIDLILQQPELVLGLALVLVLFKLVLLFCLAKVFRLDNAGGLMFAVTLSQVGEFAFVIFSAALDAKVISGEHGALLNSVVALSMVTTPLLLLGFRGVYRRRLQQRRSSRGHDEFEEARPVIVAGFGRVGQIITRLLTSVGVEPTVIEHDPNQIELMRSFGYHAYYGDITRPDVLRAAGIANARLLILAIDDADAALETARYVREHYPQVKILARARNRTYVFDYMDMEIDCVRETFLSAVHLGEKALREMGYSPFHAYRTAWKFRQDDEKLMHNLHPIHTDMQKVVSYSVRTRQDLQRTLSREMEDAIAGQGRNAWEGRPPSDTPEEKG

SEQ ID NO: 16391 - protein, 230 aa, Vibrio angustum S14
MKNTRIVLLRHGQSVWNKENRFTGWANVSLSELGENEARNAGIKLKENGFNFNFCYTSMLDRAIKTSNLALEQLDSLWIPVEHDWQLNERHYGDLQGLNKAETAEEFGDEQVHIWRRSYDIEPPQVSEDSFFYPGNDRRYQELQHSQLPHGESLKDTYDRVIPFWNESIVPNVKQGSDILIAAHGNSLRALIKYLDNIPDDKITKLEIPTGAPLVYEFNEQMKPVKSYYL

SEQ ID NO: 16392 - protein, 787 aa, Zea mays
MDDLPGDEGRSQTHPSDRNWPSHLEQKFQSLPLTKQERNFDSAYSSLDSREVGHSLQAAQTLWSSGSLSGPIPNGFYSIIPEKRLKEHFDTIPSPDDLYSLGIEGFKAEIILVDIERDKKLSALKQLCTALVKGLNSNPAAMIKKIAGLVFDFYNRPNPHLSPARTSSEDLSNLLENRGVQLLGQIRHGSCRPKAILFKVLADSVGIDSKLLVGIPNEEPHGYDNSSKHMSVVVILKSAEFLVDLMRFPGQLVPFSSKAVVTSHMSATGESDSADYDSCDSPLEPNSPLCAQRQEQDDGNRSFKVLSLRNIMLKSTNSMEGKMSCSSHSEPNVANAFCGRSRDPVVDEHQRTASSSPEHPLSRVRGRSMLGDKQYGGAVAVSRSDGASTSNTHRARRSTNITPEISDDIVRAVRAMSESMRQNRLSREQKDGSLGSSNDSMKHEPAGDSNDDEASTRRPSALEGLRRQFNSQKAVSLPSSPNRSGILGLRSPSDYTEADLMATWNEVLQSSPFLNKPLLPYEEWCIEFSEITVGIRVGVGFFGEVFRGLWNGTDVAIKVFLEQDLTTENMKDFCNEISILSRLRHPNVILFLGACMKPPHLSLVTEYMEVGSLYSLIHSKTQKTKLHWKRRLKMLRDICRGLMCMHRLKIVHRDLKSANCLVNKYWTVKICDFGLSRVMSNSAMNDNSSAGTPEWMAPELIRNEPFTEKCDIFSFGVIMWELCTLCRPWEGIPPVQIVYSVANDGARLEIPDGPLGSLIADCWAEPERRPCCQEILTRLLDCEYTLC

SEQ ID NO: 16393 - protein, 1110 aa, Candida glabrata CBS 138
MTQELRKRSFEHVDELLNQASNEVNYDSNKRVRRHEYSAMTQYSSMPNSRVDTEADAALGRRVDCAHRDIGLISPPPGYIKKLTLHNFMCHRNFDVELGPGLNFIVGKNGSGKSAILTAITIGLGAKASETNRGSSLKDLITAGCNSSRITIYLSNSGIGAYVPKGKQYGDTIIIERTISRTSTAGFSLKSENGTEISNKKRDLQEILDYFAIPISNPMCFLSQDSARSFLTASTPTDKYNHFVKGTLLQQIKDYLERATEVHNESAAAMELHTESLRELQERYDKAKTDLRQISKTSDLNERLKLLTGKSLWLNVDENVMNINKLKNKISHYENEISKLTEKSDSRMNQIDSLKSEITIIEQGLSGKLSKMVEKEEQFQLMNEKIREAKSKYEQEENNEKEILDNIERCKSIIKKLNKSISELQEKQEKEQGGDKDNMLQEIEKLTASNSELKKDIEAYMTKIQDINAKLRTVKMESLKTIDSIDTQIREKQNEVKDIKHGRTNFLRNFDNNMEHLIKEISNNKSKFDNLPIGPLGNYVSIKSGYEKWAPSIQRYMTTTLSSFVVSSHRDNGLLRQLMKKCNVRSSNFSIINYKLQNAHFFDNNKLNQKYPTILDALDFIDGNLAAVFVDMNKIDRVLLIENMSEARKFLLENGGDTKVALSIRDNNYGYQLTGGTRIDSVKYQDKIRVKVGTSSEDNIAYINTVIRNLQEEKQSTQSRYKDRLQIINNELKECETALVHTKDTYRANNEKIKSFKTNITREVDTGKLNMQIEEKKNQEVAVESYLETRKSIQLHLADMVEDIKPLQEQYMIYKNELDQSKTEIENDRELLRRSKDKILKYQDHIKELLESVKNIEKNIPKIADNIRVLEDGVGLQKQKAQEICPRAELSNDLPHSQEEIKQEITNIQQKLQEAEKMMGMSQQQIVDNYNNAKTKFIDASKKYKVIEEVLGKLTRTIKIREQNLERTQQITFFEADNDFKASMRIRKFAGHLDFDKKEKKLSILILTPNDDRYREVSTFSGGEKSYSQMALLLATWRPMRSRIIALDEFDVFMDQVNRKIGSKLIVKKLKDIPNTQTIIITPQDIGGIAEIDDSVRILRMRDPKRTTIN

SEQ ID NO: 16394 - protein, 409 aa, Pholiota nameko
MFFSVVVSSLAAIALATPFFSPNDPTSQLFDRANLISSGYSTTGTQSCHNTSSVSNLCCFEAPGGLLLQTQFWDTNPSTGPSDSWTIHGLWPDHCDTTFSENCDSSRDYTGIGTLLSNNGASDTLAFMQTHWVDINGQNEQFWEHEWATHGTCMSTLKPSCLPSGSVKGAEAVAFFQTVVKLFQTLPTFTFLSNEGITPSTTKTFTLSQLTTALKAQTGFTPALDCSSGALNQISWYFNLKGSIIDGTFVPINAPETGSCPSSGIKYPPKSGGSSTTTTGGSSPTGTPGSLPGKATIHAISSSGTVGGLLSAGTWSTQTLATYTITGTASSFTMTSSKGNCGVSGTTFSCGSGVTTTSFSAVTSGSDLLLASGGSTSFSSDGVPSGSTVFTVFTGTSHTDRYTLSIIST

SEQ ID NO: 16395 - protein, 599 aa, Mesorhizobium sp. BNC1
MEAALDTYYQPLLLLGAAVIAAPLFKRLGLGTVLGYLAAGIAMGPVARLISDGEDLLPIAELGVVFLLFLIGLDLNPSRLWAMRRQIFGLGAAQVVVTGAVLALAALVFFGLSPAAAVVIGFGLALSSTAFGVQIMESEGTLNRPYGRTAISILLLQDLAIAPLLALIPLLSPGGEGAEDITFSGFALALACVAALILAGRYLLNPLFRLIGSTGAREAMIAAALLVVLGSATLLQVAGLSMGLGAFIAGVLLADSSYRHELTADIEPFRGILLGLFFMAIGLSLDLDVVLENWLLVLGLVPAFMLAKAVLLYGICRLFGCQHNQAVHVASLLPQGGEFGFVLFTAASAALIFSPETASLLIAIVTLSMAMTPAVVRMGALLMLPEEREEIDETFDGAGSEILMIGFSRFGQVASQILLAGGVDVTIIDHSATRVRSVEKFGFRIYFGDGRRKEVLEAAGINKAKVVAVCTNVRATTDAIVNMIRSEFPHVKLYVRSYDREHTLSLKARGVDYEIRETFESALVFGQRSLTELGTSEEVALEIVEDVRRRDEERLAIQAVEGIQAGGDRMHVRPVTPEPLTKPAREARRLDPAVKENSG

SEQ ID NO: 16396 - protein, 207 aa, Platanus x acerifolia
MPQGDYIELHRKRHGYRHDHFERKRKKEAREVHKRSAFAQKALGIKGKMFAKKRYAEKALMKKTLAMHEESSTRRKVDDNVQEGAIPAYLLDRETTTRAKVLSNTIKQKRKEKAGKWEVPLPKVRPVAEDEMFRVIRTGKRKTKQWKRMVTKATFVGPGFTRKPPKYERFIRPSGLRFTKAHVTHPELKCTFNLEIIGVKKNPNGQM

SEQ ID NO: 16397 - protein, 409 aa, Pholiota nameko
MFFSVVVSSLAAIALATPFFSPNDPTSQLFDRANLISSGCSTTGTQSCHNTSSVSNLCCFEAPGGLLLQTQFWDTNPSTGPSDSWTIHGLWPDHCDTTFSENCDSSRDYTGIGTLLSNNGASDTLAFMQTHWVDINGQNEQFWEHEWATHGTCMSTLKPSCLPSGSVKGAEAVAFFQTVVKLFQTLPTFTFLSNEGITPSTTKTFTLSQLTTALKAQTGFTPALDCSSGALNQISWYFNLKGSIIDGTFVPINAPETGSCPSSGIKYPPKSGGSSTTTTGGSSPTGTPGSLPGKATIHAISSSGTVGGLLSAGTWSTQTLATYTITGTASSFTMTSSKGNCGVSGTTFSCGSGVTTTSFSAVTSGSDLLLASGGSTSFSSDGVPSGSTVFTVFTGTSHTDRYTLSIIST

SEQ ID NO: 16398 - protein, 815 aa, Erwinia carotovora subsp. atroseptica SCRI1043
MNSPFIYTSPTISVEALKHSIAYKLMFTVGKDPSIANKHDWLNATLLAVRDRMVERWLRSNRAQLSQDVRQVYYLSMEFLLGRTLSNALLAMGLYEDLKAALDGMGLELDDLLQEENDPGLGNGGLGRLAACFLDSLATMALPGRGYGIRYEYGMFKQNIVNGKQAESPDYWLEYGNAWEFPRHSTRYKVRFGGRIQQEGSKLRWLETEEVIACAYDQIIPGFDTDATNTLRLWGAQASNEINLGKFNQGDYFAAVEDKNHSENVSRVLYPDDSTYSGRELRLRQEYFLVSATVQDILNRHWMMHKTYANLAEKFAIHLNDTHPVLAIPELMRLLIDEHKFKWIEAWAVVKKVFSYTNHTLMQEALETWSVDMLGKILPRHLQLIFEINEHFLEYVQKEIPDDNELLARVSIIDENNGRKIRMAWLAVIASHKVNGVSELHSDLMVQSLFADFARIFPNRFCNKTNGVTPRRWLALANPSLSKLLDDTIGQTWRTDLSQLSELKQHIDYPAFVQKISKVKLKNKVRLATYMAENLNIVVNPESLFDVQIKRIHEYKRQLLNVLHIITLYNRIKDDPEVERVPRVAIFAGKAASAYYMAKHIINLINDVAKVINNDPALHDRLKVVFIPNYSVSLAQLIIPAADLSEQISLAGTEASGTSNMKFALNGALTIGTLDGANVEMLEHIGEENMFIFGNTADQVEALRQSGYNPRQYYDQDEELHRVLTQITTGVFSPDDSRRYSDLFDSLVNFGDYYQLLADYRSYVDTQDRVDELYQNKDEWARCAVQNIASMGYFSSDRTIGEYAEDIWNIKPIRL

SEQ ID NO: 16399 - protein, 252 aa, Platanus x acerifolia
MHHSVSWMAMAAVAAAFLQLCSSVENVETSHLEADRINKLPGQPQVSFQQFSGYITVDERKQRALFYYFVEAEKDPASKPLVLWLNGGPGCSSIGVGAFSEHGPFRPSGEILIRNEYSWNKEANMLYLETPAGVGFSYSTNTSFYKAVDDEITAKDNLVFLQRWFIKFPLYKDRDLFLAGESYAGHYVPQLAQLIVQFNKKEKLFNLKGIALGNPLLEFTTNLNSRAEYLWSHGRISDLTYRVLTSACNYSR

SEQ ID NO: 16400 - protein, 554 aa, Glycine max
MAKKKEKKVNVSGKPKHSLDVNRSNDAKKESRSAATVRRLKMYNTRPVRDRKGKVLSHELQSKELPSTRIQPDRRWFGNTRVVNQKELEFFREELQSRMSSNYNVILKEKKLPLSLLNDHQKQARVHLLDREPFQDAFGPKTKRKRPSLMAADYESLLKKADGSQDAFEQKYGSSVSAEANDEDGFRDLVRHTMFEKGQSIRLWGELYKVIHSSDVVDQAAESMVLDARDPPGNACYHLEKHLKENCKHKHMVLLLNKCDLVPAWATKGWLRVLSKEFPTLAFHANINKSFGKGSLLSVLRQFARLKRDKQAISVGFVGYPNVGKSSVINTLRTKNVCKVAPIPGETKVWQYITLTKRIFLIDCPGVVYHNNDTETDVVLKGVVRVTNLKDAADHIGEVLKRVKKEHLERAYKIKEWDDENDFLLQLCKSSGKLLKGGEPDLMTAAKMILHDWQRGRIPFFVPPPRQEDLSEEPNVNGVDLDDSVDGNEASAAMKAIADVLSSQQQINVPVQNDLYSEKELKGEATDQHPNTNANEEILALDSNTSEEDPISEP

SEQ ID NO: 16401 - protein, 353 aa, Zea mays
RDLRPGCLGSLGAQLTGSRCRDAAKSLVRMLGANLEDQWMQTMNLAVTNWIVELRSSSRSSGPPSPLFSYAVSASGLWKVQLYCPVIAMGMEEAAETPQDERLLFSLIYQQVECVIQLAYRTTRRDNWIDVEVKVDNVRCDVDSLVSETLMAERGYGSEEKHFPSRVMLQITPTQQSDVLSVSVGKSNDNPTHEFGIEKGFEGSFEPPNAFGLKASVTESLTLAMKPWKFEQSVHGNTATLNWFLHDGVNGREVYSSKPSKISLLQPKAWFRDRYSNAYRPFTKQGGVIFARDEYGDSVWWKVCGATLGQTMNWQIRGWIWLTYWPNKQRTFHNETRWLEFRECLQLPLTKFP

SEQ ID NO: 16402 - protein, 480 aa, Photorhabdus luminescens subsp. laumondii TTO1
MSRRLRRTKIVTTLGPATDRDNNLEKIIAAGANVVRLNFSHGTAEDHLQRASKVREIAARLGCHVAILGDLQGPKIRVSTFKEGKIFLNIGDKFLLDANLGKGEGDKEKVGIDYKGLPTDVVPGDILLLDDGRVQLKVLDVQGMKVFTEVTVGGPLSNNKGINKLGGGLSAEALTEKDKEDIITAARIGVDYLAVSFPRTGEDLNYARRLARDAGCETQIVAKVERAEAVSSDKTIDEIILASDVVMVARGDLGVEIGDPELVGVQKKLIRRARQLNRVVITATQMMESMITNPMPTRAEVMDVANAVLDGTDAVMLSAETAAGQYPAETVAAMARVCLGAEKMPGLNVSKHRLDTIFDSIEEAIAMSTMYAANHLNGVKAIIAMTESGRTTRIMSRISSGLPIFSMSRHEKTLNQTALYRGVTPVYCSSHTDGITAANEAVNRLRDKGYLVSGDLVLVTQGDQMGTIGSTNTCRILEVE

SEQ ID NO: 16403 - protein, 651 aa, Thiomicrospira crunogena XCL-2
MYEQISHSLLNDILNQIKPDIYEQDLRHFYTRLGANFYAIHSLFDRLYGNRPDFKQQSLRLVETMARQYIKRPDKLKDLDIEREDDYNWFLSQEWVGMALYSNGFANDLKGMKEHLNYFQELGVNLVHIMPIMKCPEGRSDGGYAISDFREIDERIGTLQDLNELSSEMQQRDLLLVLDVVLNHTSDEHEWAQKARSGDPVYQDYYYTFESRNIPDMFEQSMLEVFPETAPGNFTWDEEMQRWVMTVFNDYQWDLNYSNPAVFIEMLDVILFWANQGADILRLDAVAFLWKKIGSTCQNEHEAHLILQLLKDCCQVTAPGVLFIAEAIVAPVEVTKYFGEDAVIAKECEIAYNATFMALMWDAVATKNAKLLNQGIKSLPVKLERATWLNYVRCHDDIGLGFDDNDIIKAGYEPNSHRRFLIDYLTGKFDESHARGLPFGENAKTGDARISGSLASLVGLQYAMETGDIEATEDAVKIILLLHSMILSFGGIPLLYYGDEIGTLNDDAYLSDPNKMDDNRWVHRPHIDWEKTERRNSTGTVEYQIFSALKKMIAVRKEINVFSDFNNRELIEVDNPNLFVISRFDPHKFSDRVLVVANFNSKPQSLNLEEVSSWGSYQNGELMDLYTRQSPEIFNNALIVPGFSFYWLYEM

SEQ ID NO: 16404 - protein, 451 aa, Thiomicrospira crunogena XCL-2
MNHDIESKKQALKDMGVKYCLGAYVDIHGIPKGKFVPIDHLGHMLEGSELYTGYALDGLGQMPNEDEIASVPDLDSLIQLPWQPEVAWMAADNTLHGEPYEINTRVALKKVLAEAEEMGFGFNLGIECELFVLKEEEDGSLSVPDRDDKLIKPCYDVRSFMNRFTWLDKMSTTINDLGWDLYSLDHEDANGQYEFDFQYSDALTMCDRFIFFRYMAKHYAQEEGLLATLMPKPFADKTGNGAHFNMSLFDKETGKNVFACDPKDDPRGLGLTELGYQFIAGVLKHGPALCAVFSPTVNSYKRLIRQGAMSTFSWAPVFNSFGSNNRTNSVRVPLGGGRFESRNADGSVNPYLASALVLAAGLEGIKEKLDPGLPQEENLYELSESERMEKGIEFLPQNLGEAVRAFADDPFVEKVLGKGLSDEFIKYKSQEWEEYHRTVSAWEIERYSHLF

SEQ ID NO: 16405 - protein, 175 aa, Triticum aestivum
FSLHVRLLILVQMSIDDKEVVTYIDIVCKAFEGRVNIRPALSVLFVFEVLAWTVALIILFADNTHSVWPSLSITSLKIMSFFLILPTTFLPLRLLSFSSLLGVLSSAWLVAIIFANGFTSHTTPGSILVPAATSLWPEFGPGQAGIAIGLLMSGFGGHSIMPTICYDMRDKTHWR

SEQ ID NO: 16406 - protein, 125 aa, Brassica napus
MTVKKVEMQVDINCGKCKNQIMQAVTELEGVNQVVLDEEKSLLTVVGTMDPICIAEQLRKIKQNPVVVNIGPPKPPEAKPEKKPECCKPCLPYYNNTCDLPYYNYNTRDMVSVSTYESGSGCTIV

SEQ ID NO: 16407 - protein, 207 aa, Oceanobacillus iheyensis HTE831
MNELSKIEQAIEDLRNGKLIIVADDADREAEGDLVGLSEFVTPEKVNFMTKYGRGLICVPITEERALELDLHAMATNNTDTYGTQFTVSVDYYTNSTGISTADRADTIRALAEPLSKAADFKRPGHMFPLIAKNAGVLERRGHTEAAVDLARLSNSIPSAYICEILNDDGTMARYPALETLAKDWDLTLITVEDLVQYREKEIAIEN

SEQ ID NO: 16408 - protein, 175 aa, Triticum aestivum
MGPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 16409 - protein, 151 aa, Triticum aestivum
  misc_feature (96)..(96): Xaa can be any naturally occurring amino acid
  unsure (1)..(151): unsure at all Xaa locations
MAEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLXASEPGTIRGDFAVDIGRNVIHGSDSVESARKEIALWFPEGIAEWRSSQHNWIYEA

SEQ ID NO: 16410 - protein, 360 aa, Carboxydothermus hydrogenoformans Z-2901
MSTYTIPVGPLHVALEEPMYFRVEVEGETIVGLELTAGHVHRGIEYLAMKRNIYQNLTLLERVCSLCSNNHPFTYCMALEKIAGIQIPERAEYLRVIADEIKRIASHLFNIAMMAHIIGFDSLFMHVMELREIVQDIKETIYGNRMDLAANCIGGVRYDLSEEKIKYLARQLDNLKKPLEEITRIYMNNKFVRARTEGVGILPKDEALRYGVVGPVARGSGINNDVRVKSPYAAYDKLKVNVQLETGCDVKARALVRLREIQEAINIVQHCLKELPDGPTCIDYLPEIPAGEAVARSEAPRGELIYYLRTNGSDIPERIKWRVPTYMNWEALKVMMPGNKVADIPLIINSIDPCISCTER

SEQ ID NO: 16411 - protein, 480 aa, Campylobacter jejuni subsp. jejuni NCTC 11168
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVVNIDNQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGIDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQIAYYLQ

SEQ ID NO: 16412 - protein, 404 aa, Ralstonia metallidurans CH34
MELLLQAVLFLASALVVVPLSIRLGFGSVLGYLVAGMLIGPSALGFVTDVNAVLHIAELGIMLMMFIIGIEMDVRKLWNLRRSIFGHGGAQVLLCAVLLALAFTAFGVNWRVGVAAGFALSLSSTAMVIAILEQRGLMQAPIGRASFGILLFQDMAAIPMIALLPLLSPAPATTNTIAGWIVALEALGMLAAVVFGGTILLRYLLPIIRRSGTRDMVTVFALLWVIGIALLMQSVHLSMSLGAFVAGVLLAGSDCREEIEADISPIKGVLLGLFFMAVGMSIKFDVLASKPFLVAVLLLVLLVAKISGLLFLARQIQLPRGDRVYFAVLLSQGGEFAFVVMAVAEAARLLNGEQASIVTAVVALSMAATPLLLMALRTKEVARDVERPLPAANRHADAPDADLH

SEQ ID NO: 16413 - protein, 352 aa, Streptococcus pneumoniae R6
MKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 16414 - protein, 541 aa, Pseudomonas fluorescens Pf-5
MRHFVLQVSRPVTKWRNAIVLNDLGFPSVGSPTLVARGSVTFWRNSCVRYKERPVGFFLRERMQTGWSYSFFVAKVLFMSGTQLSNDLEQGLKPRHVTMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNVAIWVFTLVITLLLTATNLFSVKNYGEFEFWFALIKVVAIIGFVILGLAAICGLLPNSQVSGVSHLVDTQGFMPNGMGAVLAAMLTTMFSFMGTEIVTIAAAESHNPGKQISKATNSVIWRIGLFYLVSIFIVVALVPWNDPSLAQVGSYQTVLDRMGIPNAKLIVDLVVLVAVTSCLNSALYTASRMLFSLGKRGDAPAAAKRTNASGTPYWAVILSTAAAFLAVFANYVAPAAVFEFLLASSGAIALLVYLVIAVSQLRMRHKRMAAGEKIAFRMWLFPGLTYAVIVFIVAVLGIMLFQEEHRVEILATGLLSVIVIAAGLMVARRRKAERNGALALN

SEQ ID NO: 16415 - protein, 458 aa, Bacillus subtilis subsp. subtilis str. 168
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 16416 - protein, 473 aa, Oryza sativa (indica cultivar-group)
MDNSVSDRSFLIDSDEEDDAAAAVEDGKRRGHGGDESDDGSDSSSSCGTPRVAAAGGGGGGRGSQPSSYTQQWPQSYRQSIDMYSSVQSPNLSFLGTPTLSRLSNSFLTASFRGKPPEIISGLIKPLLPTTAAAAAADDEGDGRQQQHEDGRKSSQYLLPPRRPSSLQKIPEDQKPLVVGHHEVGPYRQCTYTQGVLNGVNVLCGVGVLSTPYAVKQGGWLGLIILALLAVLAWYTGILLKRCLDSKEGLETYPDIGHAAFGTTGRIVISVILYMELFACCIEYLILESDNLSKLFPNAHLTIGTFTINAHILFAILTTLIVMPTTWLRDLSCLSFISAGGVIASIVIVACLFWVGLVDHIEAKDEGTALNLPGIPIAVGLYGYCYSGHGMFPNIYSSMKKRSQFPAVIFTCIALSTVLFAGAAIMGYIMFGESTESQFTLNLPSNLVASKIAVWTTVTNPITKCTYHDSSCP

SEQ ID NO: 16417 - protein, 584 aa, Bartonella quintana str. Toulouse
MLHDTPLITTIVAGLCLAFLLGMVASRLRISPLVGYLLAGVLVGPNTGGFRIDSSIINQLAEIGVILLMFGVGLHFSLKDLLSVKAIAIPAALAQMAFSTFLGLCLGLIMGWGFSSSLVFGLALSTASTVILLRALQERHLIETEKGRIAVGWLIIEDLAMVLILVLIPSLANILGNTKKEAIDPVIKWLDPSIWGVFGLTILKVIVFIILMLVIGRRIIPWLLKVSAQSGSRELFRLSVFATALGVAFGAAHLFGVSLSLGAFFAGMVMSESELSHRAAEESLPLRDAFSVLFFVSVGMLFDPGKILSHFFPLLATLLIIIIGKSAVAFFIVKALRHSNAIACTISASLAQIGEFSFILASLSLNLGFLNNDAHDLILGGAILSILLNPLVFIAFDKIKKHLENLLTNLQDVQTIIDIDLKDPDQEFLPITSKTNHIVIIGYGRIGKCVALSLINKGELVVIVEESKRLADKAIADGLEVICGNIIKQDIMSAANISNAYKVVITMRSTIEVGECIVNIRNMKKDIQIITHALSDVETAYLIDLGADIVVTDDEEIANGIIEYITGQKSVKNMHNYELNLQKT

SEQ ID NO: 16418 - protein, 318 aa, Psychrobacter arcticus 273-4
MDKRVSIQWFPGHMNKARNEIKEIMPQMDVVIEVIDARIPYSSENPMVAALRGEKPVIKILNKADLADPELTQAWMDYLEQQNGVKAIACDTDKANDVKRIIAICKQLVPNKVGTGRQIKAMIMGIPNVGKSTLINTLAGRAVARTGDEPAVTKSQQLIKLDDDIMLYDTPGMLWPKVENENSGYRLAATGGIRDTAFDFADVASYTAEYLLTAYPELLKTRYKIEELPKTDWEFFEIAGRNRGCVRAGNKVDTYRMSEILVNELRSGKIGRITLEKPAMTEAEEVIVAEQRIASEEKRIAKEEEKRLRRLKTRKNRK

SEQ ID NO: 16419 - protein, 224 aa, Bacillus anthracis str. A2012
MDKQIGFIGCGNMGMAIIGGMLNKKIVSSNKIMCSDLNTTNLENASEKYGISITTDNNEVAKNADILILSIKPDLYASVINEIKEEIKSDVIVVTIAAGKSVKSTEDSFDTKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETRNTSWE

SEQ ID NO: 16420 - protein, 269 aa, Streptomyces avermitilis MA-4680
MTQKVAVLGTGKIGEALLSGMIRAGWAPTDLLVTARRPERAEELRARHGVTPVTNAEAAKTADTLILTVKPQDMGTLLTELAPHVPTDRLVISGAAGIPTSFLEERLAQGTPVVRVMTNTPALVDEAMSVISAGSHATAGHLAHAEEIFGAVGKTLRVPESQQDACTALSGSGPAYFFYLVEAMTDAGILLGLPRDKAHDLIVQSAIGAAIMLRDSGEHPVKLRENVTSPAGTTINAIRELENHGVRAALIAALEAARDRSRELASGSS

SEQ ID NO: 16421 - protein, 803 aa, Cryptococcus neoformans var. neoformans B-3501A
MSAIVTLRAIPTEADTGALKSIVSRDVRRAYISPETLRTHKVAAGDWMRFKSGSTFIMAQAWPKASIDDDVVALSSAQINNLCGSEVEMHHFKAGQSQGRLVSIVLKEVPLTEAPSSSKLNVVTRPPINLDSPREWVWCKAAIKEALTSLHYVRTGYSLIVGDTEKAPRKFEIISVEVSPKDIEKRLASIEDGMEELAIDEENQRLYEMHWKTSVSLEGEKLQENKEVREAIPDEKKVLSTKDFSKMSTSSVPHYINFFTPAESPVSAYTFLGGLQSQIDQIKTLLDLPMLHPDLYIKFGLNPPRGILLHGPPGTGKTALARAVASSAGCSCIVVNGPELSSAYHGETEERLRGVFTEARKRSPCIVVLDEVDALCPRRDGGEGGEVERRVVATLLTLMDGMSHESLEGERVFVVAATNRPNSIDPALRRPGRFDREIEVGVPDVKGRREILDIMLSKIPHSLSEKDLSSLAARTHGYVGADLFSLVRESASAAISRFHLSPSSTLSEPVLTNADILSTLPSIRPSAMREVFIETPTVRWSDIGGQQDVKQKLRECIEWPLMHRDTFKRLGVEAPRGVLLYGPPGCSKTMTAKALATESGINFIAVKGPELLNKYVGESERAVREIFRKARAASPSIIFFDEIDALGSARSDDHAHSGVLTSLLNEMDGVEELSGVTVVAATNRPDVLDSALMRPGRLDRILYVGAPDFETRKDIFRIRLATMAVEPGVNVEQLAEITEGCSGAEVVSICQDAALAAMNESLDAPYVKASHLVNSAHTVRRRITPEMIAFFEEWRDLSGVRSA

SEQ ID NO: 16422 - protein, 294 aa, Salmonella typhimurium
IVFRAAQKRSDIEIVAINDLLDAEYMAYMLKYDSTHGRFDGTVEVKDGHLIVNGKKIRVTAERDPANLKWDEVGVDVVADATVIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLV

SEQ ID NO: 16423 - protein, 563 aa, Medicago truncatula
MVKKRERSVNVSGKPKHSNDANRSNDTKNESRSAATVRRLKMYNTKPVRNRKGRVLYEPFQLPYLPSTRIKPDSQWFGNTRVVNQKELEFFREEMAKHGSSNYNVVINGKNLPMSLLNDYQKQSRVHLLDREPFLHAFGPKTKRKRPSLLASDYESLAKKADVSQDAFEDGNEADDGFRDLVRHTMFEKGQSKRIWGELYKVIDSSDVVVQVIDARDPQGTRCYHLEKHLKENCKHKHMVLLLNKCDLIPAWATKGWLRVLSKEYPTLAFHASINKSFGKGSLLSILRQFARLKSDKQAISVGFVGYPNVGKSSVINTLRTKNVCKVAPIPGETKVWQYITLTKRIFLIDCPGVVYHNNDSETDVVLKGVVRVTNLKDAADHIGEVLKRVKKEHLTRAYKIKEWVDENDFLLQLCKSSGKLLKGGEPDLMTAAKMILHDWQRGKIPFFVPPPRLEDLSKSEEPNVNGIDVDEANVNGIAVDEAVDHYQASAAIKAIANVLSSQQKQIVPVQGDLCNENELKGETADQLPNSEDDTDEDSDTFEQDPSTEVPSEQLTPAAGPNK

SEQ ID NO: 16424 - protein, 261 aa, Kluyveromyces lactis NRRL Y-1140
MPQNEYIEQHIKQHGRRLDHDERKRKREAREAHKISEKAQKLTGWKGKQFAKKRYAEKVAMKKKIRAHEQSKVKGGSKPLDENGEALPTYLLDREQNNTAKAISSSIKQKRLEKADKFSVPLPKVRGISEEEMFKVVKTGKSKSKAWKRMITKHTFVGEGFTRRPVKMERIIRPSALRQKKANVTHPELGVTVFLPILAVKKNPQSPMYTQLGVLTKGTIIEVNVSELGMVTSGGKVVWGKYAQITNEPDRDGCVNAVLLV

SEQ ID NO: 16425 - protein, 250 aa, Oceanospirillum sp. MED92
MRTAFVAGNWKMNGNTDSINELMDGLVNSINSSSVEVLVCPPSVYISQVKSLTESSKISVGAQNVSENANGAFTGEVSLSMLNDLGCEYVILGHSERRSLYAETDQLVAAKFIAAVESGVKPILCVGETLDERENGETLKVVSRQLNAVIDAAGIEKFADAVVAYEPVWAIGTGKTATPEQAQEVHAAIRAEIAKSDAATAEKTRILYGGSVNAANAAELFANADVDGGLVGGASLKVNDFIAICQAADA

SEQ ID NO: 16426 - protein, 429 aa, Listeria innocua
MQNYIKSEKAFKEAKKVLPGGVNSPVRAFNSVDASPVFMDHGKGAYITDVDGNEYIDYVLSWGPLILGHADPSVVNAITNSAMKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDVEGAKLAFEKFGEEIAAVIVEPVAGNMGVVPPIDGFLEGLRELTTEYGALLIFDEVMTGFRVDYYSAQGYYVVTPDITCLGKVIGGGLPVGAYGGKKEIMEQIAPAGSIYQAGTLSGNPLAMNAGFETVRQLTPQHYDVFRSLIKRMEEGLTEISNRHEVPLSINKAGSMFGFFFTDQKVTNFDTAKTSDLEFFRNYYREMLAQGIFLPPSQFEGVFISTMHTEKEIDATLEAFDVTCKMLRG

SEQ ID NO: 16427 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 16428 - protein, 346 aa, Burkholderia xenovorans LB400
MKALVYHGPGKKSLDERPMPQLASATDAIVKVTRTTICGTDLHILKGDVPTCQPGRILGHEGVGIVQQVGAAVSSLKEGDHVLISCISACGKCDYCRRGMYSHCTTGGWILGNRIDGTQAEYVRIPHAETSLYPIPAGADEEALVMLSDILPTGFECGVLNGKVQPGSAVAIVGAGPIGLASLLTAQFYSPAQIIMIDRDERRLEVASRFGATACIDSRVAEPVVEVMKLTGHVGVDCAIEAVGVPDTFELCQALVAPGGVIANIGVHGVKADLHLESLWDRNISITTRLVDTVSTPMLLKTVQSGRIDPARLITHHFQLDDVLNAYDTFGRAADSHALKVIIEMS

SEQ ID NO: 16429 - protein, 480 aa, Salmonella typhimurium LT2
MIMRQTKLYPVVMAGGSGSRLWPLSRVLYPKQFLCLKGDLTMLQTTICRLNGVECESPLVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 16430 - protein, 119 aa, Synechococcus elongatus PCC 6301
MKVGDRDQRPWGQFEILAQGSGYQVKRLEVLPGQQLSLQRHQQRQEHWLVVQGLARVQLGDRQFSLRVGQSLDIAIGEWHRLQNPGDELLALIEVQMGAYLGEDDIERRADDYGRCPTS

SEQ ID NO: 16431 - protein, 308 aa, Salmonella bongori
INGFGRIGRIVFRAAQKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAGIALNDNFVKLVSWYDN

SEQ ID NO: 16432 - protein, 136 aa, Arabidopsis thaliana
  misc_feature (45)..(45): Xaa can be any naturally occurring amino acid
  misc_feature (55)..(55): Xaa can be any naturally occurring amino acid
  misc_feature (76)..(76): Xaa can be any naturally occurring amino acid
  unsure (1)..(136): unsure at all Xaa locations
KSYAAFPVTRKTNKDITCIASYGGRVICMKVWPPIGKKKIETLSXYLPDLIDLEXTKEVDYLLRNKQISCVEFHTXHGSVYREHGNTLGYYDGRCWTMWKLPLFGCTDSAQVLKEAEECKKEYPGAFIMIIGFDNT

SEQ ID NO: 16433 - protein, 68 aa, Triticum aestivum
  misc_feature (14)..(14): Xaa can be any naturally occurring amino acid
  unsure (1)..(68): unsure at all Xaa locations
EVKLVRRMWDLYTXTGDHVWLPRFWQEAFEAAYEELAGDDTPASDAAVSEIARMAIHRPELEQAGNNN

SEQ ID NO: 16434 - protein, 377 aa, Bacillus licheniformis ATCC 14580
MKAVTFQGPQHVEVSQVEDAKIEKSDDIVVRITSTAICGSDLHLYQGNFPLPKGFQLGHEPMGIVEETGPDVTKVKKGDRVVIPFTVACGHCFYCENKLESQCDNANPHYDSGGYFGYSEKFGNHPGGQAEYLKVPFGNFTPFVIPESCEMEDESLLFLSDVLPTAYWSVLHAGVKKGDTVIVLGCGPVGLMAQKFAWMEGAKRVIAVDYLDYRLKQAEALNRVEVFDFTKYPDMGEHLKEITKGGADVVIDCVGMDGKKSPLEYLEQKLKLQGGTLGPIQISTKAVRKCGTVQITGVYGSNYNMFPLGAFFSRNVTLKMGQAPVIHLMPEIYKKIEENQFDPKEIITHQLPLEEAGRAYHLFNDHEDDCIKVILKP

SEQ ID NO: 16435 - protein, 477 aa, Bacillus licheniformis ATCC 14580
MKGKRSNAWLYFFGALGGVLYGYDTGVISGAILFMKDELGLNAFTEGLVVSAILIGAIFGSGLSGRLTDRFGRRRAIMSAAVLYCIGGLGTALAPSTEYMVAFRIVLGLAVGCSTTIVPLYLSELAPKESRGALSSLNQLMITIGILLSYLINYAFSDAGAWRWMLGLALIPSIGLLIGIFFMPESPRWLLTKGKEEKARRVLSKMRGGERVDQEVKEIKEAEKQDQGGLKELLEPWVRPALIAGVGLAFLQQFIGTNTIIYYAPKTFTNVGFEDSAAILGTVGIGTVNVLMTLVAIRFIDRIGRKPLLLFGNAGMVISLIVLSFSNLFFGNTSGAAWTTVICLGVFIVVFAVSWGPIVWVMLPELFPLHVRGIGTGVSTLMLHAGNLIVTLSFPVLMEAMGISYLFLCYAAIGIAAFLFVFFKVTETKGKVWKRSSRICGTSTAESRQLTHSRLNDRQKDGQGPILFCVKRPADHG

SEQ ID NO: 16436 - protein, 87 aa, Zea mays
MGTASTSPDTMEAARLPSLSITVEKNPPEARLLQLGVKSWPKWGCPPGRFPLKFDAALTCYLVKGRVRAAVKGSRECVDKHYNFDPS

SEQ ID NO: 16437 - protein, 467 aa, Bartonella quintana str. Toulouse
MNCKQNLEENLQNKLQRGLDNRHVQLIAIGGTIGTGLFMGSGKTISVAGPSIILVYAIIGCALYFVMRAMGELLLSNSQYRSLIDFSTDILGPGIAFFAGWSYWLSWVVTGAADIIAIITYMHFWWPTLNPWIIVFACVTFFLTLNLLAVKMFGELEFWFGLIKVVAILALIIVGFYMIATGFTSPNGTVASLSHIWNDGNIFPRGITGFFAGFQIAIFSFVGIEIAGTAAAEVKEPKKVLPKAINAIPIRIVLFYIFSLVVIMSVTPWDQVIPDKSSFVTMFWLAGIPTAAGLVNFIVLTSAASSANSGIFSTSRMIYGLATQKGAPRLLGKLSNHHVPANALFFSCLCILLGYTIASLSPSIINAFTIVTSISAISFIFVWSVILVSYIVYRRNRPQLHIESIYKMPGGVIMCWIILAFFAFILYLLTLESDTLIAFKYSLLWFIFLGVTYFIMFVRKKTAQHTK

SEQ ID NO: 16438 - protein, 474 aa, Bacillus anthracis str. A2012
  misc_feature (470)..(470): Xaa can be any naturally occurring amino acid
  unsure (1)..(474): unsure at all Xaa locations
MLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 16439 - protein, 223 aa, Antirrhinum hispanicum
MATRRNSHYRPFPSLIACVVLLLHYSSAQFDHFKLVLTWPHSFCLVYPGKCHRTPLPLNFTIHGLWPDKQKGKTSPCKKYPVSPLNDKNLELRLEESWPDLRRDSKLGFSTIFWKEQWDKHGSCAWPLYNYEKYFLKALEFKDKFDVLGHLVQDSLGPGTSPTVSRNLVNKTISQATTGIPILKCPSNYLTEVVICFKPTGVVVVACPQPPKDPCPNENVNFP

SEQ ID NO: 16440 - protein, 330 aa, Kluyveromyces marxianus
VRIAINGFGRIGRLVLRIALSRKNIEVVAINDPFITVDYAAYMFKYDSTHGRFDGEVSHDGKSLIIDGKKVLVFQERDPATLPWGAEKIDIAIDSTGIFKELDSAQKHIDAGAKKVVITAPSSTAPMFVVGVNEDKYAGQTIVSNASCTTNCLAPLAKIINNAFGIEEGLMTTVHSITATQKTVDGPSHKDWRGGRTASGNIIPSSTGAAKAVGKVLPELQGKLTGMAFRVPTVDVSVVDLTVKLAKPATYEEIKAVVKKASENELKGVMGYTEDAVVSSDFLGDTHSSIFDAAAGIQLSPQFVKLVSWYDNEFGYSTRVVDLVELVAKN

SEQ ID NO: 16441 - protein, 157 aa, Triticum aestivum
  misc_feature (24)..(24): Xaa can be any naturally occurring amino acid
  misc_feature (49)..(49): Xaa can be any naturally occurring amino acid
  misc_feature (99)..(99): Xaa can be any naturally occurring amino acid
  misc_feature (114)..(114): Xaa can be any naturally occurring amino acid
  misc_feature (122)..(122): Xaa can be any naturally occurring amino acid
  misc_feature (145)..(145): Xaa can be any naturally occurring amino acid
  unsure (1)..(157): unsure at all Xaa locations
MAEQTFIMIKPDGVQRGLIGEVIXSRFEKKGFYLKGLKLQNVEKSFAEXQHYSDLSSKPFFAGLVEYIVSGPVVAMVWEGKSVVATGTQDHLGATNPLXASEPRHHPVGDFAVXDIGRNVIXMGSDSVESARKEIALWFPEGIAXWRSNQHNWIYEA

SEQ ID NO: 16442 - protein, 394 aa, Synechococcus sp. RS9917
MTQLETRTEPMVVNFGPHHPSMHGVLRLVVTLDGEDVVDCEPVIGYLHRGMEKIAENRTNVMFVPYVSRMDYAAGMFYEAIVVNAPERLADIPVPKRASYIRVLMLELNRIANHLLWLGPFLADVGAQTPFFYIFREREMIYDLWEAATGQRLINNNYFRIGGVAADLPFGWLEKCRDFCDWFGPKIDEYEKLITNNPIFRRRIEGLGTIGREEAINWSLSGPMLRASGVPWDLRKVDHYECYDDFDWDVAWENEGDCFARYRVRIEEMRQSLKILRQACDMIPGGPTENLEARRMAEGKSSDFAGFDYQYVAKKVAPTFKIPNGELYTRLESGKGEIGVFIQGNNDVTPWRFKIRAADSNNLQILPHILKGHKVADIMAILGSIDVIMGSVDR

SEQ ID NO: 16443 - protein, 518 aa, Zea mays
MAPPRISFLELCLSFLCFVVFYYLHIRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADGDSWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNEQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPMLSIILHMKNGFMATVKRRRQTFA

SEQ ID NO: 16444 - protein, 246 aa, Triticum aestivum
MAMVTAKLSSPAAARLAPSAGSARRASRVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEISSTVTMAIREETPLEVAKGQKVVFLLKKRFV

SEQ ID NO: 16445 - protein, 168 aa, Avena agadiriana
VMASSATTVAPFQGLKSTAGLPVSRRSSGSLGSVSNGGRIRCMQVWPIEGIKKFETLSYLPPLSEEALLKQIEFLIRSKWVPCLEFSKVGFIFREHGSTPGYYDGRYWTMWKLPMFGCTDASQVIKEVEEVKKEYPDAYVRIIGLDNIRQVQCVSFIAFKPPGCEESG

SEQ ID NO: 16446 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 16447 - protein, 362 aa, Streptomyces coelicolor A3(2)
MAQEVRGVIAPGKDEPVRIETIVVPDPGPGEAVVKIQACGVCHTDLHYKQGGINDEFPFLLGHEAAGVVESVGAGVTDVAPGDFVILNWRAVCGKCRACRRGRPWYCFDTHNAEQRMTLASTGQELSPALGIGAFAEKTLVAAGQCTKVDPAVPAEVAGLLGCGVMAGIGAAINTGNVGRGDTVAVIGCGGVGDAAIAGSYLAGASKVIAVDIDDRKLETARTMGATHTVNSRGTDPVEAIRELTGGFGADVVIEAVGRPETYRQAFYARDLAGTVVLVGVPTPEMKLELPLLDVFGRGGSLKSSWYGDCLPSRDFPMLVDLHLQGRLDLGKFVTETIRLDEVEQAFDRMHAGDVLRSVVVL

SEQ ID NO: 16448 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEDVKKKYPDAYVRIIGFVNIRQVQCVSFIAFKPPGCEESG

SEQ ID NO: 16449 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITTGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 16450 - protein, 323 aa, Streptomyces coelicolor A3(2)
MTHTEQQPLNSPFSAATTAEDVMAGHDLSGVTAVVTGGYSGLGLASTRALTAAGARVLVPARRPDIARAALRDVKGSEVVPMDLTDLDGVRSAAAHIGDRIDRIDLLMAAAGVMATPERRVGPGWEFQLAANHFGHFTLACELYPLLAAAGGARVVAYSSAGHAMTDIRRHDPHFRTGYDRWLAYGQAKTANALFAVHLDALGKDDGIRAFALHPGKIITGLQREMPLQEQIDAGWVDEHGNVVAADFKTASQGAATGLWAATSPLLDGRGGLYLADCDVARVFPPDTPMDDNGVRPYAVEPANAARLWEMSLAATGATPPTR

SEQ ID NO: 16451 - protein, 168 aa, Avena clauda
VMASSATTVAPFQGLKSTAGLPVSRRSSASLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 16452 - protein, 279 aa, Bacillus cereus E33L
MKNLQSTTTLHNGVEMPWFGLGVFKVEEGPELVEAIKSAIKAGYRSIDTAAIYGNEAAVGEGIRAGIEATGISREELFITSKVWNADQGYEETIAAYEESLKKLQLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEQRIIANADVFNFELTKEDMEKIDALNQNHRVGPDPDNFDF

SEQ ID NO: 16453 - protein, 504 aa, Solanum tuberosum
MSSRGGGIAESPYLRNYRVGKTLGHGSFGKVKIAEHLLTGHKVAIKILNRRKMKTPDMEEKLRREIKICRLFVHPHVIRLYEVIETPTDIYVVMEYVKSGELFDYIVEKGRLQEDEARKIFQQIIAGVEYCHKNMVVHRDLKPENLLLDARRNVKIADFGLGNIMRDGHFLKTSCGSPNYAAPEVVSGKLYAGPEVDVWSCGVILYALLCGTLPFDDENIPNLFKKIKSGVYTLPSHLSPLARDLIPRMLIVDPMKRISVPDIRQHQWFKIHLPRYLAVPPPDARQHLKKLDEEILQQVSRMGLDRDQLLDSLQKRIQDDATVAYYLLYDNRSMASSGYLGAEFQESVDCYSPGLFPNLDLQLSTGNGVSEESLRRPFRKEKMWLVGLQSPANPKEIMNQVLGTLLELNVRWKKIGHYNMKCLWCHDLHLHSMANNHMNDDDHFISNATAISTHLQPQPTVKFEMQLYKTEDEKYLLDLQRISGPQFLFLDFCAGFIRQLEGPQ

SEQ ID NO: 16454 - protein, 404 aa, Oryza sativa (japonica cultivar-group)
MDPCPFVRVLVGNLPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 16455 - protein, 298 aa, Triticum aestivum
  misc_feature (130)..(130): Xaa can be any naturally occurring amino acid
  misc_feature (150)..(150): Xaa can be any naturally occurring amino acid
  unsure (1)..(298): unsure at all Xaa locations
MKSLGLKIAASLKKNSGFPADGCLENDDTLSLKSTSVRAQDHPTTNSVIPVDSVVAAEIISTDLSCVVDTLSNEEDDAELDLDSPTEGFSSISEAIEDIRQGKLVIVVDDESRENEGDLILAASLVTPEXAMAFIVRHSTGIVCVSMKEXDLERLNLPLMVSTKENEEKLCTAFTITVDAKEGTTTGVSAKDRAKTVMTLASPYSKPEDFNRPGHIFPLKYRDGGVLKRAGHTEASVDLAVLAGLPPVGVLCEIVDEDGSMARLPKLRVFAEKNNLKIVSIADLIRYRRKRDRLIERA

SEQ ID NO: 16456 - protein, 476 aa, Nostoc punctiforme PCC 73102
MRRTKIICTVGPATSAPENLRGLVEAGMNVARLNFSHGAYEFHAQTAHYLRQISNEQQKPIAIMQDLCGPKIRLGTLPPEGLNLEAGTEVTFVLQEKGESIDELPLPLPTLFAMVRPGEPILINDGRVKLIVTDRDADRIRAQVKTGGLISTHKGVNLPQTPLPVSSITEKDLLDLRFGIQLGVDWVAVSFVQSPQDLEPAKRMIEAAGASIRLIAKIERAEALENFDSILKVADAIMIARGDLGVEVPIHEVPLIQKDIIRRCNRAGKPVITATQMLESMISAPDPTRAEATDVANSILDGTDAVMLSGETAVGQYPIAAVQMMHNIAVRTEQALDEGSKHAWCHEAGSLSVTESVAESVCRIAYETGSRAILCNTSSGNTARMVSKYRPTSPIIALTSDITAYRQLALSWGVEALLIPPVHHAEEMFTNVVNTVVDMGLANKGDKVVITSGVPIGKSGTTSLIKVHSIGQPISA

SEQ ID NO: 16457 - protein, 170 aa, Triticum aestivum
MAAAAISLCGSRCVGPSRKPEPRLASQAAAAPCARPSSSRRKLVVAAAKSSGKKADEKVPSWARPGSDEPPPWARDEGGASGQEGDAVQVPFYAYLLASAVRGIAAIGSIFEYTNGRAVYGVVGTDSPIYAPILGFFAGTGIPTSGYLWYKAVQTVNKDAEEQDRRDGFL

SEQ ID NO: 16458 - protein, 315 aa, Mycobacterium avium subsp. paratuberculosis K-10
MVKPNLTLEIPDLRGKFAVVTGANSGLGFGLAKRLAAAGAEVVLAVRDPAKGDQAVAAIRREVPQAKLTIRQLDLSSLRSVAALGEQLTAEGRPIDILINNAGVMAPPRRQQTSDGFELQFGTNHLGHFALTGRLLALLRAADSARVVTVSSIAATQRKLDFADVNAEHGYQPMYSYGVAKLAQLMFAVELDRRSRLGGWGLMSNAAHPGLAKTNLLSGASYGRSAPTLQARLTRLTWRLLPFMWLDIDEAVKPTLYAAVSPDAQGARYYGPRGFYETARGGVTFARVPPLARSEPEMARLWRLSEQLSGVDYPG

SEQ ID NO: 16459 - protein, 115 aa, Brassica napus
  misc_feature (114)..(114): Xaa can be any naturally occurring amino acid
  unsure (1)..(115): unsure at all Xaa locations
MSAINITNVTALDNPAPFVSPFQFEISYECLTSLKDDLEWKLIYVGSAEDETYDQTLESVLVGPVNVGNYRFVLQADPPDPSKIREEDIIGVTVLLLTCSYMGQEFLRVGYYVXN

SEQ ID NO: 16460 - protein, 331 aa, Streptomyces coelicolor A3(2)
MTTNPDGGRHARNDSALLTTPFDSHARAQEVIDGVDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 16461 - protein, 874 aa, Monacrosporium haptotylum
MSTTPTPPSPSMTGQDILSQTFAKRPRHKRTATGFGSREIKSIESSIPQPLREKWRKFAATEFSTKDEFQKEVVKHVETTLARSLYNCDELAAYSGVALAFRDRLIIDWNKTQQAQTFVDQKRVYYLSLEFLMGRTLDNAMLNHRMKDTAVEGVSELGFRMEDLIEQEHDAALGNGGLGRLAACFLDSLASLNYPAWGYGLRYRYGIFKQEIIDGYQVEVPDYWLDFNPWEFPRHEITVDIMFYGYVRKSTDENGQTSHVWEGGEVVQAVAYDSPIPGFATSTTNNLRLWSSKPSSGEFDFQKFNSGDYESSVRDQQRAETISAVLYPNDNIDVGKELRLKQQYFWVAASLYDIVRRFKKSGRAWSEFSDQVSIQLNDTHPTLAIVELQRILVDKEHLEWDEAWNIVTQTFGYTNHTVLPEALEKWSVPLVQNLLPRHLQIIYDTNLFFLQSVERRFPKDRELLSRVSIIEESNPQVIRMAYLAIIGSKKVNGVAELHSDLIKTTIFKDFVTIFGPDKFTNVTNGVTPRRWLHQANPELSKLIADKLGGFTFLKDLTLLNGLEKYADDKEFQKDWMHIKFRNKQRLAKYIKDTTGIVVNPSALFDIQVKRIHEYKRQQMNIFGVISRYLAIKKMTKEEKKKLVPRVSIFGGKAAPGYWMAKTIIRLVTAVSEVVNNDPDVGDLLKVVFIEDYNVSKAEFLCPASDLSEHISTAGTEASGTSNMKFVLNGGLIIGTCDGANIEITREIGEDRIFLFGHLAEDVDDLRHAHRFGKTEMDPALRQVCDEIEKGTFGDPGVFSGLIHALTDGGDYYLVSDDFASYLATHKLVDEAFKNEEAWAHKCIMAVSAMGFFTSDRAILEYAENIWNLEPVVVA

SEQ ID NO: 16462 - protein, 347 aa, Thermoanaerobacter tengcongensis
MDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 16463 - protein, 116 aa, Glycine max
MASSMISSPAATTDNRAGAAMGASFTGLKPMAGYPTRKTSSDITYIASNGGRVHCLLVWPPGGLKKYVTLSYLPDLDDAQLAKAVEYLITMGRIPCSAFEMERCFQHREHTREPGY

SEQ ID NO: 16464 - protein, 131 aa, Zea mays
MTTTRLCAALTTFLPLLLLSSAAVSLANAAGRESEDGRGQQAATTASVYVVMVKAPAQGVDSEAYHMRILATALGSEEKAKRALIYSYKAAASGFAAKLTPAQVAALQKHPDVVQALPDVKYTLEDRNHLN

SEQ ID NO: 16465 - protein, 469 aa, Methylococcus capsulatus str. Bath
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGDNGNGMHVHQSLAKDGKNLFSGDLYGGLSETALHYIGGIIKHAKALNAFCNASTNSYKRLVPGFEAPVMLAYSARNRSASIRIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTRLRMSTHPVEFDMYYSL

SEQ ID NO: 16466 - protein, 149 aa, Brassica napus
  misc_feature (5)..(5): Xaa can be any naturally occurring amino acid
  misc_feature (7)..(7): Xaa can be any naturally occurring amino acid
  misc_feature (57)..(57): Xaa can be any naturally occurring amino acid
  misc_feature (88)..(88): Xaa can be any naturally occurring amino acid
  unsure (1)..(149): unsure at all Xaa locations
LYVVXVXRVLQIEDFMEDGVWVASSDYKKASPDPLRDVAEDIVNQINANNMEDIFRXCNVYVDLDFVVSETKMIWMDRLGFDLRVWSXRGVYDVRIPFPMDVTDEKGAKSSFNGMSQLAWEVEKSYCPADFNKVKLLKQVVTSSHKGGQ

SEQ ID NO: 16467 - protein, 270 aa, Magnetococcus sp. MC-1
MSSQPPIAFLGGGNMASAIIAGLHKVGYPAAKLRVGEPNATQREALIRQFAIQGHAHNPDAVAEAAFVVVAVKPNLVAQVLRDVAPQLAPTAVVLSIAAGVDLTTMAAALPAGQPIIRAMPNTPALVGQGMTVLCPNGHVDAEQLAQAQRLLESVGQVAVVKQESLMDGVTALSGSGPAYLFLIAEALSDGGVACGLPRALADQLAVQTLLGSATLLRESGEHPGVLKNRVTSPGGTTIAGLGVLERQGVRGALMAAVEAAWNRSKALGQ

SEQ ID NO: 16468 - protein, 345 aa, Zea mays
  misc_feature (157)..(157): Xaa can be any naturally occurring amino acid
  unsure (1)..(345): unsure at all Xaa locations
PTRPPTRPPTRPRTRGIFPLKYREGGVLKRAGHTEASVDLAMLAGLPPVAVLCEIVDDADGSMARLPKLRVFAEKENLKIISICCRYRRKRDRLIERASVARLPLKWGNVHAYCYKSVIDGIEHIAMVKGDKSLPDIICTLSALLCDVLLFVHHLIXTINHMPNDGQGDIGDGQDILVRVHSECLTGDIFGSERCEYGNQLAGGGGGGEKAGRGVLVYLRGHEGRGIGLGHKIRAYNLQDDGRDTVEASEELGLPVDSREYGIGAQILRDLGVRSMKLMTNNPAKYSGLKGYGLSIAGRVPLITPITSENRRYLETKRTKMGHVYGLANAQANQANGSQSTEENH

SEQ ID NO: 16469 - protein, 496 aa, Silicibacter sp. TM1040
MPRARKSCPIATDTNEAEMRNYPDLKLFIGGTWRDTPETLSVVNPATEEELGRLPCARISDLEDALAAAQKGLEIWRNTPPRSRADLILRAARLLRDRQEEIAQSITAEHGKPLAQARLEVIRGAEFFEWDAAEAMRTYGRVIPSAAGTKISVHHHPIGVVAAFSPWNFPMSQPARKIAGALASGCSLILKAAEETPAGAIHIVRAFQDAGLPDGVLNLVFGRPAEISAYLIPQPCVRLVALTGSTAVGRQLTALAAQSDTRVLMELGGHAPVIVCEDTDVQKAALSGAIRKMRNAGQVCTSPTRFFVHQDIFDEFATTFTQRAAATRVGNGMHDGIEMGPTANARRIPVLTDLVNDALAQGATLCTGGTRVGERGYFFAPTVLTHVPDSARIMREEPFGPIAVLNTVRNLDEAIAQANAVDYGLAGYAFTNRADYIARMIDEVEVGNFSINTLEASLPETPFGGVKSSGYGREGGTEGLESYLTTRNVWQSSDIT

SEQ ID NO: 16470 - protein, 224 aa, Listeria innocua
MINQKKIAGEKACEWIEDGMVVGLGTGSTVYYTIEKLGEMVQKGLNITGVSTSIETEQQARTLGIPLKSLNDVTKIDVTIDGADEINQAFQGIKGGGGALLREKMVAQASSKNIWVVGEEKLVTELGKFPLPLEVIPFGWKQIKRMLENDGVETTLRKQSSGEIYETNNGNYILDIINQTFTNPEAWHEKLAGIPGVLEHGLFLHYVDIIICGKASGEIEIIKK

SEQ ID NO: 16471 - protein, 364 aa, Psychrobacter arcticus 273-4
MSMMKSLIFIEPGKIEVAEKKIPDVGPNDALIKITTTTICGTDIHIFKGEYPVAKGLTIGHEPVGIIEKLGSAVMGYQEGQRVIAGAICPSFTSYASQDGFPSQDGGYIQPDGTCACHGYKATGGWRFGNIIDGTQAEYVLVPDAQANLAPVPDGLTDEQVLMCPDIMSTGFKGAENANIKIGDIVAIFAQGPIGLCATAGAKLRGASTIIAIDGNNERLAMSKKLGADITLNFKEVDVVDEIMKITGGRGVDSSIEALGLQSTFEQGIKVLKPGGTLSSLGVYSADLKIPMAYFASGLGDHTIRTALCPGGKERMRRLLNVVESGRVDFSEMVTHTYALDDIVEAYDLFMHQRDGVLKIAIKP

SEQ ID NO: 16472 - protein, 585 aa, Listeria innocua
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAVVAKSNAEALQKAEEGGILIVKTTDKEILPAFEKSAAVVVEEGGLTSHAAVVGINLGIPVIVGAKDATSLVKDGEIITVDSRQGVVYNGKTATH

SEQ ID NO: 16473 - protein, 602 aa, Pseudomonas syringae pv. tomato str. DC3000
MPHEGSLLQAAVVFLLAAVLTVPLAKRLKLGAVIGYLFAGVIIGPSVLGLIGDTESVSHISELGVVLLLFIIGLELSPKRLWVMRKAVFGVGMAQVMLTGLVIGAIALFAFGQSLNTAVILGLGLALSSTAFGLQSLAERKQLNSPHGRMAFAILLFQDIAAIPLIAMVPFLAGADHAMNTGESVNHGLRVLGSIAIVVIGGRYLLRPVFRIVAKTKIQEVSTATALLVVIGTAWLMELVGVSMALGAFLAGLLLADSEYRHELEAQIEPFKGLLLGLFFISVGMGANVGLLLSSPLAVLGLTLLLIAIKLPMLFIIGRTAGGLNNRSALQLGLVLAAGGEFAFVVFKIGSTQGLFEAGLYDMLVLTITLSMAITPLLFIALARWIKPKAKVVNVPDEYRDIQTDKPRVVIAGMGRMGQIVARILRAQKVPFIALDTAVESIEFSRSFGNVPVFYGDPLRPEILRAAKVDEAQYFVIATDDPDTNIKTAELIRKLYPHMKIIARARNRQHVHRLMDIGAHAVRETFYSSLEMSRQTLMGLGLTEAQADARISRFKRHDEQVLAAQHEVYDDDAKVLQTAREARADLAQLFEADRLDEEAAKG

SEQ ID NO: 16474 - protein, 409 aa, Vibrio angustum S14
MAKVSLNKDKIKILLLEGLHPSSLEVLQQAGYTNIEYHKGSLAGEELLEAVKDAHFIGIRSRTQLTPEVFAAAKKLTAVGCFCIGTNQVDLDEAMRRGIPVFNAPFSNTRSVAELVLGELLLLLRGIPEKNAKAHRGEWIKSADNSFEARGKTLGIIGYGHIGTQLGILAENLGMRVCFYDIESKLTLGNATQVASLSELLNKSDVISLHVPETPETQNIMGAEEFARMKPGSIFINAARGTVVDIDALCSALESKHIAGAAIDVFPVEPKTNNDPFESPLLQFDNVILTPHIGGSTQEAQENIGIEVAGKLVKYSDNGSTLSAVGFPEVSLPEHRGCSRLLHIHENRPGVLNQITTIFASEGINIAAQFLQTGAEIGYVVIDVETERSKEALAKLKTIEGTIRARILH

SEQ ID NO: 16475 - protein, 302 aa, Medicago truncatula
MRVITNFSMLLLITCFLCLILSSAQTSFDGIVSARSLDDQLQDCAFKAFSTPKTGVPYDAQVPSNLTGIKVSAMRLRSGSLWDKGVQSYKEFEIPEGVIEQPYFKRIVLVYQNLGNWSQYYYPLSGYSYLAPVLGLLAYDGTNLIASNLPELELSAYHKPILVNFSYVKNTSPYGSLAKCVYFDLFGSIKFDTLLNGNVCPIFEQGHVSIVVESNASPQTHWKNEFKFKIVIVCLAGGIVLLFLFGLLISRMRRAKQETKIKQMELEADCSETLKIIYIGNAKVPSALGTRTPPKIENDYVP

SEQ ID NO: 16476 - protein, 219 aa, Vibrio angustum S14
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKAMEDKINALPGVVTVGLFAHRGADVLLVGSPDGVKKFEK

SEQ ID NO: 16477 - protein, 479 aa, Ralstonia solanacearum
MTRATKIVATLGPSSNTLEILTRMIAAGVDVVRLNFSHGTAQDHVARAELVRETARAVGREVGIMADLQGPKIRVGKFESGKITLSPGERFTLDARCELGNQERVGLDYKELPRDVGPGDLLLLNDGLIVLQVERVVGEEIETVVKVGGDLSNNKGINRQGGGLSAPALTAKDMEDIKTAMALGADYIAVSFPKNATDMEMARQLAAVAGAPHSHKTKMIAKIERAEAIRPGVLEEILAASDGIMVARGDLAVEVGNAAVPALQKRMIKLAREANKLAITATQMMESMIVNPVPTRAEVSDVANAVLDGTDAVMLSAETAAGRYPVETIEAMAAICVEAEKSQPVHLDTDFLDQTFSRIDQSIAMGALFTAYHLQVKAIAALTDSGATALWMSRHGINVPIYAITPNVASQRKMALYRNVQPLPLAISLDRDEALRQAEELLVARGVVQRGDFIVLTVGEPMGQAGGTNTLKIVRVGMH

SEQ ID NO: 16478 - protein, 223 aa, Platanus x acerifolia
MASASAKLVLVPRVAATNLSSASSTRSTCGPLLKCSSSLTSLKVSAPRSANLVVRNAVRTLETSDISISKDRGLETASLETKPTILVSEKLGEAGLEVLRSFANLDCSYNLSPEELCSKISLCDALIVRSGTKVTRAVFEASKGRLKVVGRAGVGIDNVDLQAATEFGCLVVNAPTANTVAAAEHGIALLASMARNVAQADASIKAGKWQRNKYVGVSLVGKT

SEQ ID NO: 16479 - protein, 452 aa, Pseudomonas fluorescens Pf-5
MSNNLDQLTDWLKDHKITEVECMIGDLTGITRGKISPTNKFIAEKGMRLPESVLLQTVTGDYVEDDIYYELLDPADIDMVCRPDQNAVYLVPWAIEPTAQVIHDTYDKQGNPIELSPRNVLKKVLKLYADHGWQPIVAPEMEFYLTKRSDDPDYPLQPPIGRSGRPETGRQSFSIEAANEFDPLFEDVYDWCELQELDLDTLIHEDGTAQMEINFRHGDALSLADQILVFKRTMREAALKHDVAATFMAKPMTGEPGSAMHLHQSIIDINTGKNVFSNEDGTMSQLFLNHIGGLQKFIPELLPLFAPNVNSFRRFLPDTSAPVNVEWGEENRTVGLRVPDAGPQNRRVENRLPGADANPYLAIAASLLCGYIGMVEGHNPSAPVVGRGYERRNLRLPLTIEDALERMENSKTIEKYLGQKFITGYVAVKRAEHENFKRVISSWEREFLLFAV

SEQ ID NO: 16480 - protein, 401 aa, Rickettsia sibirica 246
MSIISTRLSSIKPSPTLAIVKKTLELKQAGVDIITLGAGEPDFDTPDNIKEAAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNIMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIERTIDVIPA

SEQ ID NO: 16481 - protein, 458 aa, Pseudomonas fluorescens Pf-5
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVTKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKDGKNIFASEDPEQNAALRHAIGGVLETLPAQMAFLCPNVNSYRRFGAQFYVPNSPSWGLDNRTVAIRVPTGSADAVRIEHRVAGADANPYLLMASVLAGVHHGLTNKIEPGAPTEGNSYEQNEQSLPNNLRDALRELDDSEVMAKYIDPKYIDIFVACKESELEEFEHSISDLEYNWYLHTV

SEQ ID NO: 16482 - protein, 513 aa, Pseudomonas fluorescens Pf-5
MTTTPKPLVLMILDGFGHSESHESNAVYAAKKPVLDRLCASMPNGLISGSGMDVGLPDGQMGNSEVGHMNLGAGRVVYQDFTRVTKAIRDGEFFENPTICAAVDKAVDAGKAVHILGLLSDGGVHSHQDHLIAMAELAFKRGAEKIYLHAFLDGRDTPPKSAQSSIELLDETFKTLGKGRIASLIGRYFAMDRDNRWDRVAQAYNLIVDGQGQFNAATAQEGLQAAYAREESDEFVKATTIGEPVKVEDGDAVVFMNFRADRARELTRVFVEDDFKDFERPRQPKLAGFVMLTQYAASIPAPSAFAPGSLENVLGDYLAKNGKTQLRIAETEKYAHVTFFFSGGREEPFPGEERILIPSPKVATYDLQPEMSAPEVTDKIVDAIEHQRYDVIIVNYANGDMVGHSGVFEAAVKAVECLDLCVGRIVDALEKVGGEALITADHGNVEQMSDESTGQAHTAHTTEPVPFIYVGKRALKVREGGVLADVAPTMLKLLGLPKPAEMTGTSILVDPAH

SEQ ID NO: 16483 - protein, 586 aa, Moorella thermoacetica ATCC 39073
MLHHRPGIRFCQPLAPDRLLLRLKIGRREQQSCQVIYEDRGLKTAPMHAYARTPRYLYYQAEISLSRPWRCRYFFRLREGDGDDRYIFAGGTGQQGRPFTYQWTPADIFTVPDWIYDAVSYQIFPDRFYNGNPANDPPGTRPWSEAPTRENFFGGDLEGIQAKIPYLKFLGVNVLWLNPIFAASSNHRYNTRDYLAVDPALGDTDTLRRLVASLHGAGIRIILDGVFNHTGTDFFAFKDVVARGAGSPYKDWYYFYDFPVRSEPRANYACWWDIPSLPKLNVRNPEVRNYLLHVATYWLWDAGTDGWRLDVPNEIEPPFWREFYQQVKGTNPEAYIVGEIWRDARFWLNGRYFDGVMNYLFRDLVLAYFARRLFPISTLDMLLGLVRLRYPEAANFALLNLLGSHDTARIITAFQEGLAGVPGHSGSYAEAVAHLRPALILQLTYPGAPLIYYGDEVGLTGGPDPDCRRTMPWEPRDWDRDLLNFYRCLIRLRHQLRPLRRGFFQPLFTDDQAEVYAYARRLEGEKVIIILNASDLPQTVTLAAAVAGLAEDSTWRDGLSNRLLEVKGGQISLPLDANSGAVLYQE

SEQ ID NO: 16484 - protein, 268 aa, Vicia faba var. minor
MEFAHLTVLSLFCLAFVGITATSSGEDYWQSIWPNTPLPKTFSDLLIPSGITNSLPIKSEELKQYSTLFFEHDLHPGKNFNLGHTNSVGSIIRPFTKSRQGVTDSIWLANKEKQSLEDFCYSPTAIAEHKHCVSSLKSMIDQVISHFGSTKIKAISSNFAPYQDQYVVEDVKKVGDNAVMCHRLNFEKVVFNCHQVRDTTAYVVSLVASDGTKTKALTVCHHDTRGMNPELLYEALEVTPGTVPVCHFIGNKAAAWVPNHTADNLCVM

SEQ ID NO: 16485 - protein, 390 aa, Photobacterium sp. SKA34
MVDSINTMIFELSAIVISAAGLGSLFLFAKQPIIIAYIVAGIIIGPYGLGMINNAEAITQMGHIGVILLLFLLGLNLQPQRLLRLFRESALITLCCSLFFFICTLLFALIIQLPLKDAIITAAAMMFSSTVIGLKLIPTTTLHHQKMGEIMTSILLIQDILAITVLLLLNIDTEQRIDLAIFLIFAKLLIFIVSAYFAVKLILFPLMKKFDVIQEYSFIATLAWCFCWAEISHRIGLSYETGAFIAGTLLAVSPISNVISIHLKPLREFFLILFFFAIGANINLLASDIYTLWGILFGVVLIRLKAWGFHRALIISNTEAPINKELSARLSQASEFSLLLAYTAVANGLISKQGQTFIQIVTLTTFILSTYWIVSRYPTPISNVNTLRQD

SEQ ID NO: 16486 - protein, 89 aa, Brassica napus
  misc_feature (68)..(68): Xaa can be any naturally occurring amino acid
  unsure (1)..(89): unsure at all Xaa locations
SSLRWGFIGNCPGLGEASFSFLGKFCHQFQDIELCGLNGGTDAGFFKWVKSTSVGLGKGNLTGCINVXNNAVFAISVCHGRTWEFFNVD

SEQ ID NO: 16487 - protein, 245 aa, Brassica napus
  misc_feature (221)..(221): Xaa can be any naturally occurring amino acid
  misc_feature (228)..(228): Xaa can be any naturally occurring amino acid
  unsure (1)..(245): unsure at all Xaa locations
RPTRPIDSLTNLEEIILASDGAMVARGDLGAQIPLEQVPAAQQRIVKVCRELNKPVIVASQLLESMIEYPTPTRAEVADVSEAVRQRSDALMLSGESAMGQFPDKALTVLRSVSLRIERWWREEKRYEATPLQAISSASSDKISEEICNSASKMANNLGVDAVFVYTKNGHMASLVSRCRPDCPIFAFTNTTSLRRRLNLQWGLIPFRLSFSEDMESNLNXTFSLLKXRGMIKSGDLVIAVSDML

SEQ ID NO: 16488 - protein, 638 aa, Gibberella zeae PH-1
MVLSAHEISQLRAALQDAVVKCSERCLYQSSKWAAELLNALPETDDDEENINPADPSHVSPIFAANNDPEEAILEARELSKYLLAKSLFDCREYDRCAAVFLPDSLLSSVLASRVDHASASSAAGKGKSKASEAAVPLPKLSQKSLFLALYAKFMSGEKRRNEDSEMVMGPQDLGTVTNKQLLVIGHFLATWFEERTTEDDEVLGSQGWLEYLYGMVLAKEKNDDKALEYFIRSVHKYTMNWGCWLEMTSLISRVEDGPGLANSLEQLLSIFPTSSFLLTCNALLAYHAKDLMAAEQHFTRLLALHPHRLDSLDHYSNILYVLNLRPKLAFLAHLCSSVDKFRPESCVVIGNYYSLLSMHEKAVQYFRRALTLDRSCLSAWTLMGHEYVELKNTHAAIESYRRAVDVNRRDYRAWYGLGQTYEMLEMHTYSLWYYKKAAGLRPWDGKMWMAVGSCLQKMGRERDGIKALKRALLADAYYDVGSSFGSGDLLGSRNATGHMDPDILLQIAVMYDQLGEEEEARSYMELCVAQEDGSGGAAGAEVDPGESIAIHNDSPAGSENGAENDENSNNEGTGVTAATSKARMWLAKFSMRTGDYMTASRLAGELCQDGVEVEEAKALVREVRSRMEATGMLDPLS

SEQ ID NO: 16489 - protein, 285 aa, Thiomicrospira crunogena XCL-2
MNLTICFIGAGNMSISLIGGLIASGYPKDKIRATDPSDARRREITQSMGIHCDEDNIEAATNSDIIVLAVKPQMLESVCQQLSATLQAKRPLVISIAAGVRSTDIDYWLGGNMAIVRTMPNTPALIRSGATGLFANSAVSNAQKEQAEHILRAAGITVWVPKETDLDIVTAISGSGPAYYFLFMEAMQQAGQKLGLDEATARLLTIQTAFGAAKMALESPDDCATLRQKVTSPNGTTEKAIQSFESHQLRETIEEAMKAAKDRAISLANELGSTQTDFQNKTGEK

SEQ ID NO: 16490 - protein, 328 aa, Triticum aestivum
APPCFEANSAALSPSFGPQLRIDLVCNRPPGQPTTCAPGDSLPGGGDATQGGSGFIHAAALVSHSALYSKDLMEERMAAGPAMIHPLEAAPKGSIWKDLFEPGVRRALFVGVGIQMLQQFAGINGVLYYTPQILEQAGVAVLLSNLGLSSASASILISSLTTLLMLPSIGVAMRLMDISGRRFLLLGTIPILIASLIVLVVSNVINLSTVPHAVLSTVSVIVYFCCFVMGFGPIPNILCAEIFPTRVRGVCIAICALTFWICDIIVTYSLPVMLNAIGLAGVFGIYAVVCCIAFVFVYLKVPETKGMPLEVITEFFAVGAKQAQATIA

SEQ ID NO: 16491 - protein, 542 aa, Streptococcus pyogenes M49 591
MTIDKKKVVYQIYPKSYKDTTGNGVGDLRGIIDKLPYLQELGIDMIWLNPFYPSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMGQGNGWNALFYNNHDQPRALNRFIDVTHFRNEGATMLAASIHLSRGTPYIYMGEEIGMLDPDFDSMDDYVDVESLNAYSSLLVSGKSAEEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILAEN

SEQ ID NO: 16492 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 16493 - protein, 516 aa, Arabidopsis thaliana
MLEKVETFDMNRVIDEFDEMTRNAHQVQKQTLKEILLKNQSAIYLQNCGLNGNATDPEEAFKSMVPLVTDVELEPYIKRMVDGDTSPILTGHPVPAISLSSGTGSATTNVYRNPMYKAGMNTITSPSCSPDEVIFSPDVHQALYCHLLSGILFRDQVQYVFAVFAHGLVHAFRTFEQVWEEIVTDIKDGVLSNRITVPSVRTAMSKLLTPNPELAETIRTKCMSLSNWYGLIPALFPNAKYVYGIMTGSMEPYVPKLRHYAGDLPLVSHDYGSSEGWIAANVTPRLSPEEATFAVIPNLGYFEFLPVSETGEGEEKPVGLTQVKIGEEYEVVITNYAGLYRYRLGDVVKVIGFYNNTPQLKFICRRNLILSINIDKNTERDLQLSVESAAKRLSEEKIEVIDFSSYIDVSTDPGHYAIFWEISGETNEDVLQDCCNCLDRAFIDAGYVSSRKCKTIGALELRVVAKGTFRKIQEHFLGLGSSAGQFKMPRCVKPSNAKVLQILCENVVSSYFSTAF

SEQ ID NO: 16494 - protein, 335 aa, Arabidopsis thaliana
MRSYRFSDYLHMSVSFSNDMDLFCGEDSGVFSGESTVDFSSSEVDSWPGDSIACFIEDERHFVPGHDYLSRFQTRSLDASAREDSVAWILKVQAYYNFQPLTAYLAVNYMDRFLYARRLPETSGWPMQLLAVACLSLAAKMEEILVPSLFDFQVAGVKYLFEAKTIKRMELLVLSVLDWRLRSVTPFDFISFFAYKIDPSGTFLGFFISHATEIILSNIKEASFLEYWPSSIAAAAILCVANELPSLSSVVNPHESPETWCDGLSKEKIVRCYRLMKAMAIENNRLNTPKVIAKLRVSVRASSTLTRPSDESSSPCKRRKLSGYSWVGDETSTSN

SEQ ID NO: 16495 - protein, 402 aa, Pseudomonas syringae pv. tomato str. DC3000
MTASRIAARVLRIKPSPSSAAADRANELRRAGKSIINLVVGEPDFDTPAHIRQAACAAIENGETRYTLNAGTATLREAIAAKLQRENGLTYAPGQIVVTSGAKAAIFNAFAATLGVDDEVLIPAPYWVSYPDMVLACDGRPVTLACPEENQFKLTAEQLREAITPRTRWLLLNSPSNPTGATYSAAEWRALADVLLDYPDVLIMTDDIYEHIRYDDTPLSHLLTVEPTLRERVLIINGVSKTYAMTGWRIGYAAGPSDIISAMATLQSQSTSNACSVSQAAAVAALNGDQSFVGESVKVYKQRRDRCLELINAIDGLSCIKPEGAFYLYVNCGALIGKTTPSGAVLHADTDVVLYLLESQGVAVVAGTAYGLAPFFRMSTATAIETLESGCARIATAVAALR

SEQ ID NO: 16496 - protein, 440 aa, Parvularcula bermudensis HTCC2503
MAKDQSYEQGSLSLWGTIAMGTGVMIGAGIFALTGQVAELSGDLFPLAFLFAAAISGFSAYSYIKVASAYPSAGGIAMILKKAYGQTTVTGAAALLMAFSMIINESLVARTFGSYALRPFGVADDSVLIPVLAVGLVVFAFVVNVANNKWIGGISQIAAILKIGGILVFGIVAMAAAGFSFEPYENGLANDTGAFGFLAGTALAILAFKGFTTITNSGDEVKNPEKNVGRAIIISLAICAIVYLVVAFGVASTLSVKEIVAAKDYALAEAARPAVGSLGVGFTVAVALIATASGILASVFAVSRMLTMLTEMKLIPHRHFGMSGPIHRHLLVYTVVLAGTLAAFFDLTRIAALGAIFYLVMDIIIHWGLLRHLREDVGAKGWVVITAITLDTVALLAFVVMKAQQDRLVVAIALVGIALTFVGERIFLQQSQGDEAGAAR

SEQ ID NO: 16497 - protein, 194 aa, Arabidopsis thaliana
MGIFFSKAEPPPPMVLVPPLFDYPPIAARTRMAVPAYELMFGKVSLQNLFEDYFDQAGNMTSRIMLKPLEDPHVDLIATVSAAADRNSGTEVKGDALFRWQRELDDPHTFVDLLVSTSNPLLQLRLCAYHPKYRIGAFGTLPLLMGNRVHSEDYGVMGVRYGSENLSVGASFVPISLSSEVPFGAWLVGRKGSL

SEQ ID NO: 16498 - protein, 250 aa, Photorhabdus luminescens subsp. laumondii TTO1
MAVTKLVLVRHGESEWNRENRFTGWTDVALSEKGRAEAQQAGQLLKEEGFVFDFAYTSVLKRAIHTLWNILDQVDQQWLPVEKSWKLNERHYGALQGLDKAETAAKYGDDQVKLWRRGFAITPPDLTKDDERFPGHDPRYANLKPEELPVTESLATTIERVIPYWEEVIKPRVAQGEKVIIAAHGNSLRALVKYLDNMSEETILELNIPTAVPLVYEFDENMKPIKHYYLGNADEIAAKAAAVANQGKAK

SEQ ID NO: 16499 - protein, 146 aa, Arabidopsis thaliana
  misc_feature (15)..(15): Xaa can be any naturally occurring amino acid
  misc_feature (27)..(27): Xaa can be any naturally occurring amino acid
  misc_feature (64)..(64): Xaa can be any naturally occurring amino acid
  misc_feature (102)..(102): Xaa can be any naturally occurring amino acid
  misc_feature (115)..(115): Xaa can be any naturally occurring amino acid
  misc_feature (129)..(129): Xaa can be any naturally occurring amino acid
  unsure (1)..(146): unsure at all Xaa locations
MAASMLSCAVEVTSXDEAPMVAPFTGXKIFAAYPVPRMTNQDITSIARNGGRVSCMKVWPTHRXKKFETVSYIADLRDVELTKDVDYLVRNKWIPCVEHESXHCSAYCEHGNTQXYYDGLDWTMWKLAXTGCTCSAQVLKEAEECT

SEQ ID NO: 16500 - protein, 468 aa, Pseudomonas fluorescens Pf-5
MSKSVQLIKDHDVKWIDLRFTDTKGTQHHVTMPARDALDEDFFEAGKMFDGSSIAGWKGIEASDMILMPDDETAVLDPFTEEPTLILVCDIIEPSSMQGYDRDPRAIAKRAEEHLKATGIGDTVFAGPEPEFFIFDQVKFKSDISGSMFKIYSEQGSWMSDQDIEGGNKGHRPGVKGGYFPVPPFDHDHEIRTSMCNALEEMGLTVEVHHHEVATAGQNEIGVKFNTLVKKADETQTLKYVVHNVADAYGRTATFMPKPLYGDNGSGMHVHMSIWKDGKNTFAGEGYAGLSDTALYFIGGIIKHGKALNGFTNPATNSYKRLVPGFEAPVMLAYSARNRSASIRIPYVSSPKARRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 16501 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDATYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 16502 - protein, 665 aa, Oryza sativa
  misc_feature (140)..(140): Xaa can be any naturally occurring amino acid
  unsure (1)..(665): unsure at all Xaa locations
MAPHVIVDTYPRACAYGVQRLAQPTALFSHRYKYRQLERHKGINDDGEVVTINVAGVRRCRRAAACVLDGGHGRRRGGGGGGATVEVQPDAADAVRGAGAVWGAGAAGMLCTAAGTGGVPMRVRTEPQLSTSTPSTNHQXQQLPSPPQSHRLRLHPPRAIPLPPAIPRARELASSRSHPSPRLGTGAPSFRRGAGAARIIPSVEPASDRPNGHGRSSNYLERAIVLDEMMKSTVFSAVAVSIGYTLLGWDFTTVLGNPSAEANIHMKKEFGLNNGPSIDGIILAVSVFGSIAITVFSGSLLDWLGRRIVFSYCLIFWMTLIPSPNWRIMIGAIFAPSLVYFALLVFYLPESPRWLVSDGKISEARISLQWLRGKDDVSDRSAGEIALIADGMNMITETAVGGHAVGAVRSQSFLGTSTNQMSRHSTFYWHLSDPLVDLLGSIHESMSELGAGRNSYFPVFNSFNIVEQERASEQRGNDSLQQSREAYSAEEGNNGDNLQASLLSQVASAETNDINTSFTSEGSSSYLRRHGTSTSGLAQDLISSLHDHDIEEDDEEIHIAALSSQPALGSGLHPFRQQIVRLSETADIKPKWRVLLQPGVRHALCYGMLIQALQQTTFNLLLPGDAKYHWAQWGMCDLCIRVLLGSRVRLLKSSRDEGSSLGAHS

SEQ ID NO: 16503 - protein, 355 aa, Coccidioides immitis RS
MAESNGNGASAVGHESINTDIITLTRFLTEEQTKHPEATGDFTLLCHALQFSFKSIAYYIRRASLINLTGLAGSSNTTGDDQKKLDVIGNDLFVASMRGSGKCRILVSEEEDEAILFNECKGARYAVVCDPIDGSSNLDAGVSVGTIFGIFQLPEEVLSENYTVSAKDILLPGTELVASGFTMYGASAQLVITMKGGTVNGFTLENSLGEFILTHPNMRLPAKRAIYSVNEGNSMYWEEWVKAYFHELKFPANGGKPYSSRYIGSMVADAYRTLLYGGIFAYPADSKSPKGKLRILYECAPMAMVFENAGGQAVNSSMQRLLEVVPESIHDRSGIFLGSFDEVQKVIDTHKKFVN

SEQ ID NO: 16504 - protein, 824 aa, Magnetococcus sp. MC-1
MEVSDQSSRPEHDFKCQGTLLQAIHRHVVTTLGNDVFPPRKETYYKGLAYAVRDRLMERWVMAQRDFYDQKAKRVYYLSMEYLPGRFLMNYITNLELEQEVEAAIKDMPFTLQALEEEEWDAGLGNGGLGRLASCFMDSMATLKIPGYGYGLRYDYGIFFQKIVNGYQVEKSDNWIRNGFPWEIKRTGFLYDVNFYGRSQAYIDSVGETRYRWVDTQQVHAMACDIMIPGYGTKHVNNMRLWESVSDEAFSLTHFNDGDYTGAMQAKVREESITKVLYPSDEKAEGRELRLKQQYFMVAATLHDIFRRFKKKHGQEFQKLPDQVAIQLNDTHPSIAVAEFMRRLLDEEMVGWDQAWEIAVKTFAYTNHTVLPEALETWPVELLGRLLPRHLEIIYEINHRFLEMLRQDFPHRPDLQNKLSIIKEGPTRLVRMAHLAIIGSHAVNGVAELHSRIIRESLFRDFNTIYPDRLTNVTNGITPRRWLRQANPELSQLISQAIGDAWIADLDQLKRLIPLADDAAFQQQWIAVKRIKKQQLSAYIQRKLKFSPNPDALFDVQVKRIHEYKRQLLTIMHGIALYRRLLINPQLDMVPRTIILAGKAAPAYHLAKNIIKLANAVAEQINNNPICQGKLSMAFLPNYCISQAEKVIPGADLSEQISTAGMEASGTGNMKFALNGALTIGTLDGANVEIMEEVGAENIFIFGLTSEEVEQWREGGLYNPRWYVERDEELRGVLQMISSDTFCPGQPGLFEPIRASLLERGDYYMVIADFRAYLDRQQEVAETYRNTGEWARRSILNTANMGKFSSDRAIREYARNIWDVEPLR

SEQ ID NO: 16505 - protein, 127 aa, Brassica napus
  misc_feature (37)..(37): Xaa can be any naturally occurring amino acid
  misc_feature (122)..(122): Xaa can be any naturally occurring amino acid
  unsure (1)..(127): unsure at all Xaa locations
RADHTLPAQKGLILKKTFQLEFLSQVVDEPLQGIPFXLTELRGAKTAVEMKGYLIPKGWKVWPWFRAVHMAPEVFPDPKKLDPFGWNKGLFPKPGPFFLLGAGSLLCPEKDLVNFEDLFFLXHHFLL

SEQ ID NO: 16506 - protein, 103 aa, Brassica napus
MANLYVKAAPPPDMNRNTEWFMYPGVWTTYILILFFGWLVVLSVSGCSPGMAWTVVNLAHFVVTYHSFHWMKATPFAMVPPVGNGFTTACPLHTAHHPTRPRK

SEQ ID NO: 16507 - protein, 497 aa, Mesorhizobium loti MAFF303099
MSAHFARSHRHEALDRLADRRLLRELAYVDGHWTASEAAESFEVTDPATGSTVAFVAALDARQTTQAIDAAALAFPAWRSLLPQERSRILRKWFELIITAKDDLALLMTLEQGKPLQESLGEIDYAASFVEWYAEEAKRLNAESVTSHLANAEMMVRREPLGVVGIVTPWNFPSAMLTRKAAAALAAGCTIVAHPSSETPLSALALAELGERAGLPAGVFNIVTGKAATIVGRMCEDTRVRAMSFTGSTEIGRLIAAQSAPTMKRLVMELGGHAPLIVFADADLDKAVSIAIDAKFATSGQDCLAANRIYVQRPIHDRFCAAFAKRIEALRTGNGLDDMTDIGPLLHERAVQKVEEQVADALAHGARCLAGGKRHQAGPLFYQPTLLADVSDAALIMREETFGPVAAVTPFDSEDEVIARANATEYGLVAYVVTDNGARQQRMGRALDYGMVAINRVKITGAPIPFGGVKQSGIGREGSRHGLEAFTDLKYLCLDVA

SEQ ID NO: 16508 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRPEEDDRVRMTPHPVEFELYYSV

SEQ ID NO: 16509 - protein, 218 aa, Candida glabrata CBS 138
MSVPPLTKTISQSSFAESLRDLSSDEDLINKRIGSPNRDHRRRRSSSILSHVEPETFEDENDQHILTNMNATWMDQPGAWIIHVVIILLLAGMYKVMPGMSTKNAWSLTNTTYVIGSYVMFHWIKGTPFEFNGGAYDNLTMWEQIDGETLFTPTRKYLISVPIVLFLIVTHYSRGSHFFSKDFIWNCCVTFFGAILPKLPITHRLRLSIPGFTPAQIS

SEQ ID NO: 16510 - protein, 358 aa, Nostoc sp. PCC 7120
MYDNMSSPLFPVILAGGKGERFWPLSRQDRPKQFLSLDGSSRSLLQSTAERLVKFAGEWNDLWVITSSQLGQGVQQQLPELPSQNLLTEPQGRDTAAAVAWASLEIQKRYGDDAIIGFFPSDHWIADPEAFKRTLDAASQLATSTEAIVTLGIKPTFPSTGYGYIEQGEKIGTFNELPAYHVNRFTEKPIREKAESFLSTGRYSWNSGMFVFRAGVVLKELYTYAPEIIEPLVKHGVDVYPQLPKQSIDYALMEKTNLVYVLPADFGWDDLGDWNAIERLLKKPDNPNVELATHVGLDTQGAIVYATNPEDVIVTIGLEDVVIVRDRNVTLIVNKERTQEIKQILKTLQSDPRFTDLL

SEQ ID NO: 16511 - protein, 480 aa, Pseudomonas fluorescens PfO-1
MQLKDTQLFRQQAFIDGAWVDADNGQTIKVNNPATGEILGTVPKMGAAETRRAIEAADKALPAWRALTAKERAGKLRRWFELMIENQDDLARLMTLEQGKPLAEAKGEIVYAASFIEWFAEEAKRIYGDVIPGHQPDKRLIVIKQPIGVTAAITPWNFPAAMITRKAGPALAAGCTMVLKPASQTPFSAFALAELAQRAGIPKGVFSVVSGSAGDIGSELTSNPIVRKLSFTGSTEIGRQLMSECAKDIKKVSLELGGNAPFIVFDDADLDKAVEGAIISKYRNNGQTCVCANRLYIQDSVYDAFAEKLKVAVAKLKIGNGLEEGTTTGPLIDEKAVAKVQEHIADAVSKGATVLAGGKPMEGNFFEPTILTNVPKDAAVAKEETFGPLAPLFRFKDEADVIAMSNDTEFGLASYFYARDLGRVFRVAEALEYGMVGVNTGLISNEVAPFGGIKASGLGREGSKYGIEDYLEIKYLCLGI

SEQ ID NO: 16512 - protein, 68 aa, Arabidopsis thaliana
AVVVTSPAQATFFAPFTALKAAVLLPGAAKTNKDITSIASNGGRVSCIKLWPPIGKIYFETLSYLPDL

SEQ ID NO: 16513 - protein, 168 aa, Citrullus lanatus
DRIAKLDKTCKFVKGDFMKMPFEDNSFDAIYAIEATCHAPDYGCFKEIYRVLKPGQHFAAYEWCLTNSFDPNNQDHQRIKAEIEIGSGLPDIKTIGKCLEALKQAGFEVIWGKDLAEDSPVPWYLPLDGGQFSITNFRATAIGRCVTKYMVRALEYIHLAPKGSERVQ

SEQ ID NO: 16514 - protein, 269 aa, Rhizobium leguminosarum bv. phaseoli
IQKRLTPARISAMKGGKPIVCLTAYTTPMARLLDEHCDLLLVGDSLGMVLYGMESTIGVTLDMMIAHGKAVMRGVDKACVVVDMPFGTYQESKEIAFRNAVRILQETGCDAIKLEGGEEMADTIAFLTKRGVPVMGHIGLMPQQVQTAGGYRSVGHSEHETSKIRRDAHAIGGSGAFAVVIDGTVEPLAREVTGAMHIPTIGIGASSACDGQVLVSDDILGLFNDFIPRFVKRYDELGKRMSARRRRLVPGGPVATVFRQRSTPFKRRS

SEQ ID NO: 16515 - protein, 343 aa, Listeria monocytogenes str. 4b F2365
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 16516 - protein, 327 aa, Yarrowia lipolytica CLIB122
MADQKEVDLDSVIDRLLEVRGSRPGKQVQLMEHEIRYLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFAMHGGLSPELNTMEQIRRVMRPTDIPDVGLLCDLLWSDPDKDITGWNENDRGVSFTFGPDVVLRFLQKHDMDLICRAHQVVEDGYEFFSKRHLVTLFSAPNYCGEFDNAGAMMSVDESLLCSFQILKPAEKKQKFVYSGMGGGRPVTPPRKQKKAGK

SEQ ID NO: 16517 - protein, 350 aa, Listeria monocytogenes str. 4b F2365
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 16518 - protein, 570 aa, Oryza sativa (japonica cultivar-group)
MATAPPRVSCGSLLQELQVLWGQIGQNEAERDRMILQLEEDCLNVYRKKVEQTRKQKEDLIEELSFGELDIEKILSALGERESFSRVEKLGGTLLEQLAKVEPVLEDLRRRRDERVEEFMVVQAQIVRLHAEISGTIENGDPVPPLVDETNLSLRRLEEFKSQLKELQTEKNLRLQKIDVQINCIHEICNMMSLDLKKELYDVHPSFVELGRTTSMSISDSTLERLAGKVHSLNQEKKQRLRKLQDLGSTLIELWNLMDTPTAEQKCFDHVTSLISVSPSTKMPQGCLARELIEKVEVEVKRLNCLKASKMKELVLKKMIELEEIYKSVHMDIDSDYERRILNDLIDSGKADLSDLLTGMDGRITKAREHALSRKEILEKVEKWTLASEEESWLDEYEKDQNRYNAGRGAHKNLKHAEKARMLVSKIPSLLENLTAKIKAWEKENGVPFMYDKIRLLDSLEEYTSRRQQKDEEKRRSRELKKLQEQYAAEQGATFGTKPSPARPPSARKPLGQSSNANIISGTPTSRRVCTPMARKGGLSSGKVKEAGKTAFIPANYVALPKDCSDNSNL

SEQ ID NO: 16519 - protein, 441 aa, Arabidopsis thaliana [sequence omitted]

SEQ ID NO: 16520 - protein, 816 aa, Pseudomonas fluorescens Pf-5
MTQEPLVRDAEVAAFREAVLTKLTYAVGKDPDHAFDHDWFEAIALAARDHMVDHWMDHTRQIYRKGQKRVYYLSLEFLIGRLLFDSLSNLWLLEVAREALTDLGVDLERIRLLEPDAALGNGGLGRLAACFMESMSTLGIAGHGYGIRYEHGLFRQAIVDGWQQEQTEHWLDFGNPWEFERPEVIYSIGFGGSVDTVTDEAGNTRQVWWPAETVRAVAYDTPVVGWRGASVNTLRLWRARAMEDLHLERFNAGDHLGAVAEVARAESISRVLYPADSTEAGQELRLRQEYFFVSASLQDLLRRHKNMHDSVLSLGEHAAIQLNDTHPSIAVAELMRQLVDLHGIAWDAAWQITVETLSYTNHTLLPEALETWPVGLMERMLPRHMQIIYLINAQHIDSLRAKGLHDFDVLRAVSLIEEDNGRRVRMGNLAFLGSHSVNGVSGLHTQLMRSTVFSELHKLYPERINNKTNGITFRRWLYQANPQLTEMLVEALGPELLDSPEELLRGLEPFAEKPAFRKQFAEQRLHSKRALAAIIHERLGIAINPAAMFDVQVKRIHEYKRQLLNLLHTVALYQAIRAEPETDWVPRVKIFAGKAAASYHQAKLIIKLTNDIARTVNNDPTVRGLLKVVFLPNYNVSLAESIIPAADLSEQISTAGFEASGTSNMKFGLNGALTIGTLDGANVEMCEQVGAEHMFIFGLSAQQVEARKRNGEFSAVPDIAASHRLNDVLQAIRGGVFSPDDPSRYTALIDSLIDYDRFLVCADFDAYWNAQARVEERWHDSKEWWRSAVLNTARMGWFSSDRTIREYATEIWKALE

SEQ ID NO: 16521 - protein, 440 aa, Silicibacter sp. TM1040
MLHPIILAGGVTQTSEWSTGVCHLALETAPGVPSRFEGVLDAMSGDVFADPVVVTTRDNMSLVERQIAARPAALIVEPETHKPAAALLSAVLSLRHMPGALVVVAPATANLADTRNLDKALCNAIPAAQRGEIVMFGQRTTRAYGGFGIMEVVTQPHENAPVAVSRVLASGRKVTLSHLLHGNHQLWGTGLYLARVDVLLAAFKSHASRLFLPVKNALLRAGTVDRTTLLDRATYRRVKAITFEKAVAEKIENICAIQLDPTWSALEEWDQDAAADSAVAQWDEDLAQERAGVLNARAAAPFPHSADMMAVYASLSKISAEDALSAHATEYDWGRLESLAMGPGFTLQRMSIAPGATLDLNAAPGGAEHWIVAQGSVLITIGDHVRLVWEGHSARIPAGRSRRIENPGSGTLVLVQLQVMPLSATGQPQSAASFSPAGVA

SEQ ID NO: 16522 - protein, 125 aa, Triticum aestivum
  misc_feature (32)..(32): Xaa can be any naturally occurring amino acid
  misc_feature (106)..(106): Xaa can be any naturally occurring amino acid
  unsure (1)..(125): unsure at all Xaa locations
DNVIPQPVCALPELLFCTPGALHYLIAEILYXETLNQSTRGRKPYCDILRAYNVLPDILVNKATIDLAVTHDETTTQSFDDLAKRCAEYYEDGARFAQSSAGLKIXASDPSQLSINQNAHGLARL

SEQ ID NO: 16523 - protein, 398 aa, Lactococcus lactis subsp. cremoris
MFQYNTVEEALTALKAGEIIIVTDDENRENEGDLICAAEMISPEKINFMASQAKGLICSPMSEKYAKSLHLSAMTERNTDNHGTAFTVSVDHVETSTGVSAFDRSLTIRKLADEESSVEDFRRPGHVFPLIARKNGVLERNGHTEATVDLLRLAGLKEVGVCVEIMAEDGSMMRTEELQEKAKEWDLNFITIKAIQKYRKQNEQLVEQVTRAKLPTKYGYFEIFGFVNKINGEHHVALVKGDIGEGEAVLCRVHSECLTGDAFGSMKCDCGEQLEQALTQINVEGRGILLYLRQEGRGIGLINKLRAYSLQDEGLDTIEANLALGFEEDAREYSIGAQILKTLGVKSLRLMTNNPQKINDFSKYGLPVKERVPIQIKENEFDQDYLKVKQTKMGHLFD

SEQ ID NO: 16524 - protein, 175 aa, Oryza sativa
MGPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEDAKKAYPDAFVRIIGFDNVRQVQLISLIANKPPGRAEFGGN

SEQ ID NO: 16525 - protein, 336 aa, Pseudomonas fluorescens Pf-5
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTQQVAAGYAIYGPQTMLVLTLGDGVKGFTLDREMGSFVLTHEDIKIPESTQEFAINMSNERHWEAPVKRYVEELLAGDTGPLKKNYNMRWVAAMVADVHRILTRGGLFMYPRDSREPEKPGKLRLMYEANPMSFLVEQAGGASTDGHKRILDIQPEGLHQRVAVFLGSKEEVARVTGYHKE

SEQ ID NO: 16526 - protein, 323 aa, Staphylococcus aureus subsp. aureus MRSA252
MSKYSQDVLQLLYKNKPNYISGQSIAESLNISRTAVKKVIDQLKLEGCKIDSVNHKGHLLQQLPDIWYQGIIDQYTKSSALFDFSEVYDSIDSTQLAAKKSLVGNQSSFFILSDEQTKGRGRFNRHWSSSKGQGLWMSVVLRPNVAFSMISKFNLFIALGIRDAIQHFSQDEVKVKWPNDIYIDNGKVCGFLTEMVANNDGIEAIICGIGINLTQQLEDFDESIRYRATSIQLHDKNKLDRYQFLERLLQEIEKRYNQFLTLPFSEIREEYIAASNIWNRTLLFTENDKQFKGQAIDLDYDGYLIVRDEAGESHRLISADIDF

SEQ ID NO: 16527 - protein, 348 aa, Deinococcus radiodurans
MRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 16528 - protein, 529 aa, Plantago major
MTADHQKSSVASFAVSSGDAGKLGLSSTLDTLPKKPLKRNKYALAISILASMTSVLLGYDCGVMSGATQFIQEDLIITDVQVELLVGTINIYSLVGSAVAGRTSDWVGRRYTIVFASTIFFLGAILMGFATNYAFLMVGRFVAGIGVGYALMIAPVYAAEVAPASCRGFLTSFPEVFINFGVLLGYVSNFAFAKLPLTLGWRMMLGVGAVPSVLLGVGVLYMPESPRWLVLQGRLGDAKKVLDKTSDSLEESKLRLADIKEAAGVPLDCHDEIVQVQKRSQGQGVWKELLLHPTKPVLHILICGVGIHFFQQGIGIDSVVLYSPRIYEKAGIKNTSDKLLATIAVGVSKTFFILITTFFVDRFGRRPLLLTSCAGVALSMFALGTSLTIIDRNPDGNIKGLLIFAVILTMAIVGFFSMGLGPIAWVYSSEIFPLKLRAQGCSMGVAMNRFMSGVILMSFISLYKAITIGGAFFLFGGITTVAFIFFYTLFPETQGRTLEEMEELFGTFFSWRTRMKELDAKKKTGSEAT

SEQ ID NO: 16529 - protein, 530 aa, Plantago major
MNSEHHNSGGLASFSVDAGKSQKPDAASVLDTLPKKPVTRNKYALAISILASMTSVLLGYDTGVMSGATLYIKDDLKISDVQVELLVGTINIYSLVGSAVAGRTSDWVGRRYTTVFASVVFFVGAILMGIATNYVFLMAGRFVAGIGVGYALMIAPVYAAEVAPASCRGFLTSFPEVFINFGVLLGFVSNYAFAKFPLKLGWRMMLGVGAIPAVFLAIGVIYMPESPRWLVLQGRLGDARRVLDKTSDSLEESKLRLADIKEAAGIPEDCNDDFVQVQKHSQGQGVWRELLLHPTKPVLHILICGVGIHFFQQGIGIDSVVLYSPRIYDRAGITDTSDKLLATIAVGISKTFFILITTFYVDRFGRRFLLLVSCAGVALSMFALGTVLTIIDRNPDAKQTGVLVLVVLLTMVIVGFFSMGLGPIAWVYSSEIFPLKLRAQGCGLGVAMNRFMSGVILMSFISLYKEITIGGSFFLFGGITTLGWIFFFTLFPETRGRTLEEMEGLFGTFFKWRTTMKELDAKKRSGTDGA

SEQ ID NO: 16530 - protein, 601 aa, Mycobacterium tuberculosis CDC1551
MNEAEHSVEHPPVQGSHVEGGVVEHPDAKDFGSAAALPADPTWFKHAVFYEVLVRAFFDASADGSGDLRGLIDRLDYLQWLGIDCIWLPPFYDSPLRDGGYDIRDFYKVLPEFGTVDDFVALVDAAHRRGIRIITDLVMNHTSESHPWFQESRRDPDGPYGDYYVWSDTSERYTDARIIFVDTEESNWSFDPVRRQFYWHRFFSHQPDLNYDNPAVQEAMIDVIRFWLGLGIDGFRLDAVPYLFEREGTNCENLPETHAFLKRVRKVVDDEFPGRVLLAEANQWPGDVVEYFGDPNTGGDECHMAFHFPLMPRIFMAVRRESRFPISEIIAQTPPIPDMAQWGIFLRNHDELTLEMVTDEERDYMYAEYAKDPRMKANVGIRRRLAPLLDNDRNQIELFTALLLSLPGSPVLYYGDEIGMGDVIWLGDRDGVRIPMQWTPDRNAGFSTANPGRLYLPPSQDPVYGYQAVNVEAQRDTSTSLLNFTRTMLAVRRRHPAFAVGAFQELGGSNPSVLAYVRQVAGDDGDTVLCVNNLSRFPQPIELDLQQWTNYTPVELTGHVEFPRIGQVPYLLTLPGHGFYWFQLTTHEVGAPPTCGGERRL

SEQ ID NO: 16531 - protein, 270 aa, Oceanobacillus iheyensis HTE831
MKALKDFMRMKHEGEKISMLTAYDYPSAKQAEAAEIDMILVGDSLGMTVLGYESTVDVTLDDMKHHARAVRRGAKDTYVVVDMPFGTIGIDASTDTAFAIELYRDTHANAIKIEGAHAAPVIKKCHDIGIPVVAHLGLTPQSYGITGYQLQATSKEAAKQLIEDAKLVEKSGAIMLVLEAIPSDLAHVITESLTIPVIGIGAGVGTNGQVLVYHDVLNYGVEHKPKFVKRYGDFSIGVESIKNFHDEVKRQAFPTEEYTYKKQIMNEVDE

SEQ ID NO: 16532 - protein, 381 aa, Listeria innocua
MTKSIRPELRDIEVSGIRTFNTRVTGIPDMIRLTLGEPDFPTPEHVKQAAITAIQENFTNYTPNAGMPELLEAASSYFEEKYDLTYSNKEIIVTVGATEAISVALQTILEPGDEVILPDPIYPGYEPLIKLNKARPVKVDTTESNFKLTPEQLRAHITPKTKALIIPYPSNPTGVSLSKQELRDLAEVLKETGIFVIADEIYSELTYHEEHVSIAPMLRDQTIVINGLSKSHAMIGWRIGFLLAPEKITTEMLKIHQYSVTCASSISQKAALEAITNGKDDAFQMRTEYKTRANFTQDRLEKMGFTVIPPDGAFYFFVKLPDDITENSFDWAVRLAEEAKVAVVPGNAFSEKGDRYFRLSYATSVNNLAEALDRMAQFLAK

SEQ ID NO: 16533 - protein, 1108 aa, Chlorobium tepidum TLS
MPKKQAVTSYQPESLWYKDAIIYELHVKTFCDSDNDGIGDFRGLKSRLGYLESLGVTAIWILPFYPSPLRDDGYDIADYKSVNPDYGTIEDFRDFLEEAHRRGIKVITELVVNHTSDQHEWFKKARKAPKGSPERDFYVWSDDPTKYGEARIIFQDFEASNWTWDPVAGQYYWHRFFHHQPDLNFENPAVHQALFDVLDFWLGMGVDGLRLDAVPYLYEAEGTNCENLPQTFEFLRKLRSYVDEHYPNRMLLAEANQWPEDSAAYLGKGDMCHMNFHFPLMPRMYMALATEDRFPIIDILAQTPEIPESCQWASFLRNHDELTLEMVTDEERDYMRRVYAHDVKARINLGIRRRLAPLMSNDRRRIELMNIMLLSLPGTPVLYYGDEIGMGDNYYLGDRDGVRTPMQWNADRNAGFSRANPQRLLLPVIIDPEYHYEAVNVEVQESNPNSLLWWMRHTIATARRFRAFSRGTIEFLNANNPKVLMFIRSYEDETILTVINLSRNAQVINVDLSAYEGCVPEEIFSMNRFPRVHKTPYMVALGPYGYFWLRLIREESPADRSALLEKVALRAGSWQELFVGRSLDQFETAILPPYYKSVRWFGGKARNIIRIRVTDTVPVAGMENTAFAMTEVNYPSGENERYQLPLTFVPVERGNLADELFYRHAIARVELDGLEGFLIDASADETFRSRLLDLILHRETWSGAAGKITADAGKMLENSCLSTAGEEPPASHLMGLEQSNTSIRYGEQLCLKLYRKIDSGMAPEIEISRVLTDQTEYRNIPVYLGSFDYGKSYRERCSLGILQNFVPNESDGWQLSLGHVRRYYEDVLSRCSQGVLPPTLPELSGTTSKLPELIHELIGEFYFQMVGKLAERTAGMHRALGSVDTDAAFSPEPFTTLYQRSIYQAMTDQVKRSMIFLRESIHAVPKEARPLAHKLLDMQKEILEQFEPIRKEKIDTVKIRIHGDYHLGQVLYTGNDFVILDFEGEPARSLSERKIKRSVYRDLAGMLRSFDYAAFNVLMQNQAIRPEDRKALEPWAELWSYYVGQHFIDVYTQQTEGSGLIPKEPRQRELLLRSYLMNKAIYELNYELNNRPEWLPIPMNGILRLIRN

SEQ ID NO: 16534 - protein, 181 aa, Oryza sativa
MGGATSPAAPCLSVCLLPLLFLFLHGCWSCVAIERERTLAMIKPDGLSGNYTERIKEVILESGFDIVKEAVVQLDAERASLFYAEHSGRSFFDSLVKYMTSGPVLVMILERPDAISHWRVLIGPTDARKAKISNPNSIRAMCGVDSEKNCVHGSDSPQSAAREISFFFGDVRSDTVEHDEL

SEQ ID NO: 16535 - protein, 450 aa, Vibrio angustum S14
MARFFKPQKRKTDTKHKEITISRLDHIGAGIGHLNNKPVFIDGALPDETVVVQLTEDKKNYARARVIKRLKDSAARIKPHCPIYDQCGGCNLQHLSHQGQVIAKQQALSELMAKFAITEKDDAAQVEPIVGQSEHYRRCARFSVRMLPNGKMVFGFRKKQSKDIVDVNACPVLATTLNDLLPPLRELLSNLKGRKHVGHIELVNADNGRVLLIRHLQPFNDNDLAAIKAFATEHALMLFLAPSSDELDHVLGEQPYYDIDDVRLTFSPKDFIQVNRDVNVKMVEQAINWLDIQPQDRVLDLFCGLGNFSLPLARRAKAVVGVEGVDEMVARATANAAANGLDNATFYQANLDEDVTKLVWAQEQFDKILLDPARAGAAGVMQHIVNLAPSKVVYVSCNPATLARDSQMLLQQGYKLARLGMMDMFPHTGHLESMTLFVKTNHHKKNSNVM

SEQ ID NO: 16536 - protein, 595 aa, Myxococcus xanthus DK 1622
MSFLQQALVFLAAAVLAVPLSRRLGLGSVLGYLAAGAVIGPWGLKLISDVEHIFHVAELGVVLLLFVIGLELQPSRLWALRRSVFGLGGAQVLFTGALLASVGLLCSLTWGAAIVTGFGLSLSSTAFALQLLAERNRLTTPYGQLAFGILLFQDLAVVPLLALLPLLGDGGAPSPGPVWLLLLKDVGVLLAVVLSGRYLVRPVFRAVAATHSQELFTATALLLVVGTASVVNAVGLSMALGAFLAGVLLADSEYRHELEADLAPFKGLLMGLFFISVGMSVNLSLILQKPLLVFGLVLGLVALKGAVLYGLGRMALGRREPALDLAVVISQGGEFAFVLFSLATAQHVMERSLSELLVVVVGLSMATTPVLYAAHERWVRPRFKPKASGREFDVAPTEDNPVIIAGFGRVGQVVGRLLRAKRIGFTAIDASPEQIDFMKRFGSQVFYGDASRLDLLRAARADKAKVFVLAIDDIEASLRTARAVQQHFPHLTLFARARNRVHAYELLDMGIERVMRETFLDSLEMGAGVLQELGLTYSESRRAQERMMEHDERLLRETARFHRDEQKLVELADKARKELESLFEKDEAEHPDRTA

SEQ ID NO: 16537 - protein, 216 aa, Oryza sativa
  misc_feature (75)..(75): Xaa can be any naturally occurring amino acid
  unsure (1)..(216): unsure at all Xaa locations
RNCYQSLRARGKKEAASSALPTLDRLHETLEMLEKKECFLQKKASAEVERAKDYTKAKNKSAAIQCLKKKKLYEXTKFEQLANFQLRVHDQIIMLESAKATTDTVDALRSGSSAVKAIHQSVSIDDIENAIEEANEHTENMRQIQEALATPIGASADFDEDELEAELEDLEEEELDHELPEPPQSTRMEPSARVTTSSQPANDLAELTKLQAEMAL

SEQ ID NO: 16538 - protein, 954 aa, Pseudomonas fluorescens Pf-5
MLSLSQLREPNAFLNRHLGPDAEEQQAMLASLGLGSRAELIEQTVPPGIRFNRALDLPPALDEAAALARLKGYAGQNQVWTSLIGMGYHATLTPTVILRNVLENPGWYTAYTPYQPEIAQGRLEALLNFQQMTIDLTGLDLANASLLDEATAAAEAMALAKRVSKSSSNLFFVDEHCHPQTVSVVRTRAEGFGFELVVGGVDELSGHQVFGALLQYPDTHGEIRDLRPLIDQLHAQQALACVAADLLSLLLLTPPGELGADVVLGSSQRFGVPMGYGGPHAAFFACRDDYKRAMPGRIIGVSKDARGQVALRMALQTREQHIRREKANSNICTAQVLLANIAGFYAVYHGPAGLKRIAQRVHRLTCILAVGLERHGIARVNRHFFDTLTLEVGGSQTAIIESARAQQINLRILGRGRLGLSLDETCDESTVTRLFDVFLGADHGLDVSNLDAEALESGIPDPLLRRTRYLTHPVFSAHHSETEMLRYLKQLENKDLALNQSMIPLGSCTMKLNASSEMIPITWPEFANLHPFAPREQAAGYGLLIAELERWLCAITGFDAICMQPNSGAQGEYAGLLAIRRYHESRRQGGRHVCLIPASAHGTNPASAQMAGMQVVIVECDEAGNVDLEDLKAKAQAAGERLSCLMATYPSTHGVYEEGISQICEVIHSHGGQVYMDGANLNAQVGLARPADIGADVSHMNLHKTFCIPHGGGGPGMGPIGVRAHLAPFVANHPVVPIDGPLPENGAVSAAPWGSASILPISWMYIALMGPQLADASEVAILAANYLAEQLSGAFPVLYSGRNGRVAHECILDLRPLKAQTGISEEDVAKRLMDYGFHAPTMSFPVPGTLMVEPTESESKAELDRFIEAMLSIRAEIAQVQEGNWPAEDNPLKGAPHTLADITGVWERSYSIEQAVLPTAHTRAHKYWPAVNRVDNVYGDRNLFCACVPLADYR

SEQ ID NO: 16539 - protein, 132 aa, Rickettsia sibirica 246
MIKPDAIKRNKIGQVNTYLENAGLKIVAQKMKFLTKYEAACFYDEHRARPFFNSLVEYITSGAVVLQVLKGEDAITLNRTVMGATNPAEAEAGTIRKDLGESIEANSIHGSDSENSAKREIEFFFNKSEIIE

SEQ ID NO: 16540 - protein, 166 aa, Pavlova lutheri
MQNNRLMKEYREISRGKRDPEISLRLENENSLLRWHAVLQGPPGTPYEGGRFELKIACTSTYPLTPPQVRFVTNVFHPNVLFKTGEICLDILKEDAWTPAWTLQSVCRAVTALLSSPEADSPLNCDAGNLIRSGDVRGFASMAQMYTQLHAMASSEPGCVPSCERT

SEQ ID NO: 16541 - protein, 216 aa, Petunia x hybrida
LISAFFILLFSLSPVSANFDYFQLVLTWPASFCYPKNKCQRRSNNFTIHGLWPEKKRFLEFCTGDKYKRFLEEDNIINVLERHWIQMRFDETYANTKQPLWEHEYNRHGICCKNLYDQKAYFLLAMRLKDKLDLLTTLRTHGITPGTKHTFGEIQKAIKTVTSNNDPDLKCVENIKGVMELNEIGICYTPAADRFDRCRHSNTCDETSSTKILFRG

SEQ ID NO: 16542 - protein, 149 aa, Staphylococcus aureus subsp. aureus MRSA252
MERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLESAEREINLWFNENEITSYASPRDAWLYE

SEQ ID NO: 16543 - protein, 659 aa, Neurospora crassa
MAATTTTTNAGRSMASWKRLSTLIAAFTLSWTSSFVAAAGSADYFVHDLPGAPDGPLVKMHAGHIEVTPDNNGNLFFWHFQNKHIANKQRTVIWLNGGPGCSSEDGALMEIGPYRLKDENTLVYNDGAWNEFANVLFVDNPVGTGFSYVDTNAYIHELTEMAANFVTFLERWFALFPEYEHDDLYIAGESYAGQHIPYIAQAILERNKNAGPVNRKWNLSGLLIGNGWVSPKEQYDAYLQFAYEKDIVKKGTDLANKLEIQQRICQKEIAVKPDKIDYPECEAILQDMLQLTAGGVGASGKNQCYNMYDVRLKDDYPSCGMAWPPDLKSVTPYLRKKEVIKALNINDNKSTGWTECNGQVGMNFNPKTKPSITLLPDILSAGVPILLFSGAEDLICNHLGTEALISNMEWNGGKGFELTPGTWAPRRDWTFEGEPAGFWQQARNLTYVLFYNSSHMVPFDYPRRTRDMLDRFMGVDISSIGGQPTDSRLDGEKLPETTVGGAAGNSTSNQAAEKAKLEMAKWEAYRKSGELVLVIVIVAAGVWGWFVWKERRKTAGQGYMGVATGERHSISNNPGPRGNLSGGGDRTRGQGLAGFRNKRSGRRDVEAQDFDESELDDLHLSKPEDPHADSRYSIGGASDDEEEQKPGKGSSSRQPGGRS

SEQ ID NO: 16544 - protein, 504 aa, Oryza sativa (japonica cultivar-group)
MAAMGRSVRVVLDSSVLLDPSGVTAEEEEVVVALRPGAEALLRRLRYSNLRVAICHPEGLPTNESGFLEKTAKLYSFGYMPLTSPSGSNLLNELMLEWSGTNFCFYVTSGVHEGLLSELQNHNWEVIAMGNEDVIKNSGVIHISMLQELLITLATSIKKEIGNSSAFVVGYVMKQSREEDFAKRGAFPIYPSKNDLIFVPLSFELPLASQLQEVDLVLHKITDEIINIDPNSSISFPKGISFSPGMSEIIRFVEEHCDFCVIDPFKNIYPLLDRIQIQEILIRLEGLSAEGRPKLRAPCFLKIESFCGSELQKQLAEAKLSFPLIVKPQVACGVADAHNMALIFKIEEFSNLSVPLPAILQEYIDHGSKIFKFYAIGDKIFHAIKNSMPNASHLKSSSGGKPLTFNSLKTLPVATKEQLLQNEVQDSKLLDINLVEEAAKLLKELLGLTIFGFDVVVQESSGDHVIVDLNYLPSFKEVPDNVAMPAFWDAIKQSYESRKQMTQT

SEQ ID NO: 16545 - protein, 441 aa, Mycobacterium tuberculosis CDC1551
MSEVVTAAPAPPVVRLPPAVRGPKLFQGLAFVVSRRRLLGRFVRRYGKAFTANILMYGRVVVVADPQLARQVFTSSPEELGNIQPNLSRMFGSGSVFALDGDDHRRRRRLLAPPFHGKSMKNYETIIEEETLRETANWPQGQAFATLPSMMHITLNAILRAIFGAGGSELDELRRLIPPWVTLGSRLAALPKPKRDYGRLSPWGRLAEWRRQYDTVIDKLIEAERADPNFADRTDVLALMLRSTYDDGSIMSRKDIGDELLTLLAAGHETTAATLGWAFERLSRHPDVLAALVEEVDNGGHELRQAAILEVQRARTVIDFAARRVNPPVYQLGEWVIPRGYSIIINIAQIHGDPDVFPQPDRFDPQRYIGSKPSPFAWIPFGGGTRRCVGAAFANMEMDVVLRTVLRHFTLETTTAAGERSHGRGVAFTPKDGGRVVMRRR

SEQ ID NO: 16546 - protein, 316 aa, Zea mays
  misc_feature (37)..(37): Xaa can be any naturally occurring amino acid
  unsure (1)..(316): unsure at all Xaa locations
MRWFYHKGSSGFSSASTAEDVTAGVDGQGLVAVITAXGASSGIGLETARVLALRGVHVVMAVRNVSAGLKAREAIVAKIPVARIDVLELDLSSIASVRRFASNFDSLNLPLSILINNAGVMTRSCTRSCDGLELHFATNHIGHFLLTNLLLENMKKTCRDSGIEGRIVNLTSSAHSITYREGICFDKIHDPSSLNDFVAYGQSKLANILHSNELSRILKEDGVNISANAVHPGVIMTNLFRNRTIVSALLNSIGRIICRTVEQGAATTCYVAMHPQVRGISGKYFTNCDVANPSSQASDAELAKKLWQFSLQIVSS

SEQ ID NO: 16547 - protein, 400 aa, Bartonella quintana str. Toulouse
MAFIADKLSRIKPSATIAVSQKARNLKALGRNVITLGAGEPDFDTPNNIKNAAIEAIRRGETKYTPVSGIPELRQAISAKFKRENNLTYQPEQIIVGTGGKQILFNALMATLNKDDEVIIPSPYWVSYPEMVTLNGGIPIFVETKAEFSYKLQPQELEAAITHKTKWFIFNSPSNPSGAAYTHNELKKLTDVLVKYPHVYILTDDIYEHLIYGGFTFVTPAQVEPNLYNRTLTMNGVSKAYAMTGWRIGYAGGPPELIKAIDTIQGQQTSGTSSISQWAAVEALNGPQDFIAQNKSIFQARRDLVVSILNQAPGINCPTPEGAFYVYPSCAELIGKKTPEGNVINDDEDFVTALLEAESVAVVHGSAFGLGPAFRISYATSEKLLEEACLRIQRFCNNLL

SEQ ID NO: 16548 - protein, 211 aa, Oryza sativa
  misc_feature (74)..(74): Xaa can be any naturally occurring amino acid
  misc_feature (94)..(94): Xaa can be any naturally occurring amino acid
  unsure (1)..(211): unsure at all Xaa locations
ELSRRRRKESSRQPIKSSIDFPWRGRGTEAFPDLGAQCDREDCNQLDFLPFDCDGCGKTFCAEHRTYRDHGCAXRAADQGRTVFFCKACGDAIXRRAGDGGGDDAAVLEAHARSRRCDPARKRKPRCPVPRCKETLTFSNTSGCKGCGQKVCLKHRFPADHACAGAGAGAASKAAGAAAAARSAGQCGRDAQKKEGGGWKLPQSVRNMKIF

SEQ ID NO: 16549 - protein, 338 aa, Oryza sativa
  misc_feature (125)..(125): Xaa can be any naturally occurring amino acid
  unsure (1)..(338): unsure at all Xaa locations
MAKIKIGINGFGRIGRLVARVALQSDDVELVAVNDPFITTDYMTYMFKYDTVHGQWKHHEVKVKDSKTLLFGEKEVTVFGCRNPEEIPWGETGAEFVVESTGVFTDKDKAAAHLKGGAKKVVISXAPSKDAPMFVVGVNEKEYKPDIDIVSNASCTTNCLAPLAKVINDRFGIVEGLMTTVHAITATQKTVDGPSSKDWRGGRAASFNIIPSSTGAAKAVGKVLPALNGKLTGMAFRVPTVDVSVVDLTVRLEKPASYDQIKAAIKEESEGKLKGILGYVEEDLVSTDFQGDNRSSIFDAKAGIALNDNFVKLVSWYDNEWGYSSRVVDLIRHMYNTQ

SEQ ID NO: 16550 - protein, 431 aa, Chlorobium tepidum TLS
MPVLTRSAELFEKAKKFIPGGVNSPVRAFKSVGGTPIYMAKGQGAYMTDVDGNTYLDYVGSWGPFILGSMHPRVTAAIEYTLRNIGTSFGTPIELEIEIAELLCKIVPSLEMVRMVNSGTEATMSAVRLARGYTGKDKIIKFEGCYHGHGDSFLIKAGSGVLTLGDPDSPGVTKGTANDTLNATYNDIESVKAIVNENKGQVAAIIIEPVAGNTGVIPAKKEFLVALRELCDAEGIVLIFDEVMCGFRVALGGAQELYGVTPDLTTMGKIIGGGLPVGAFGGKRHIMENIAPLGSVYQAGTLSGNPLALTAGLETLKILMEENPYPELERKAAFLEAGFKANMEKLGLNYTQNRVGSMACLFFTETPVVDYKSAITADTAKYGKYFHSMLDQGIYLAPSQFEAMFTSFAHTDEDLEKTVKANYNALVAATK

SEQ ID NO: 16551 - protein, 453 aa, Sulfitobacter sp. EE-36
MGNLTFDTLKDLAAKGEVDTVLVALVDMQGRLMGKRFHVTNFIDHSHAETHCCNYLLATDLVMSTPEGFASTSWETGYGDYVLRPDLSTMRHVPWLDKTVLVLGDVLDHHTHEPVSHSPRAMLKKQIARLDALGFDAMMATELEFFLFEGDYRTLQKEKYANLVPLNGHNEDYCLFQTTKEESFLQPLRNHLVGAGIPVECTKGEAEVGQQELNIRYADALACADHHTISKQAVKEIAYQQGFSASFLPKWSADKVGSSSHVHMSLWKDGTPAFYDKDAKLGMSQMMQHFMAGLIAYAPDITYFFAPYINSYKRFAKGTFAPTKTVWSVDNRTAGFRLCGDGTKGIRVECRIGGSDLNPYLAQAVLLAAGLKGIEEKLPLQEPTMGDVYEDANVTEIPRTLRAATQTLRNSAMLREALGDDVVDHYTRAAEWEQEEYDKVVTDWEINRGFERA

SEQ ID NO: 16552 - protein, 469 aa, Methylobacillus flagellatus KT
MAVADVLKLVKENDIKFVDFRFTDTKGKEQHVTVPISAFDEDKFTEGHAFDGSSIAGWKGIQASDMLLIPDPNTANIDPFMDEPTLFLTCDVVDPTDGKGYDRCPRSIAKRAEAYLKSSGIGDAAFFGPEPEFFIFDSINWSVDMSGSSVKINSEEAAWASNEKFEGGNTGHRPGVKGGYFPVPPIDSLHDIRSAMVVALEELGVPVEVHHHEVATAGQCEIGTKFSTLVQRADWTQILKYVVLNTAHAYGKTATFMPKPISGDNGSGMHVHQSVWKDGKNLFAGNGYAGLSEFALYYIGGIIKHARALNAITNPGTNSYKRLVPGFEAPVKLAYSAKNRSASIRVPFVQSDKARRIEARFPDPTANPYLAFSALLMAGLDGVQNKIHPGEPATKDLYHLPPEEDAAIPTVASSLEQALEALDKDREFLTRGGVFSDDWISAYIDLKMEEVTKLRQTPHPIEFSMYYSV

SEQ ID NO: 16553 - protein, 526 aa, Candida albicans
MSANIQALMKSYVNFDEHTSGSAARGILIGMFAAFGGFLFGYDTGTISGVLSMDYVKARFPNNKTDFTSGESSLIVSILSVGTFVGSLIAPLFSDRIGRRWTLILSTLIVFNLGVLLQTVATEKKLLIAGRAIAGTGVGLISSVIPNYISETTPKWARGAVTASYQWMITWGLLIAACANKGSQGRKDSGSYRIPIGIQFLWALILGIGFLFLPETPRYWVSKSEETKAKDSLRRIRNLPVDHPDLVSEYDDIKANFDFESKYATSSWTQVFKNVNKQHHRLFTGVAIQALQQLTGINFIFYYGTQFFKRSGIEDPFLIQLATNIVNVGMTVPGIILVETWGRRPLLMAGSVVMAVSQLIVAIVGVAASSHAANQCLVAFSCIFIAGFAATWGPLCWAICGESFALNVRSKSISLCTASNWLWNFGIGYATPYMVDSGKGNADLGSKVFFIWGGCNVIGGLFAYFMVYETKSLTLEQVDELYLKVDHAWQSKGFVPSVHAFRDDGDIEHISSDGKAEMVEVDENSV

SEQ ID NO: 16554 - protein, 510 aa, Arabidopsis thaliana
MEMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 16555 - protein, 515 aa, Methanosarcina acetivorans C2A
MAQARRPLMLIILDGWGYREVEEGNAVLSAGTPNLDRLVKDYPWCLLEASGGAVGLPEGMMGNSEDGHLNIGAGRIVYQNLTRINISIRNGDFFKNPVFLNAISKVKANDSSLHLIGLVSCGGVHSYTPHLHALIKLAKEKGLKKVYIHAFLDGRDVPPKTALGDIKKLNEFCKEHGGAKIATVSGRYYAMDRDKRWDRTKLAYDVLTLGASQYKAPNAETAVSEAYGRGETDEFVKPTVITDHEEKPVATIRDKDSVIFFNFRADRARQLTWAFVKDDFDGFVREKRPKIYFVCMARYDEDLDLPVAFPHEELKNVLGEVLSKQGLTQLRIAETEKYAHVTFFLNGGEEKRYEGEDRCLIPSPKIATYDLKPEMSAYKITDEVVRRIQSGKYDVIVLNFANMDMVGHTGIFEAAVKAVEAVDKCIGRIVEALKEIGGVALITADHGNAEQMIDSKTGEPHTAHTSNPVRCIYFGNGEVKALKKGKLCDLAPTLLELIGIPKPQEMTGKSLLVKE

SEQ ID NO: 16556 - protein, 279 aa, Stictis sp. 1-MW-2004
AIEHGAVNVVAVNDPFIEAHYAAYMLKYDSQHGQFKGEIKVDGNDLIVKGQKVKFYQEKDPANIPWSETGAYYVVESTGVFTTTEKAKAHLKGGAKKVVISAPSADAPMFVMGVNEKEYKSDIEVISNASCTTNCLAPLAKVLHDNFTIIEGLMTTIHSYTATQKTVDGPSAKDWRGGRTAAQNIIPSSTGAAKAVGKVIPSLNGKLTGMSMRVPTSNVSVVDLTCRLEKAVSYDQIKETIKKASEGEMKGILAYTEDDIVSTDLNGDNHSSIFDAKAG

SEQ ID NO: 16557 - protein, 436 aa, Exiguobacterium sibiricum 255-15
MSLTNQNSKSKAAFERALPLMPGGVNSPVRAYKSVGMTPIFAERAQGSRLYDIDGKEYIDYVLSWGPMILGHADPIVTAAIQEQATRGWSYGTPTEIESAMAEVVISRVPSVEVVRMVNSGTEATMAALRLARGYTGKTKILKFEGCYHGHGDSLLIKAGSGVATLGLPDSPGVPAQIASMTLTVPYNDMDAVRIAFEKHGDDIAGVIVEPAAGNMGFVPPQPGFLEGLREITEQHGTLLIFDEVMTGFRVGFNCAQGHFGVTPDITCLGKVIGGGMPVGAYGGRRDIMEQIAPQGPIYQAGTLSGNPLAMAAGLATLTQLKPEHYEEFDRKANRLSEGYLAAAAKYNIPLTTNRAGAMFGVFFTDQPVTNFEQAKSSNLDMFRSYYQKMAARGVFLPPSQFEGLFLSTVHTDDDIEQTLAAVELTFKELQLEFNR

SEQ ID NO: 16558 - protein, 176 aa, Dendrobium grex Madame Thong-In
LPSLNAGGARLMKSTGTIGNRVASINVENAETNRRALRELLFCAPGALQYLSGVILFEETLYQKTAGGKPFVEVLNEGGVLPGIKVDKGTVELAGTNGETTTQGLDDLGKRCAKYYEAGARFAKWRAVLKIKSHSAFPAFYQSECLWTSSHAIICQENGLEAKHGHQKKRISLSII

SEQ ID NO: 16559 - protein, 241 aa, Triticum aestivum
  misc_feature (65)..(65): Xaa can be any naturally occurring amino acid
  unsure (1)..(241): unsure at all Xaa locations
MGGLSMEHPWAFAFGLLGNVISFSSLLAPIPTFYRIFKSKSTEGFQSVPYVVALFSAMLWIFYAXVKTGEGLLISINAAGCVIETVYIVMYLVYAPRKAKIFTAKIVVLLNIAGFGLIFLLTLFAFHGETRVVTLGWICVGFSVCVFVAPLSIIGRVIKTKSVEYMPFTLSLTLTLSAIVWFLYGLLIKDKYVALPNILGFTFGVIQMVLYVFYMNKTPVASQVKEGKEAWKAPRRGPRRP

SEQ ID NO: 16560 - protein, 427 aa, Burkholderia vietnamiensis G4
MSNNQILFERAQKTIPGGVNSPVRAFRSVGGTPRFVARAQGPYFWDADGKQYIDYIGSWGPMIVGHVHPEVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADIAKHTTVLEYNNVAALEEAFGAFGDEIAAVIVEPVAGNMNLVRGTPEFLNALRALCTKHGAVLIFDEVMCGFRVALGGAQQHYGIAADLTCLGKVIGGGMPAAAFGGRRDIMAHLAPLGGVYQAGTLSGNPIAVAAGLKTLQLIQAPGFYDALTAQTKRLADGLAAEARAAGVPFAADSIGAMFGLYFAERVPASFAEVTKSDVERFNRFFHLMLDEGVYFAPSAYEAGFVSSTHDDAVIDATLAAARRAFAALAA

SEQ ID NO: 16561 - protein, 380 aa, Burkholderia vietnamiensis G4
MTLASTLDIIAELKAGRMVILVDEEDRENEGDLVIAAEFVTPEAINFMARYGRGLICLTLTQERCKQLHLPLMTYRNGTQYGTAFTVSIEAAEGVTTGISAADRAHTIATAVAHDVRPEHIVQPGHVFPIMAQPGGVLVRAGHTEAGCDFTALAGLTPAAVICEIIKDDGTMARLPDLLEFAKEHDLKIGTIADLIQYRSRTESIIERIAERTMQTAHGTFRAVLYRDQPSGSPHIALVRGAPAPDVDTPVRVHEPLSVLDLLETGISTHSWTLDAAMREIAERDLGVIVLLNCGDTKEHLIDVFKAFDEEQKAAALKRRPVDFKTFGIGAQILRDVGVGKMQVLSNPRKLGSMSGYGLEVTGFIPMPGDEAKSCPASNA

SEQ ID NO: 16562 - protein, 300 aa, Solanum tuberosum
RIGRLVARVALQRDDVELVAVNDPFISTDYMTYMFKYDSVHGQWKHHELKVKDEKTLLFGEKAVTVFGIRNPEDIPWAEAGADFVVESTGVFTDKDKAAAHLKGGAKKVAISAPSKDAPMFVVGVNENEYKPELDIVSNASCTTNCLAPLAKVINDRFGIVEGLMTTVHAMTATQKTVDRPSMKDWRGGRAASFNIIPSSTGAAKAVGKVLPSLNGKLTGMAFRVPTADVSVVDLTVRLEKEASYEDIQAAIKEESEGKLKGILGYTEDDVVSTDFVGDSRSSIFDAKAGLALSKNFVKL

SEQ ID NO: 16563 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGSAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 16564 - protein, 280 aa, Streptococcus pneumoniae R6
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQVVAYCREKGILLEAWGPFGQGELFDSKQVQEIAANHGKSVAQIALAWSLAEGFLPLPKSVTTSRIQANLDCFGIELSHEERETLKTIAVQSGAPRVDDVDF

SEQ ID NO: 16565 - protein, 149 aa, Zea mays
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 16566 - protein, 581 aa, Saccharomyces cerevisiae
MTIIHNPKWWKEATVYQIYPASFKDSNNDGWGDLAGITSKLDYVKELGVDAIWVCPFYDSPQEDMGYDIANYEKVWPRYGTNEDCFQMIEEAHKRGIKVIVDLVINHCSEEHEWFKESRSSKANPKRDWFFWRPPKGYDEKGNPIPPNNWRSFFGGSAWRYDEKTGEFFLHVFALGQPDFNWENEECRKAIYDSSVGYWLRHNVDGFRIDVGSMYSKVEGLPDAPITDPTVPYQKGTEFFINGPRIHEYHKEMHNYMLSQVPEGKEIMTVGEVGIGNEDDFRVYTSAKEGELNMMFNFKHTSVGENPKCKYELIPFTLKDFKLALAESFLFIENTDCWSTIYLENHDQPRSVSRFGSDSPKWREISSKMLATLIISLTGTVFIYQGQELGMPNFKNRKIEQIKCVEGTGTYAAIKRDYGEDSEKMKKFFEALALISRDHGRTPFPWSADEPSAGFSKDAKPWIDMNESFRDGINAEAELKDKNSVFFFWKKALQVRKEHKDILVYGHNFQFIDLDNDKLFMFTKDTDNKKMFAVFNFSSDNTDFSVPDNEASYTMFFGNYANSNGDSRTLQPWEGRLYLLK

SEQ ID NO: 16567 - protein, 185 aa, Triticum aestivum
  misc_feature (2)..(2): Xaa can be any naturally occurring amino acid
  misc_feature (10)..(10): Xaa can be any naturally occurring amino acid
  unsure (1)..(185): unsure at all Xaa locations
QXGSRLVAAXYVLYSSATIFCISFGAGTHGFTLDRSTGEFVLTHPSMQIPPRGQIYSVNDARYFDWPEGLKKYIDTIRQGKGQHPKKYSARYVCSLVADFHRTIIYGGVAMNPRDHLRLVYEANPLSFLAEQAGGRGSDGKTRILSIQPVKLHQRLPLFLGSMEDMLELESYGDVQQKVNPGYDV

SEQ ID NO: 16568 - protein, 506 aa, Oryza sativa (japonica cultivar-group)
MVMEGMGMAAAWAAGDLWVLAAAVVAGVVLVDAVVRRAHDWVRVAALGAERRSRLPPGEMGWPMVGSMWAFLRAFKSGNPDAFIASFIRRFGRTGVYRTFMFSSPTILAVTPEACKQVLMDDEGFVTGWPKATVTLIGPKSFVNMSYDDHRRIRKLTAAPINGFDALTTYLSFIDQTVVASLRRWSSPESGQVEFLTELRRMTFKIIVQIFMSGADDATMEALERSYTDLNYGMRAMAINLPGFAYYRALRARRKLVSVLQGVLDGRRAAAAKGFKRSGAMDMMDRLIEAEDERGRRLADDEIVDVLIMYLNAGHESSGHITMWATVFLQENPDIFARAKAEQEEIMRSIPATQNGLTLRDFKKMHFLSQVVDETLRCVNISFVSFRQATRDIFVNGYLIPKGWKVQLWYRSVHMDDQVYPDPKMFNPSRWEGPPPKAGTFLPFGLGARLCPGNDLAKLEISVFLHHFLLGYKLKRANPKCRVRYLPHPRPVDNCLATITKVSDEH

SEQ ID NO: 16569 - protein, 517 aa, uncultured bacterium
MKKSILTTSIFALVAFSSCEKKPAPEVKNYWPQAGVTYEIFVQSFYDSNGDSIGDFNGVTQKLDYVKELGANAIWFMPIMPSPTYHKYDVTDYKAVHPDYGTLDDFKKLLDEAHKRDIKIVIDLIINHTSNEHPWFLEAKSGRDNPYRDYYVWAQKDTIADFLNKKTITFDLDNIRQWHDPGQGEDFYYGFFWGGMPDLNFDNPKVREEIYEIGRFWLEEVGVDGFRLDAAKHIFPDDRPLDNHAFWKEFRAKMEVIKPDVYLVGEVYDKKEVVAPYLPGLPALFNFDFHYTLLETMNTGDGMLLAKKQKEILDFYQGITSSFIDATISSNHDQPRLLNELGSDPAKYKQAIAVMLSMPGAPYLYYGEEIGMLGLKPDEHIREPFLWDEKSKDTGRTKWIKPKYSKDSTVTSLEVQKKDSNSYFNHYKNLIALRNSYPALAIGSLELPAEELPKSVMAYFRKSGDQEIFVVHNVDKEEVDIQLPEGFEEVIFYLGEGKNSSGKLQLKGNSSMVFLKD

SEQ ID NO: 16570 - protein, 191 aa, Zea mays
  misc_feature (29)..(29): Xaa can be any naturally occurring amino acid
  misc_feature (172)..(172): Xaa can be any naturally occurring amino acid
  misc_feature (180)..(180): Xaa can be any naturally occurring amino acid
  unsure (1)..(191): unsure at all Xaa locations
KRPTTRSLASSMFFSADAITSPAQATMVXPFTGLKSSAAFPDTPKRNNYITSIASNAGRVSCMKERPPVGKKKFETLSYLPDLTEVELDKEVDYLLRNKWIPCVEFELEHGFVYREHVCTPGYYDGRYWTMCKLPLVGCTDSAQVLKEFQECKTEYPYAFIRIIGFDNTRQXQCIRFIDXEPPSFTGAKLV

SEQ ID NO: 16571 - protein, 194 aa, Oryza sativa
MAGAAKVSWMVAMSVGAVEALKDQGGLCRWNYALRSIHKAAKANAAGVSQGKKLPASAAAVAERRRAEKAEEGLRTVMHAWILEESDVQSGTIAQDRRLLLVLPANAGSREHWRVQKVRSCISLIYGATFSCRLCQLSRASEYSLASHNTGDPLTCSYLVPSYGTAFGIKGPTAGSAAKITRIFPRVDRVITGK

SEQ ID NO: 16572 - protein, 565 aa, Aspergillus nidulans FGSC A4
MSRRPNPAQAAQNQQTIKALLKLEPNKVCADCKRNKHPRWASWNLGIFICIRCSGIHRGMGTHISRVKSVDLDAWTDEQLQSVVRWGNARANKYWEAKLAPGHVPPEAKIENFIRTKYESKRWVMDGPMPDPSTLDAGDDDVPLAVVQEKAKIERSASQRVAPARQPAVQHRPQASIDLFDDDGVAPPVRPSTTEPSIRAPPKQPQAAPKPTRPGDSLLGLDFFGSAQPAANSRPASVASTPAGGMSRPDLKQSILSLYSKPQPTAHERTSSFGDLASPPPQSTSSSNLGGLTDAFSGLSFPTSPPAQRPAEKPSPFAGLTSFANSKSAPAAPKVTSPTASIGSTGGGLFDSLTSPTAPSAKPQSRTTSISSNSNDFGFSSFQSPPPPKANPPSASLSNDLFGLSSPPISAAPIPPPARSPPPVAAPQPDISSAFNLSQPAPKPVAPPQPLTTTTSIPTLSAAAIDPWGSNAWSTPEPAAPAAPQPSSMMKLPDTLTANDVGAGWGAPSAAASKPTPPTVAEDEDFGGWASAAPISSTSTTNVNAPPKPAGGFSGSDDLFSNVWE

SEQ ID NO: 16573 - protein, 128 aa, Glycine max
  misc_feature (17)..(17): Xaa can be any naturally occurring amino acid
  unsure (1)..(128): unsure at all Xaa locations
ASSMISSPPVTTINRAXAGMAATFTGLTSMAGSPTRNTNNDITYIASNSGRVHCMHVWPPDDKKNFETISYLPDLDDAQLAKEVKYLLRKGWIPCLEFELEHGFVFREHNKSPEYYDGHYCTMWKPPI

SEQ ID NO: 16574 - protein, 133 aa, Brassica napus
MEVATATEASAPAASGGAAGQGHPFPWLDAAISEPYYFLHLLAFFSYFAARSAALSADDGGELHDRLLRREIQAVLVFLVLFVVKIVKEETWEAVIADSLLYAKGLLLAVTLVIDWWLAFAYFLGFLVIYAVA

SEQ ID NO: 16575 - protein, 287 aa, Streptococcus pneumoniae TIGR4
MIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLLRQVILHV

SEQ ID NO: 16576 - protein, 270 aa, Clostridium acetobutylicum ATCC 824
MDSKVGFIGCGNMAQAIIKGMVKAKVVPNENIIVSNPSNEKLEKISKECGVLTTNDNKQVALKADIIVLSVKPNKYEKVISEIKDLVQQSVIIVAIAAGVSIEKTRIMFKNSNIRVVRAMPNTPALVGEAMTAISPCEEIDKGELKNVTEIFESFGKCEVVDEALMNAVTGVSGSSPAYVYMFVEAMADAAVLNGMTREKAYKFAAQSVLGAAKMILETGEHPGKLKDDVCSPSGTTIEAVYALEKSGFRASVIAAVDACIKKSKLMSSK

SEQ ID NO: 16577 - protein, 398 aa, Burkholderia vietnamiensis G4
MNTTADSLVTLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRPVLVPSGPEACFQLTADDVRTRWGNRTRGVLLASPSNPTGTSLEPDELKRIVEAVRARGGFTIVDEIYQGLSYDAAPVSALSYGDDVVTVNSFSKYFSMTGWRLGWLVVPPALVGTFEKLSQNLFICPSALAQHAALACFEPATLDIYEARRLEFKRRRDFIAPALERLGFKVPVMPDGAFYVYAHCGGVAHPAAGDSAALTHAMLHDAGVVLVPGMDFGVHAPRDYIRLSYATAYSRLEEAVERLAKLFGHH

SEQ ID NO: 16578 - protein, 160 aa, Glycine max
MKDKETFPIAKKEASDSGLFGRGSYKFWALAAMLLLAFWSMFTGTVSLRWSGTLNTFSHASLHDHLDVLEIEEREKLVRHMWDVYTNNRRIRLPRFWEKAFEAAYEDLTSDAADVRDVAVAEIVNMSLRSLDLQLPPRARKLSKNLKEVEKGKGATSERA

SEQ ID NO: 16579 - protein, 254 aa, Brassica napus
MARKFFVGGNWKCNGTAEEVKKIVNTLNEAQVPSQDVVEVVVSPPYVFLPLVKSILRPDFYVAAQNCWVKKGGAFTGEVSAEMLVNLNIPWVILGHSERRALLNETNEFVGDKVAYALAQGLKVIACVGETLEQREAGSTMDVVAAQTKAIADRVSNWPNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 16580 - protein, 285 aa, Streptococcus pneumoniae TIGR4
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVHTIIIVLLVRHLCKISL

SEQ ID NO: 16581 - protein, 307 aa, Dechloromonas aromatica RCB
MSIQWFPGHMTQARKKAGETLAVADVVVEVLDARLPQASSNPMIHELRVFRQRPCLKLLNKADLADPEATKAWLAFFDAQPNVKAVAISCKKASDVARIPGLAQKLAPHRNDAVKPLRLMIMGIPNVGKSTLMNALVKKKVAAVGDQPAVTKSQQRIDISNRLTLYDTPGMLWPKIDHPIDGLMLAASHAVGVNAYIDEEVGTWLAEFLLEHYSALLKARYGFATEGMDAVGVIEAIGKKRGCVIKGRGGEIDMERAAAILILDYRSGALGRISLETPELRASRQAELKAAGRLKENPDLATDEGND

SEQ ID NO: 16582 - protein, 519 aa, Zea mays
MLGVGMAAAVLLGAVALLLADAAARRAHWWYREAAEAVLVGAVALVVVDAAARRAHGWYREAALGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 16583 - protein, 179 aa, Pyrus communis
FTQQYQPAVCRSNPTPCKDPTDKLFTVHGLWPSNLNGPHPANCTNATVNSHRIKNIEAQLKIIWPNVLDRTNHVGFWNKQWIKHGSCGNPPIMNDTHYFQTVINMYITRKQNVSGILSKAKIEPVGLKRPLVDIENAIRNSTNNKKPKFKCQTKNRVTELVEISLCSDGSLTQFINCPR

SEQ ID NO: 16584 - protein, 285 aa, Oryza sativa
ASKPTFHIHAILLRLLLLLLLLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTRSAVGQAASVMCLGEMATENDENRVRSLFSAIGKVWTAEEKYFDAVTGLSGSGPAYIFLAIEAMADGGVAAGLPRDLALGLASQTVLGAATMVNKTGKHPGQLKDMVTSPAGTTITGIQELEKGAFRGTLINAVVAATKRCRELSQS

SEQ ID NO: 16585 - protein, 124 aa, Arabidopsis thaliana
  misc_feature (64)..(64): Xaa can be any naturally occurring amino acid
  misc_feature (72)..(72): Xaa can be any naturally occurring amino acid
  misc_feature (104)..(104): Xaa can be any naturally occurring amino acid
  unsure (1)..(124): unsure at all Xaa locations
MASSMLSSAAVVTSPAHATMVAPFTGLKSSAAFPVTLKSNTDITSIASNWGRVSCIKVLPPLGXNNFETRSXLPYLSDFELANEVDYLLCNKWIPCVELELEHXLVIREHCNTPGYYYGQYWTM

SEQ ID NO: 16586 - protein, 175 aa, Triticum aestivum
  misc_feature (128)..(128): Xaa can be any naturally occurring amino acid
  misc_feature (151)..(151): Xaa can be any naturally occurring amino acid
  unsure (1)..(175): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREHNASPGYYDGPATWDNVELPISGCTDAXTQVINEVEESKKEYLTRYVRIIXSTTSSRAWLNSSPTGSKIRKAKYH

SEQ ID NO: 16587 - protein, 181 aa, Oryza sativa
TSNLASPMPLSSNISTQKTHYEVLSVNEGATYDEVRAGYRAAILNAHPDKSQAKLDSLVSSVEHGEFFSVQKAWEVLRDPKSRTEYDKQLQTSRQNSANIAYEIEIEEMTVESTGDAMELMYPCRCGDHFSILSSDLAEMGILVDDDGEIYFQSSDCVSASVVLSCGSCSLKTRLVINRTS

SEQ ID NO: 16588 - protein, 168 aa, Aspergillus nidulans FGSC A4
MSQSKAGRRRRSSSIIYQEPPESIEHTSDQAALPNLNANWVNAKGAWTIHFVLIAALKIFYDILPGVSQETSWTLTNISYMFGSFLMFHWVRGIPFEFNAGAYDNLNMWEQIDNGDQYTPAKKFLLCVPICLFLLSTHYTHYDLTYFVINFLATLGVVLPKLPFLYFT

SEQ ID NO: 16589 - protein, 266 aa, Listeria innocua
MKKIGFIGAGNMGAAMIRGLAKANLGKEEDILVCGRDMEKLKPLKTEFNGIQLTTDIAQLAEQADIIILSVKPYTIPEILTAVKDKITPEKIVISVAAGVTIKDLEELTSTETKIVRVMPNTPALVGEAMSSISPNSNVTAEETAHISTIFSSFGKAEVVAENLMDAVVGVSGSSPAYVYMFIEALADGAVLKGMPRDKAYKFAAQAVLGAAKMVLETGEHPGKLKDMVTSPGGTTIEAVKSLEDTGFRSSVISAVQAAANKNSSM

SEQ ID NO: 16590 - protein, 1116 aa, Xanthomonas campestris pv. vesicatoria str. 85-10
MNAVASLQADAEQSAVVADQRWYKDAIIYQVHVKSFFDSNDDGIGDFPGLISKLDYIAELGVDTIWLLPFYPSPRRDDGYDIAEYMAVHPDYGSIEDFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLEAVLEVMRFWLDRGVDGLRLDAVPYLIERPGTSNENLPETHAILRKIRATLDAEYPDRMLLAEANMWPEDTQQYFGQNADECHMAFHFPLMPRMYMAIAREDRFPITDIMRQTPEIPESCQWAIFLRNHDELTLEMVTDSERDYLWQTYAADRRARINLGIRRRLAPLLERDRRRIELMTSLLLTMPGTPVLYYGDEIGMGDNIHLGDRDGVRTPMQWSIDRNGGFSRADPAQLVLPPVMDPLYGFQAVNVEAQMRDQHSLLTWTRRVLSVRKRYQAFGRGSLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDADESAALLPHLPTLEGEILPAWLSARRWFSAKDQALRSVRIARRTPLPGDEPMTLLELEVELEDGRHERYMLPVGIVWEREQPSTLAEQLALARVRQGREVGYLTDAFALKPMVRGVIDALRSNAALDFCDGDDASQQGQVCFEATPALATLDIPQDPEIRWLSAEQSNSSLVVADKAVFKLLRHVAVGANPEIEIGRRLTEMGYANAAPLLGSVSRIDAQGTVTTIALLQGFIRNQGDAWRWTLDHLARSFDEYATAQTDEARAEAVAGYDAFAAVVGKRLAELHEALSRATDDADFAPQRIDLPTANDVVAGVGRQVEEMWDTVNARLAGSEDSAEREALEAVLAERPQLDALLAQAPSVLADSLLTRVHGDFHLGQILVAFDDVVLIDFEGEPAKPLAERRAKASPLRDVAGFLRSLDYASEVSARGEEGTAARAGVGVDTHLDEFLVQFRRRSTQAFLDAYHAVLDASAHPWIAPAAFNAATLLFLVEKACYEVRYEAANRPGWLMVPIEGLRRILQRARAGAGDT

SEQ ID NO: 16591 - protein, 262 aa, Legionella pneumophila subsp. pneumophila str. Philadelphia 1
MNISFIGYGNMAKAIACHLQKQNKYSLSAASPSLSAGISKENIRTHYDNKEVAKDADVIILAVKPAQMREVVNEINPFISSGCLLISVAAGLSLTWFAKYCKKGQAVVRTMPNTPAIVGFAATSMIANEFVNEKQKKWAEQLFSSIGITDWVKDEEDMDTLTALSGSGPAYVFLFLEAMINAGVQLGLEETVAKHFAIQTFSGSLQLAQHSQLSLTELRKKVTSPGGTTAAALEILHGDLDELIFSAMKAAKQKAHELGKVE

SEQ ID NO: 16592 - protein, 486 aa, Chlorobium tepidum TLS
MKEQLIFDLSRSGRKGYSLSPLDIPERPADELLPSKFLRKEPAELPEMAESEVVRHFIRLSNLNYHVDKNMYPLGSCTMKYNPKINDYTCDLPGFASMHPLQPESTSQGALQLMYELAEMLKEIAGMKAVTLQPAAGAHGELTGILLIKKYHEKLGNKRHKLLVVDSAHGTNPASAALGGYECVSVKCDESGCTDMGDLRAKLDGEVAALMLTNPNTVGIFEKQIPEIEKLVHGNGSLLYMDGANMNALLGITRPGDMGFDVMHYNLHKTFSAPHGGGGPGSGPVGVSERLVEFLPVPVIEKFEKDGQTRYRLNSSKPNTIGRMMNFYGNFSVLVRAYTYIRMLGADGLRRVSENAIINANYLLQRLVEHYALPYPRPVMHEFCLSGDRQKKEHGVRTLDIAKRLLDYGYHAPTVYFPLIVSEALMIEPTETEAKETLNAFADAMIAIAEEAKSNPDLIKSAPTTTPVKRLDEAQASRQLNICCQH

SEQ ID NO: 16593 - protein, 352 aa, Bacillus cereus E33L
MTIDRVCTIGPASNNKETLAQLINNGMKIVRLNLSHGTHESHKDIIRLVKSLDASIKILGDVQGPKIRLGEIKGEQITLQAGDSFMLRTQPGTGSNREASIDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPVESVSTLRLVSEFAVHVKKDGPFVMKDVLELLHKSLDE

SEQ ID NO: 16594 - protein, 478 aa, Rhodopseudomonas palustris CGA009
MNAVGKSSNDPRCVPLIMCGGAGTRLWPASREVRPKQFLPLFGPRSTFQETLLRVSDPALFGRPIIITNTAYRFMVRDQLAEIGIEADVLLEPARRDSGPAIVAGAVFAEQREPGAVVLALAADHVVRDKDAFIAACRDGLAGVAEGRIVTFGVKPERPATEYGYISPGDAIVGKVRNVAKFVEKPDLATAEGYVAAGYLWNSGNFMFPAAALLEEYNAVDPDSVATITEAVTTAGRDLGFVTLPEASFGKAKPISIDYAVMEKTKRAAVVPVDCGWSDVGSWRAVWELTAKDGGGNAAQGPAVFEDSRNCHVSSEHTLVALEGVDDLVVVATQDAVLVSRQKDGNGLKRLVAKVKTVAPEVTDHHAQVHRPWGSYRSLDSGDRHQVKRIIVKPGERLSLQKHHHRSEHWIVVRGTAQVTVDELVKIIHENESIYIPIGATHRLENPGKITLELIEVQTGSYLGEDDIIRFDDDYRRS

SEQ ID NO: 16595 - protein, 476 aa, Novosphingobium aromaticivorans DSM 12444
MTAYPSLHMIIDGARVSGGGRRTHAVVNPATGETIGELPLAEVADLDRALEVAAKGFRIWRDSTPQQRAAVLQGAARLMLERQEDLARIATMEEGKTLPEARIEVLMNVGLFNFYAGEVFRLYGRTLVRPAGQRSTITHEPVGPVAAFAPWNFPLGNPGRKLGAPIAAGCSVILKAAEETPASALGVLQCLLDAGLPKEVAQAVFGVPDEVSRHLLGSSVIRKLSFTGSTVIGKHLMRLAADNMLRTTMELGGHGPVLVFGDADIDKALDTMAASKYRNAGQVCVSPTRFIVEESVFERFRDGFAERVGRIKVGNGLDQDAQMGPMANARRPEAMDRLIGDAVTRGARLHTGGERVGNAGYFYAPTVLSEVPLDAAIMNEEPFGPVALINPFGGEEAMIAEANRLPYGLAAYAWTDSAARAKRLAREIETGMLGLNSTMIGGADSPFGGVKWSGHGSEDGPEGVMACLVTKAVHEG

SEQ ID NO: 16596 - protein, 544 aa, Oryza sativa
MASSKEAYRVELRAAARQLGERGLYSAAKWAAELLVGIDPDATPAPSSAMDTPSSSGSGGHLLHLHRSGGSSFRRRLRPGAAGEAGTPLGGVSYVSTPIPDDDDAFDVGADRLETLYSNIEMNGQYKVLTYSSNTIALMQQGGLRIQAGEKRKEEETVELEGSLGKSNAVNQELVALERELATHRRTGAIDSFCLYLYGIVLRDKGSEALARTVLVESVNSYPWNWSAWLELQSLCTSSDILNNLNLKNHWMKDFFLASAHLELKMHEEALKRYERLMGVFRCSDYIQAQIATVQYSMRDLDEADMIFEELLRTDPFRVDSMDVYSNLLRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRSQSVLPLMDIDHFAMRFKQVILIVCILARRLHSAGDVDFVCVMIASSC

SEQ ID NO: 16597 - protein, 257 aa, Oryza sativa (japonica cultivar-group)
MAAASVLLLLPSPFLRPSSPAHRARCGIATTTTTSTSGRRGLFLFASRCRPGPRRRAASAAVPPEHGLSQPQPQARAVGSYEAALGDAKDALYAALEGMNRGIFGMTSEKRSEIHALVELLESKNPTPEPTDKLQDKVDGCWRLVYSTISILGKKRTKLGLRDFISLGDFFQMIDVKEEKAVNVIKFSARALKILSGQLTIEASYKITTKTKVDITLDSSTITPDQLMNIFQKNYDMLLAIFNPEGWLEITYPFRLM

SEQ ID NO: 16598 - protein, 107 aa, Oryza sativa
MSAGSERAHAAFASPSPVSGAFFSASGSILSGSILSGSILSSSSAAVTTTTSAGRTPSSSSGAPTKKKKKPPFRPVADDTKPVLRDPISRSDPVETEQAVLRLPPFP

SEQ ID NO: 16599 - protein, 323 aa, Arabidopsis thaliana
  misc_feature (94)..(94): Xaa can be any naturally occurring amino acid
  misc_feature (295)..(295): Xaa can be any naturally occurring amino acid
  unsure (1)..(323): unsure at all Xaa locations
MDIDASCSLVLYGKSSVETDTATRLKNNNVLKLPDNSKVSIFLQSEIKNLVRDDDSSFNLSLFMNSISTHRFGRFLIWSPYLSSTHDVVSHFFXNFSEIPVGSVCVSDIQLKGRGRTKNVWESPKGCLMYSFTLEMEDGRVVPLIQYVVSLAVTEAVKDVCDKKGLSYNDVKIKWPNDLYLNGLKIGGILCTSTYRSRKFLVSVGVGLNVDNEQPTTCLNAVLKDVCPPSNLLKREEILGAFFKKFENFFDLFMEQGFKSLEELYYRTWLHSGQRVIAEEKNEDQVVQNVVTIQXIGDDNVMYELHPDGNSFDFFKGLVRRKL

SEQ ID NO: 16600 - protein, 469 aa, Enterobacter gergoviae
MSAEHVLTMLNEHEVKFVDLRFTDTKGKEQHVTIPSHQVNAEFFEEGKMFDGSSIGGWKGINESDMVLMPDASTAVIDPFYEEPTLIIRCDILEPGTLQGYDRDPRSIAKRAEEYLRATGIADTVLFGPETEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRLEENDRVRMTPHPVEFELYYSV

SEQ ID NO: 16601 - protein, 453 aa, Nostoc sp. PCC 7120
MTVTQNLPNGPRIPRLLRLFKFITQPIQYVEDFAKVYGDNFTIWGSGESYFVYFSHPQALEQIFTNVSCFESSGGGSPLLELLLGKNSLILLEGDRHQRQRQLLTPPFHGERMRAYGQTIREITQQVTQAWQMGKPFNIRASMQEITMRVILRVVFGVDEGELFQELRQLLTTLLDFMGSPLMSSTFFFSFTQKDYGAWSPWGRMVRLIKKIDQLIYALIAQRRAEFGENRQDILSLLISARYDDGQPMSDVELRDELMTMLVAGHETTASALTWAFYWIDSVPEVREKLFQELDTLNDDSEPSIIAKLPYLTAVCQETLRFYPIVLNAFFRRTKNPMEIMGYKLPKATLVVPSIYLAHHREEVYPQSKQFRPERFLEKQFSPYEYLPFGGGNRRCIGLAFAQYEMKIVLATILSQFQVSRLSKRPVQPVRRGLTLAAPGGMKMVANKRMRNS

SEQ ID NO: 16602 - protein, 404 aa, Arabidopsis thaliana; identical to SEQ ID NO: 245

SEQ ID NO: 16603 - protein, 787 aa, Clostridium perfringens ATCC 13124
MNKEQIKRGIERYLKVKYGKSSIKDAKDFEIFNALSLTLLEGIVDDWNHTEELYEKEKNAYYFSAEYLMGRALGNNLISLGLYNEVKEVLDELGFDLNRIEEIEEDAGLGNGGLGRLAACFMDSGASLEVPLKGYGIRYNNGLFSQYFEDGFQKEDVDSWLKYGEPWSIRKDDVFVTVDFEDMTVKAIPYDTPIIGYASKNINTLRLWKCEPVKEFDFKLFNEQKYDEALELKNRAEDISRVLYPNDSNREGKLLRLRQQYFLVSASLKDIIRKHKEVFGNVTEDFAKMHAVQLNDTHPVLAIPELIRLLVDEEGFTFEEAYNVASKTFAYTNHTILAEALEKWDVDLIEELFPRILEIIEKIDAEFIVSLEEKGYSEEEIEEFRIVNDGKVRMANLAIHVGFAVNGVAKLHTDILKNIELKNWYELYPEKFQNKTNGITPRRWLRLCNQELSALITELLGNEDWVKNLDLLKGLEKYKDDEEVLKRFMDIKHTKKEQLAAYIKEHEGVQLDPDSIFDIQIKRLHEYKRQLLNTLYILDLYYRLKENPDMDIPKVTFIYGAKAFPGYKRAKSIVKLTNEVAKLINNDESIKGKIKVVFVENYRVSYAEKLFPAADVSKQISTAGKEASGTGNMKFMLNGAPTFGTNDGANVEIVRESGVDNNFIFGLEVEEIEELKGKYDPVAYYEADADLKRVLDSLVDGTFDDGGTGDFEDLYNSLLEEGDQYFLLADFKAFKDTEDKVFEAYKDKLGWAKKAFENTCNAGMFSSDRTIQEYCDDIWGIKKCTNK

SEQ ID NO: 16604 - protein, 273 aa, Lechevalieria aerocolonigenes
MAAPTPEEVRQMYDDFTDPFARIWGENLHFGYWEDAGADVSVDDATDRLTDEMIALLDVRSGDRVLDVGCGIGKPAVRLATARDVRVTGISISRPQVNQANARATAAGLANRVTFSYADAMDLPFEDASFDAVWALESLHHMPDRGRALREMARVLRPGGTVAIADFVLLAPVEGAKKEAVDAFRAGGGVLSLGGIDEYESDVRQAELVVTSTVDISAQARPSLVKTAEAFENARSQVEPFMGAEGLDRMIATFRGLAEVPEAGYVLIGARKP

SEQ ID NO: 16605 - protein, 340 aa, Legionella pneumophila str. Lens
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARKMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 16606 - protein, 498 aa, Mycobacterium abscessus
MDAVEAAQRPGGTMTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDRVIKEALRLLAPVPLVMRKTVRDVAIDGYHIPSNTLCAITPAVNHFDRTIWNDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 16607 - protein, 224 aa, Lactococcus lactis subsp. lactis Il1403
MDNLKKQVGIKAAEFVKSGMVVGLGTGSTAAYFVEELGRRIAEEQLEITGVTTSNVTSSQARALGIPLASIDEVDYVDLTVDGADEIDSSLNGIKGGGAALLMEKIVATYSKDYIWIVDESKLSENLGSFKIPVEVIPYGSQQVFKKFEAAGYAPTWRLNEENERLITDMHHFIIDLHISQIKEPEKLAEELDLMGGVVEHGLFNNMVKKVIVAGNEGVRIINK

SEQ ID NO: 16608 - protein, 612 aa, Corynebacterium efficiens YS-314
MQGRRDVENVSTLVGMTDTTPLSSDLIPESTARPVVDAEGFIIEHESEEYHTPTPAPGEQPWEKHDREWYKDAVFYEVLVRAFYDPDNTGSGTLKGLTEKLDYIQWLGVDCIWVPPFYDSPLRDGGYDIRNFREILPEFGTVEDFVELVDQAHRRGLRVITDLVMNHTSDQHPWFQQSRTDPDGPYGDFYVWGDDPEMYKEARIIFVDTEESNWTYDPVRKQYYWHRFFSHQPDLNYDNPAVQEAMLDVLRFWLDLGLDGFRLDAVPYLFEREGTNGENLPETHEFLKRCRRVIDEEYPGRIVLAEANQWPHDVVEYFGEKEKGDECHMAFHFPLMPRIFMGVRQGSRTPVSEILEHTPDIPKTAQWGIFLRNHDELTLEMVSEEERAYMYQQFAPEPRMRANVGIRRRLATLVDGDRNQLELLHGLLLSLPGSPVLYYGDEIGMGDNIWLPDRDGVRTPMQWSNDRNGGFSKADPERLYLPAIQNDRFGYAQVNVETQLKQENSLLQWIRNQIMIRKQYKAFGKGTYREIDSTNEAVLTFLREYKGQTILCVNNMSKLPQAVALDLSEFAGITPREVSGGQYFPTIGERQCVFTLAPHGFFWLDLTGEEEE

SEQ ID NO: 16609 - protein, 107 aa, Burkholderia vietnamiensis G4
MQILTPAMLAEWLRDPARPAPVVLDVREPWEISTAQIAGSVSIPMQQIPARSEELDDEAEIVCVCHHGMRSAQVAMFLESRGFTKLYNLQGGIDAWSRDVDPAVPRY

SEQ ID NO: 16610 - protein, 2682 aa, Rhodopseudomonas palustris CGA009
MSDSNEIGFAIVGLSGRFPGAPDVQKFWQNIKAGRTSVSRFSPEELEDSFADQERADPDFVAAKPVLDDVDLFDSDYFGMSPREADLTDPQQRIFLEICSEALDDAGYDPERYQGAVGVFAGSSLNTYFLRHVCPDRAALERFTSNFQVGSYSELLGTLNDFIATRVAYKLNLKGPAVSVQSACSTSLLAVAQACESLAALQCDMALAGGVSVTFPQKRGYIYQDGGIASRDGTCRPFDVDAAGTVFGSGAGVVAIKRLADAVADRDAIYAVIRGYGINNDGAAKVGFAAPSVGGQAECIAAALAMAGFEAETIGYVECHGTGTPLGDPIEIEGLSQAFAEASTGAIEDRNCALGSVKANVGHLDAAAGVTGLIKTALILHHGVLPPQANFAEPNPRLDLAKRGFRVATELQEWPRGDAPRRAGVSAFGVGGTNVHLCLEESPPAAAESLLPVENAVVLRLSARSPTALEAMRLRLADHLEAAVQRGERIGLNELAHTLAAGRRTFDRRWAVAVNSVQGAVQSLREVRSDPRPTSLRPGAVFMFPGQGAQYPGMGRWLFESDREFRADVELGAAIVKEHLGVDILAVLFDDRDDDDHAIRSTTLAQPALFLIEYALAQRLLRSGIEPKAMIGHSLGELVAAALAGVMSYQDALKLVVHRGRIMQAQPPGAMLSVRLAASELAAHLPVGVEIASDNSPRLSVASGPFEAVEELECRLERAEIPHRRLHTSHAFHSAMMDPVAVELEKVAAGIPLRPPKRRLISTVTGAWMTAAEATSPAYWARQCREPVSFRAALTTLIDTISERVDCLLVEVGPGRTLATFAGASSSVSKVRAIITTAPDYVERNDEELTFAQALGDLWVHGARLKSDVRPAAGTARLRLPSYPFERTRHWIARPAPVNLDISMPVASAQGDSFPRTEPPQEASSDQGGLHSVSMESKMSGDEVSKALIKALAAILSDVSGRPLSDQDAATSFISLGFDSLLLGQVAQRVNKSFGVKITFRQLMRDLNSLDALAAMLKTSAPADKLPQVERAAVKPQVAMMQRPAEAVLPKDPPVPVMAGATGVEALLREQLQSMERIFAAQLAAVGKEGRVAAELPVTAVPANSGEAPSPDNSPDKALVMPDTGEEGGGRFKIYRPGAGDGDLALAPEQRAYIENLVQRYNDRTPGSKARAQASRRVLADPRTASGFNAQWKEIVYPIVCKRSKGASIWDVDGNEYIDLVNGYGQTMFGHVPPFVAAALQAQLDDGFAIGPQTELAGEVAARISAMTGNERVAFCNTGSEAVMAAIRVARAVTGRLKVVVFSGAYHGQFDEVLIKSCRAGSVPGALPIASGIPAENVGQMIVLPYGHPVSLEIVRQMADDLAAVIVEPIQSRHPALQPRDFVASLRELTAKSGTALVFDEVVTGFRVDPGGMQKVFGIKADMATYGKVLGGGMPIGVVAGRADFMDALDGGFWQYGDESEPEVAPTFFAGTFVRHPMVLAAARAVLEHIERNKAEIYAPLAQRTGQLVDRINSHLDSYGLPTRAETCASWFFVDGSPLGRFAGLLFAELRLQGIHVHEGFPCFLTTAHEAAQCQAIDGAFERAIGAFADAGLSTGETKGITRKSSLIGDDQAQPQPQKFKTVPLTEPQMEVLLAAQMGDAASMAFNESVSIRFNGTLVESALIKAVEEVVRRHEALRSRVVDFTGMLEINPDFVPEVPIIALDGEDADTELAQWLAKDARTPFDLFNGPLVRASVLRLGADVHVLVFTAHHIICDGWSMNVLLGDLAEIYNAYRDGKAPSLVPAASFAEHAAERPRPSASTIEFWRKQFENVPVASELPLDRPRPEVKSFFGASLRERLGQDLCRDARELAKRQGVTLFTVLFASVQTLFARLCDNERVVLTVPMGGQALLDRQDLVGHCVNFLPVPVTARSAVSFCDHLRHVDEKLNEIFDHQDYTLGSLVRDLDIPRSINRTPLSDIQFNLERVGSRLTFRGVDTRVDTNPKAFVNFDIFINMIETDDDLTIEVDYATDLLDRATVSRWLDQLRKILAQALERPEIKLQELKLQNPVVIGLESGQTTTLQAARFDIPLVEMIERNCDRTPDAIAVEYETDVLRYRELDSRSNRIADRLRALAPTKGARVAVAVQRGIDLPVALVAVAKAGLAYVPVDPSLPVVRIRQMAEAAEVAVFITSGADCPVAAEMGVPVIDLERDAAQIDAASSARPEPAPPQEVLDSTAYVIFTSGSTGTPKGVEISHRALANFLGSMAVRPGFGADDRIVAVTTVSFDIAVLELLLPLYCGGRTVICGKDRLLEPDSIVRLIKTSSATIVQATPTLWRVLLEAGLQPSRPLRALSGGEALPRDVAEKLIAAGFELWNMYGPTETTIWSACGRIVDASRPIVIGEPVANTDLYILSDDGTQAPVGTPGELCIGGLGLAKGYVNRPDLTAAAFPVTSLQDGRTVRLYRTGDLAVRLSDGGIQLLGRRDQQVKIRGFRIELEEIESVLRTCPDIVDAAVMVENAGTADAALVAAFVAKPGMAVSIDSLQQTAQLSLPHYMVPNRFVAVAELPKTANGKLDRKALSATIVSPSIVVNFIEKAELRDEPAPDVLTKVIAIVEAALNRTGIKPDDRVFALGATSLHVFRMAARFSEAQLPIRAQDLMTNPSMSDLARRASVAARAQTSDKKTPSLAEFRRPSSRARTT

SEQ ID NO: 16611 - protein, 592 aa, Arabidopsis thaliana
MAFMRLGSKSEAFHREGQTWLCTTGLVSDVTIEVGDMKFHLHKFPLLSRSGLLERLIEESSTDDGSGCVLSLDEIPGGGKTFELVTKFCYGVKIELTAFNVVSLRCAAEYLEMTDNYGEGNLVGMTETFLNEVFGNWTDSIKALQTCEEVIDYAEDLHIISRCVDSLAVKACADPSLFNWPVGGGKNATSGQNTEDESHLWNGISASGKMLQHTGEDWWFDDASFLSLPLFKRLITAIEARGMKLENIAMAVMYYTRKHVPLMNRQVNMDEQVIETPNPSEEDQKTCLEEIVGLLPSKKGVNPTKFLLRLLQTAMVLHASQSSRENLERRIGNQLDQAALVDLLIPNMGYSETLYDVECVLRMIEQFVSSTEQAGIVPSPCIIEEGHLVKDGADLLTPTTLVATLVDGYLAEVAPDVNLKLAKFEAIAAAIPDYARPLDDGVYHAIDVYLKAHPWITDSEREHICRLMNCQKLSLEASTHAAQNERLPLRVIVQVLFFEQLRLRTSVSGWFFVSENLDNPDNQHGANGGLLKPRGENVRERVSELEKECMNMKQELHKLVRTKRSWKNFTRKLNFKKKSECCKPKDQATPAI

SEQ ID NO: 16612 - protein, 468 aa, Silicibacter sp. TM1040
MSKDAVLKLIKDEEAEYVDIRFTDPRGKLQHVTLMSDQVDEDFLDEGFMFDGSSIAGWKSIEASDMKLIPDTESAYVDPFYAEKTICIHCSVVEPDTGEAYERDPRGTAEKAEAYLKASGIGDVAYMGPEAEFFLFDDVRFSNSINKVSYEVDATDASWNTDAEYETGNMGHRPGVKGGYFPVNPVDESQDLRSEMLSTMKRLGMKVDKHHHEVASCQHELGLIFDSLTKQADELQKYKYVIHNVAHAYGKSATFMPKPIAGDNGTGMHVNMSIWKDGKPLFAGDKYADLSQEALYFIGGILKHAKTLNAFTNPSTNSYKRLIPGFEAPVLRAYSARNRSGCVRIPWTESPKAKRVEARFPDPAANPYLAFAALLMAGLDGIKNKIDPGEAMDKNLYDLPAEELADIPTVCGSLREALESLAADHDFLLQGDVFTKDQIEGYIALKMEEVETYEHTPHPVEYQMYYSC

SEQ ID NO: 16613 - protein, 426 aa, Salmonella enterica subsp. enterica serovar Paratyphi A str.
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLCEAAQEAGIPLVVNHVGGMFGIFFTDAETVTCYQDVMACDVERFKRFFHLMLEEGVYLAPSAFEAGFMSVAHSEEDINNTIDAARRVFAKL

SEQ ID NO: 16614 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDTETGYSNKVLDLIAHISK

SEQ ID NO: 16615 - protein, 124 aa, Brassica napus
RPTRPGRSLYLNLIIVLALFASITMAESTGEASSEAKVHIIYTEKPTDEEPKDYHLRTLSSALGSEEAAKDALIYSYKEAASGFSAKLTPEQVTEISKQPGVIQVVPSQTYHLHKPGGAGFKLT

SEQ ID NO: 16616 - protein, 469 aa, Legionella pneumophila subsp. pneumophila str. Philadelphia 1
MTKNVVLDAIKEHDAKFVDLRFTDIRGKEQHITIPVSAVDDDFLENGKMIDGSSFKGWQKIHQSDLALVPDLTSIKPDPFFQDNTLFIRCNVVDPQTMMGYDRCPRSIAQRAENYLQSTGIADGVNFGPEPEFFLFDNVQWETTISGSFYKIDSDEAHWNSGKEMEGGNIGHRPPLKGGYFPVPPVDSSHDIRSAICITLESLGMVVEAHHHEVATANQCEVATRFNTLTKKADELQILKYVIHNVAHNYGKTATFMPKPLVGDNGSGMHCHQSLYKDGYNLFSGDQYSGLSETALYYIGGIIKHARALNAFTNPSTNSYKRLVPGFEAPVLLAYSARNRSAAIRIPHVSNPKARRIEVRFPDPTANPYLAFSAMMMAGIDGIQKKIYPGQPMDKDLYDLPPEELVDVPTVCSSLEMAMDHLRADHEFLLQGDVFSRDFINNYIQMKEEEITKIRSLTHPYEFELYYSL

SEQ ID NO: 16617 - protein, 245 aa, Escherichia coli
MNKNIKYSQNFLTSEKVLNQIIKQLNLKETDTVYEIGTGKGHLTTKLAKISKQVTSIELDNHLFNLSSEKLKLNTRVTLIHQDILQFQFPNKQRYKIVGNIPYHLSTQIIKKVVFESHASDIYLIVEEGFYKRTLDIHRTLGLLLHTQVSIQQLLKLPAECFHPKPRVNSVLIKLTRHTTDVPDKYWKLYTYFVSKWVNREYRQLFTKNQFHQAMKHAKVNNLSTVTYEQVLSIFNSYLLFNGRK

SEQ ID NO: 16618 - protein, 531 aa, Aspergillus niger
MLFRSLLSTAVLAVSLCTDNASAAKHGRFGQKARDAMNIAKRSANAVKHSLKIPVEDYQFLNNKTKPYRVESLPDVHFDLGEMYSGLVPIEKGNVSRSLFFVFQPTIGEPVDEITIWLNGGPGCSSLEAFLQENGRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAGASIYFDRADVKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 16619 - protein, 139 aa, Triticum aestivum
NKFVQKSRLVPVRNSRDIVDPRVRLRAEIKDDNKFREIYNFAFAWAREKGQKSLPLETAIGMWRLLFAERHWPLIDHWCQFLQVRHNKAISRDTWSQLLEFVKTIDPQLSNYDEEGAWPYLIDEFVEYLTENGCVQRNK

SEQ ID NO: 16620 - protein, 170 aa, Triticum turgidum subsp. durum
MASSATSVAPFQGLKSTDGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 16621 - protein, 169 aa, Triticum aestivum
  misc_feature (9)..(9): Xaa can be any naturally occurring amino acid
  unsure (1)..(169): unsure at all Xaa locations
MAPTVMASXDTSVAPFQGFKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGC

SEQ ID NO: 16622 - protein, 403 aa, Pseudomonas syringae pv. tomato str. DC3000
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPIFNDEKFVLDLLLSEKLLVVQGTAFNWPYPDHFRVVTLPRVDELEQAIGRIGNFLKGYRQ

SEQ ID NO: 16623 - protein, 336 aa, Galiella rufa
MVVKVGINGFGRIGRIVFRNAIEHEDIEIVAVNDPFIAADYAVYMLKYDSTHGRFKGEVSHKDGDLIVNGKTIKMYQERDPASIPWSETGAYYVVESTGVFTTIEKASAHLKGGAKKVVISAPSADAPMFVCGVNLEKYSKDINILSNASCTTNCLAPLAKVINDNFGIVEGLMTTVHSYTATQKTVDGPSAKDWRGGRTAAANIIPSSTGAAKAVGKVIPALNGKLTGMSMRVPTQNVSVVDLTVRLEKGASYEEIKKVVKAAAEGDYKGVLEYTEDELVSSDLNGNNASSIFDARAGISLNEKFVKLVAWYDNEWGYSRRVLDLISYIAKVDAK

SEQ ID NO: 16624 - protein, 380 aa, Novosphingobium aromaticivorans DSM 12444
MTEVSPIETIIEDARNGRPYILVDAPDRENEGDVIIPAQFATPNAINFMAMHARGLICLAISSERASHLDLPMMEARNQSSLSTAFTVSIEARDGVTTGISAHDRAHTIAVAVDPSKGPEDLVSPGHVFPLVARDGGVLVRAGHTEAAVDISRLAGLAPAGVICEIMNPDGSMARLPELIEFARKHEMNIGTIADLIEYRRRSESLVERVVEAPFDSWHGDFRIIVYRNVIDSGEHVALVRGDPHQDMPTLVRVHQLDLTADVLGWRAAHRDYVPAALEVLAAHDGPAVAVFVRDNSPTSISERVKGNRKAYADTHGYRDYGIGAQILRDVGVREMVLLSSSAGKLAALEGFGLSVVNRVPLVEDERGKPSRSDQPFASA

SEQ ID NO: 16625 - protein, 450 aa, Arthrobacter nicotinovorans
MLATLASATSEDAVAALEAACAAQTSWARTAPRVRAEILRRAFDLVTARSEDFALLMTLEMGKPLAEARGEVAYGAEFLRWFSEETVRDYGRYLTTPEGKNKILVQHKPVGPCLLITPWNFPLAMATRKVAPAVAAGCTMVLKPAKLTPLTSQLFAQTMMEAGLPAGVLNVVSSSSASGISGPLLKDSRLRKVSFTGSTPVGKRLMSDASRHVLRTSMELGGNAPFVVFEDADLDKAVEGAMAAKMRNMGEACTAANRFLVQESVAQEFTRKFAAAMGALSTGRGTDPASQVGPLINNGARDDIHALVTAAVDAGAVAVTGGAPVDGPGYFYQPTVLADVPNNAAILGQEIFGPVAPVTTFTTEQDAIKLANASEYGLAAYLYSRDFNRLLRVAEQIEFGMVGFNAGIISNAAAPFGGVKQSGLGREGGSEGIAEYTTTQYIGIADPYEN

SEQ ID NO: 16626 - protein, 175 aa, Zea mays
  misc_feature (160)..(160): Xaa can be any naturally occurring amino acid
  unsure (1)..(175): unsure at all Xaa locations
MVLTSNISVQKTLYEVLSVSEDATYDEIRAAYRSAALNTHPDKAQTTLESSSVPSTEQQEFSSVQKAWEVLRHPTSRADYDKQLQSSRQSIEITASEIQVGDMIVESAAGALELLYPCRCGDYFSITSGELSGDGGLSSLGNGEEVEELQASDSASASVXVRGCGSCSLKIRLVL

SEQ ID NO: 16627 - protein, 799 aa, Bacillus licheniformis ATCC 14580
MFSSKESFKQCFLKRVERLCGKSFRDSSTLDQYQTLGIMVREHISANWIETNERSRSNQNKQTYYLSIEFLLGRLLGQNLLNLGVREIVKEGLTELGICLEDIEEAEMDAGLGNGGLGRLAACFLDSLASLDLPGHGMGIRYKHGFFEQKIVDGHQVELPEQWLKHGYVWEIRNADQAVCVRFGGRVKMAQEGGRLRFWQEDAEVMTAVPHDIPIIGYETKTVNTLRLWNAEPCSLHHEPNILKYKRETEAVSECLYPDDTHDEGKILRLKQQYFLVSASLQSIVKRYKNTHPSLHDFHQKVAIHINDTHPALAVPELMRILLDEEKMTWDEAWHVTVHTISYTNHTTLAEALEKWRIDLIKPLLPRIYMIIEEINERFCGWLWEKYPGEWERIEKLAVIAHGEVKMAHLAIVGSYSVNGVANIHSTILKEREMNDFYSVFPFKFNNKTNGISHRRWLLKANPPLANLITEAIGDRWLKDPESLLDLRPFANDSAFLESFQRIKRERKQLLADMMKGSVGFAVNPDSIFDVQVKRLHAYKRQLLNVLHIMYLYNRLKEDKGFAIYPQTFIFGAKASPTYHYAKKVIKLIHSVADKINHDPDVRHSINVIFLENYRVSTAERIFPASDVSEQISAASKEASGTGNMKFMINGALTIGTHDGANIEMLERVGTECIYTFGLKADEVLDYAEKGGYLSREYYQHDARIRQTADQLINGFFEGEAGEFEPIYDSLIAYNDEYFVLKDFASYIVAQERIQKDYLNKRLWAEKAVTNIAHAGYFSSDRTIREYADDIWEIKPYQH

SEQ ID NO: 16628 - protein, 269 aa, Arabidopsis thaliana
MVVGGGGEGDQKRSSGEMMAMASLFNDQQNPIQQFQVKFKEVETNFKTWLSKQSIPVEAAVVSTMSGVQGAFIGGLMGTLSPEMPQAGVDPQAIASMKQAQALVGGPWVQARNFAAITGVNAGIASVMKRIRGKEDIESAVVAALGSGFAYSLVSQGLQGQPMNAITTAAGFAVFQGVFFKLGERFSKPSTEDPFFTRGRTMLVKLGLEKYEKNFKKGLLTDPTLPLLTDSALKDANIPPGPRLMILDHIQRFEFNFSDTPLIKYTNNC

SEQ ID NO: 16629 - protein, 156 aa, Pisum sativum
GPFGGLKFMTGFPVKKVNTDITSITSNGGRVKCMQVWPPIGKKKFETLSYLPPLTRDQLLKEVEYLLRKGWVPCLEFELEKGFVYREHNKSPRYYDGRYWTMWKLPMFGTTDASQVLKELDEVVAAYPQAFVRIIGFDNVRQVQCISFIAHTPESY

SEQ ID NO: 16630 - protein, 158 aa, Arabidopsis thaliana
  misc_feature (123)..(123): Xaa can be any naturally occurring amino acid
  unsure (1)..(158): unsure at all Xaa locations
MQAVSVDETKNTVVLRAEHKNEEGRKSVDKFEVKTRNPETIKSVERKLMEKGVQRMDRHPSDGIPLRRPPSKSGHGGKYTWEGPDRMEDYEMQPDPPAMDEGDPNYDEEQVKKKFFFWGGGGXGDDVAVELVKGEVEVAKEAPAGVARVEVDPRLVGR

SEQ ID NO: 16631 - protein, 127 aa, Glycine max
  misc_feature (50)..(50): Xaa can be any naturally occurring amino acid
  misc_feature (57)..(57): Xaa can be any naturally occurring amino acid
  misc_feature (77)..(77): Xaa can be any naturally occurring amino acid
  misc_feature (98)..(98): Xaa can be any naturally occurring amino acid
  unsure (1)..(127): unsure at all Xaa locations
TTEPSCSRICFTSRGKCHAELIANAENIVPSGKGIIAADETTGTPRHVFXNISVKNXEWGRRSLRELLITAPGVLQXLSAVILYEETLYQSTAGGKPXENDLKEVGALSVITVDKGTNYLAGTNGET

SEQ ID NO: 16632 - protein, 324 aa, Neisseria meningitidis MC58
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 16633 - protein, 149 aa, Oryza sativa (japonica cultivar-group)
MEQSFIMIKPDGVQRGLIGDIISRFEKKGFFLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 16634 - protein, 530 aa, Aspergillus niger
MLFRSLLSTAVLAVSLCTDNASAAKHGRFGQKARDAMNIANGSANAVKHSLKIPVEDYQFLNNKTKRYRVESLPDVHFDLGEMYSGLVPIEKGNVSRSLFFVFQPTIGEPVDETTIWLNGGPGCSSLEALSPGECRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAAPASTLTALIKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 16635 - protein, 485 aa, Pseudomonas syringae pv. syringae B728a
MSTLIPCIIAGGSGTRLWPVSREAMPKPFMRLPDGQSLLQKTFLRAVGLPGVERLLTVTNREVYFRTVDDYRQLNKGNARLDFILEPFGRNTAAAVAAAALHVSQLYGDEAQLLVLPADHLITDVAEFSRAVTAAQKLAAEGWLVTFGILPTAPETGFGYIEKGPVLNADACQVARFVEKPDAITAQGYLDSGQHFWNAGMFCMRADAVLRELRKHAPDVLSAVSACLESSPRKEGNRELQVELDSESFALTPDISIDYALMERSEKVAVVPCQLGWSDIGSWQAVRELSPVDAQGNYCNGETVLHDVSNCYIDSPKRLVGAIGLDNLIIIDTPDALLIADGGRSQDVRIIAQELKRQGHDAYRLHRTVTRPWGTYTVLEEGKRFKIKRIVVRPQASLSLQMHHHRSEHWIVVSGMARVTNGEREFMLDTNESTFIKPGHTHRLVNPGVIDLVMIEVQSGEYLGEDDIVRFTDIYGRVPDKAMKS

SEQ ID NO: 16636 - protein, 255 aa, Candidatus Kuenenia stuttgartiensis
MMDGLKTKIVGSEIIYHEKITSTMDAARELIQTDFKNGTTIFAEEQTNGRGRSNHIWFCPKYKGLLLTILLKYTMKPDNLCLLIGTIAVAITEMVRESFLLQAEIKWPNDLLIGGKKWGGVLVTMEKNHKKQPIFLIGIGININTTETELPKKTSILPTSIAIEKKEYVNRISFARTLLQYIDKWYLILRDEHFKYITEKWKEYCVTVGKDLIITDNGKEYSGKVIGISYNGGLMLKLQNGGTKIFRGEHATIKS

SEQ ID NO: 16637 - protein, 402 aa, Pleurotus eryngii
MLRLILLAAVASASLASPFFSQPSDLATRAVSLTSSCSTTGSASCHNTSSVSNLCCFESPGGLLLQTQFWDTNPSTGPSDKWTIHGLWPDNCDGTFEQNCDPSRAYTNIASLLSSGGASDTLSFMQTNWVDINGQNEQFWAHEWSTHGTCMSTLHTSCIPSGSVRGTEAVAFFQTVVKLYKTLPTFDWLAGQGIRPSTTQTFTLATLTSALKTASGGFTPALDCSSGALNQISWYFNLRGSIIDGTFVPINAPKAGSCPSSGIRYPPKTGSGTPTTPPSNPGGLPTRATIHAIRSGSQTGGLLSLGTWSSQTLATFTLTGTASSFTMTSSKGNCGVSGGSFSCGSGVSPTTFSAVTSGSDLLLASGGSTAWGSDGIPSGSTVFTVFTGSSHSQDYTLTIVGA

SEQ ID NO: 16638 - protein, 470 aa, Coccidioides immitis RS
MNSSVPPATAEYGGDEVSAIILDPGYSSIRAGFAGEDTPKSVTPTYYAKYSTDGQDKHIYGDSIYVSPRPGLSIHNPMGSDGIVEDWDMAEKLWEYSFSSRLTGTKPGNPMLNGLNDTSELPTEMEIVESQEKPLSDSPLLMTECGWNPTKAREKTIEIAMENWGTPAFYLARTGPLAAFAAGKASALVIDVGASTVSVTPVHDGLILKRGVQHSHLAGDYISSQVRALFKQNTPQPITITPHYLISSKTAVDAGQPAQATYRTIPDDQAPDASFRRLLENRTISEFKECVVQVWPGPQGLLNVNPNGVSNEDLAKNSPGRPFEFPDGYNQLFGTDRYRVAESLFDAKAAIPDPDSEFPAPTAAQTIPELVRSALNQVDIDIRPHLLGNVVITGATSLLYGFNDRINSELTAMFPSPRVRLFAPGNTVERKFGSWIGGSIVASLGTFHQMWISKKEYEEHGANIVEKRCK

SEQ ID NO: 16639 - protein, 459 aa, Arabidopsis thaliana
MKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTEQKEKKTMQAKESFESDEDKSKQKEKEQEASPENAVVKDEVSLEKRKLPDPVEEIKHQPGSRMPGDTVLKILMQKIRSLDVSLSVLESYLEERSLKYGMIFKEMDLEASKREKEVETMRLEVEGMKEREENTKKEAMEMRKWRMRVETELEKAENEKEKVKERLEQVLERLEWMEKKGVVVFTICVGFGTIAVVAVVFGMGIVRAEKQGGLAWLLLLISSTFVMFILSL

SEQ ID NO: 16640 - protein, 338 aa, Dianthus caryophyllus
MAPIKIGINGFGRIGRLVARVILQREDCELVAVNDPFITTEYMTYMFKYDSVHGQWKHHDIKVKDEKTLLFGEKAVTVFGNRNPEEIPWGGTGADYVVESTGVFTDKDKAAAHLKGGAKKVIISAPSKDAPMFVVGVNEHEYKPELDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRIEKPATYEQVKAAIKEESEGKLKGILGYTEDDVVSTDFVGDNRSSIFDAKAGIALNDNFIKLVSWYDNEWGYSTRVVDLIAHIHKTCQ

SEQ ID NO: 16641 - protein, 474 aa, Xanthomonas oryzae pv. oryzae KACC10331
MERPRSDAPMPEPSSTTAPQFRRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVITILVFIVLGGAAVIGLLPLADGSPAPGLRHLRADGWFAHGTLPILMTMVAVNFAFSGTELIGVAAGETEQPARAIPLAIRTTLMRLVVFFVGTVLVLAALLPAEQAAVETSPFVRAFELLGIPYAADLLNVVILTAILSAANSGLYAAARMLWSLANEGTLPSGLTRLTGRGIPLRAVSLSMLGGLLALLTGVYAADTVFVAISAVSGFAVVVVWLSICASHYVFRRQLLRDGVAPETLAYRARWYPWTPILGFSLCLLACIGLAFDPQQRIALWCGVPFVALCYGAYALTQRLAARRLHA

SEQ ID NO: 16642 - protein, 324 aa, Mycobacterium sp. MCS
MTIAVTGSIATDHLMRFPGRFADQLLAEHLQKVSLSFLVDDLVVHRGGVAGNMAYAMGILGGQPTLVGAVGKDFDDYRGWLTAHGVDCDNVLVSETAYTARFVCTTDEDMAQLASFYPGAMSESRNIKLADVVARTGTPDLVIIGANDPDAMFLLTEECRTLGLPFAADPSQQLARLSGEEIRKLIDGATYLFTNDYEWDLLLQKSGWSEAEVMRQIQLRVTTLGEKGVDLVGRDGTFVHVDVVPETHKEDPTGIGDAFRAGFLTGRSAGLSLERAAQLASMVATLVLEAPGPQEWRWDKDAGITRLADAYGEDAAKEIASALA

SEQ ID NO: 16643 - protein, 287 aa, Raphanus sativus
EFMNEVRLIARLQHINLVRILGCCIDADERMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWVLGSEATAIPQPKPPVYCLIPSFYANNPSSSRPSDDDESWTMNEYTCSVIDAR

SEQ ID NO: 16644 - protein, 347 aa, Silicibacter pomeroyi DSS-3
MRAAQLTAWRQPLTLATLPDPTPGPGEVVLRVLACGVCRSDWHAWTGADPDVELPLVPGHEFCGEVVALGTGVSRWRLGDRVIAPFILACGRCGDCAAGHQTICANQQVPGFTRNGAFAELIAVPFADTNLTALPDSLPPHVAAGLGCRVTTAWQALVGRAELRPGEWLAVFGGGGVGLSALLLGRALGARVVVVDVVEDKLTHAKSLGADAVVNAADTDAAEAVRELTGGGAHVAVEALGIAATMTGAMRSLRKLGRLVMIGMPAGEHTAMTLPMDVLYSGQLTLQGTRGMPAWRYPSLLSLIDGGHVDLSPLVTRTIALSQASDELAAFDRPAPPGVAVITDFAT

SEQ ID NO: 16645 - protein, 339 aa, Lactococcus lactis subsp. lactis Il1403
MSNQEPIANYKFNYKTTANKVMKNINLSGKTIIITGGYSGIGLEMTKQLSRAGAKIIIPARRMEVAKKNLSKIKNIDILPLDLTNPESIHQFAESFLQNNSKLDILINSAGLMYLPLKRDSRGIEYHFATNHLGHYQLTLELLPALKNAKISRVINLSSRAQQMTPLLEDWNFEKIENYNPQIGYQQSKTANVLFSIKLDELGKKYGIRSFAVHPGMIPMTNIGRQNSPITPWLRYLADYFKLIHIPVFFNALKSGFDRSKYRYLKTIAQGAATPLWASTSPDLEGKGGLYCEDLNIARLMTSEEANNFSGGLRPHAIDHNDADRLWQISKNITGLDFE

SEQ ID NO: 16646 - protein, 290 aa, Raphanus sativus
EFMNEVTLIARLQHINLVQILGCCIDADEKMLIYEYLENLSLDSYLFGKTRSSKLNWKERFDITNGIARGLLYLHQDSRFRIIHRDLKVSNILLDKNMIPKISDFGMARIFARDETEANTKRVVGTYGYMSPEYAMKGIFSEKSDVFSFGVIVLEIVTGKRNIAFNNLNYENNLLGYAWSNWKEGKALEIVDPDIVDSLSPLSSTFQPEEVLKCIQIGLVCVQELAEHRPTMSSVVWMLGSEAAEIPQPKPPGYWVRRSSYEIDPSSSRQCDDDDSWTVNQYTCSVIDAR

SEQ ID NO: 16647 - protein, 495 aa, Arabidopsis thaliana
MAESAGESYRLLSVSSSTTFLAFIIIFLLAGIARRKRRAPHRLPPGSRGWPLIGDTFACLFGKWAVVSADPDFNRFIMQNEGKLFQSSYPKSFRDLVGKDGVITVHGDQQRRLHSIASSMMRHDQLKTHFLEVIPVVMLQTLSNFKDGEVVLLQDICRKVAIHLMVNQLLGVSSESEVDEMSQLFSDFVDGCLSVPIDLPGFTYNKAMKVSFKHLSQLLICGFGACLLRFCLFLIQARKEIIRKINKTIEKRLQNKAASDTAGNGVLGRLLEEESLPNESMADFIINLLFAGNETTSKTMLFAVYFLTHCPKAMTQLLEEHDRLAGGMLTWQDYKTMDFTQCVIDETLRLGGIAIWLMREAKEDVSYQDYVIPKGCFVVPFLSAVHLDESYYKESLSFNPWRWLDPETQQKRNWRTSPFYCPFGGGTRFCPGAELARLQIALFLHYFITTYKSVHVMLLKWTQLKEDRISFFPSARLVNGFKIQLNRRDSDPPNQ

SEQ ID NO: 16648 - protein, 454 aa, Exiguobacterium sibiricum 255-15
MESNLKRELTARQVQMIALGGTIGVGLFLGSSSTIAWTGPSVILAYMFAGAFIFLIMRALGEMVYTHPHTGSYAKFANDYIHPAAGFMTASSNIFNWVIVGMSEVIAVGAYMRFWWPDLPTWIPGVVVIVILTLANLASVKMFGELEFWFASVKVITIILMIIAGLGLILFGFGNDGTPIGFSNLWSHGGFFTNGFSGFFFALSIVFASYIGVELIGVTAGETKDPETNITRAINGVIWRILIFYVGAIFIIVTVYPWDQLADIGSPFVATFAKVGITAAAAIINVVVITAAMSGCNSGIFSSSRMIYTLAEKGQMPSLFLKVNKNGIPLYTVLAVSAGIFVGVILDIVLPLFLGKDTNIFVYVYSASVLPGMVPWFAILISHIQYRKIEADRIADHPFKMPGAPFTNYITIVMLLIVLVGMLFNDETRVSILIGIVFLILSGIYYIVRTPKSF

SEQ ID NO: 16649 - protein, 544 aa, Glycine max
MNNSVSENSFIIESDEEDEEKDLNKGGVDGNDSDSSNYSNENPPQRKPSSYNISWPQSYRQSIDLYSSVPSPNIGYLGTPSLSRLSSSFLSTSLTRRHTPEALPSVAKPLIQDTEDEQHQRRSSHTLLPPLPSRRSSLIKKDSKVIHHEVPSGHCSFGQAVLNGINVLCGVGILSTPYAAKVGGWLGLSILVIFAIISFYTGLLLRSCLDSEPELETYPDIGQAAFGTTGRIAISIVLYVELYACCIEYIILEGDNLSSLFPSAHLNLGGIELNSHTLFAVITTLAVLPTVWLRDLSILSYISAGGVVASILVVLCLLWVGIEDVGFHSKGTTLNLATLPVAVGLYGYCYSGHAVFPNIYTSMANPNQFPGVLLACFGICTLLYAGAAVLGYTMFGEAILSQFTLNMPKELVATKIAVWTTVVNPFTKYALTISPVAMSLEELIPSNHAKSYLYSIFIRTGLVLSTLVIGLSVPFFGLVMSLIGSLLTMLVTLILPCACFLRILRGKVTRTQAALCITIITVGVVCSAFGSYSALAEIVKSLRG

SEQ ID NO: 16650 - protein, 358 aa, Arabidopsis thaliana
MSAFVSKYEDELIKTAKYIATPGRGILAADESTETIGKRFAGINVENTESNRQAYRELLFTSPGSYPCLSGVILFEETLYQKTSDGKPFVDLLMENGVIPGIKVDKGLVDLAGTNGETTTQGLDSLGARCQQYYEAGARFAKWRAFFKIGATEPSVLSIQEDARVLARYAIICQENGLVPIVEPEVLTGGSHDIKKCAAVTETVLAAVFKALNYHHVLLEGTLLKPNMVTPGSDSPKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYRY

SEQ ID NO: 16651 - protein, 399 aa, Arabidopsis thaliana
MASSTATMLKASPVKSDWVKGQSLLLRQPSSVSAIRSHVAPSALTVRAASAYADELVKTAKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHSIDRTYDVAEKVWAEVFFYLAQNNVMFEGILLKPSMVTPGAEATDRATPEQVASYTLKLLRNRIPPAVPGIMFLSGGQSGLEATLNLNAMNQAPNPWHVSFSYARALQNTCLKTWGGKEENVKAAQDILLARAKANSLAQLGKYTGEGESEEAKEGMFVKGYTY

SEQ ID NO: 16652 - protein, 285 aa, Bradyrhizobium japonicum USDA 110
MWPRAAVGGPAMQMNDKTVLITGSTDGVGRYVARRLAAECAKVLIHGRDAARAKTLIDEIVKAGHAAPIFYQADLSSMSGTRALAEAVKRDHQRLDVFVSNAGIGSQSDGPQRQVSADGHELRFAVNYLSGFLLAHLLLPLLKAAAPSRIVNVASLGQHPIDFDDVMITKGYSGSRAYAQSKLAQIMFTIDFAEEVKGAGVTVNSLHPATYMNTTMVRAGGITPISTVEQGGAAILRLVEGDDVAGKSGLFFNGINEARANPQAYDADARKRLRALSLELVGISS

SEQ ID NO: 16653 - protein, 393 aa, Triticum aestivum
METVAAAGYAHGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 16654 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 16655 - protein, 298 aa, Zea mays
MARYDELASKSNVEYIAGGATQNSIRVAQWMLQIPGASSYIGCIGKDKFGEEMKKNAQAAGINAHYHEDENAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWETENVEEIALKISQLPKASGTHKKITVITQGCDPVVVADDGKVKTFPVILLPKEKLVDTNGAGDAFVGGFLSQLVQEKNIDECVRAACYAANVVIQRSGCTYPEKPDFN

SEQ ID NO: 16656 - protein, 340 aa, Pinus sylvestris
MGSTGKIKIGINGFGRIGRLVARVALTRDDIELVGVNDPFISTDYMSYMFKYDSVHGKWKHHEVNVKDSKTLLFGEKSVAVFGCRNPEEIPWGEVGAEYVVESTGVFTDKEKASAHLKAGAKKVVISAPSKDAPMFVVGVNEHQYKSDVNIVSNASCTTNCLAPLAKVINDKFGIVEGLMTTVHSITATQKTVDGPSNKDWRGGRGAGFNIIPSSTGAAKAVGKVLPALNGKLTGMAFRVPTPDVSVVDLTVRLEKSATYDEIKAAIKAESEGNLKGILGYTEDAVVSTDFIGDSRSSIFDAQAGIALSDNFVKLVSWYDNEWGYSSRVVDLIVHMAATQ

SEQ ID NO: 16657 - protein, 338 aa, Glomerella cingulata
MAPIKVGINGFGRIGRIVFRNAIEHPEVEIVAVNDPFIETKYAAYMLKYDSTHGIFNGEIKQEGNDLVINGKTVKFYTERDPAAIPWKETGADYVVESTGVFTTTDKAKAHLQGGAKKVIISAPSADAPMYVMVVNEKSYDGSADVISNASCTTNCLAPLAKVINDKFGIVEGLMTTVHSYTATQKTVHGPSAKDWRGGRTAAQNIIPSSTGAAKAVGKVIPELNGKLTDMSMRVPTTNVSVVDLTARIEKGASYDEIKQAIKEAAEGPLKGVLAYTEDDVVSTDMIGNPNSSIFDAKAGISLNNNFVKLVSWYDNEWGYSRRVLDLLAHVAKVDASK

SEQ ID NO: 16658 - protein, 146 aa, Brassica napus
MDSRTKVKKGAGGRRGGGPKKKPVSRSVKAGLQFPVGRIGRYLKKGRYSKRVGTGAPVYLAAVLEYLAAEVLELAGNAARDNKKNRIIPRHVLLAVRNDDELGKLLKGVTIAHGGVLPNVNPVLLPKKSAKAASTTKVIKSPSKAT

SEQ ID NO: 16659 - protein, 287 aa, Raphanus sativus
EFMNEVRLIARLQHINLVRILGCCIDPDEKILIYEYLENSSLDYFLFGKKRSSNLNWKDRFAITNGVARGLVYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWMLGSEATAIPQPKPPVYCLIPSFYANNPSSSRPSDDDKSWTMNEYTCSVIDAR

SEQ ID NO: 16660 - protein, 290 aa, Raphanus sativus
EFMNEVTLIARLQHINLVQVLGCCIDGDEKMLIYEYLENLSLDSFLFGKTRSSKLSWKERFDITNGVARGLLYLHQDSRFRIIHRDLKVSNILLDKNMIPKISDFGMARIFERDETEASTMKVVGTYGYMSPEYAMNGIFSEKSDVFSFGVIVLEIVTGQRNRGFYNLNYKNNFLSYAWSNWKEGRALEIVDPVIIDSLSPLSSTSQPKEVLKSIKIGLLCVQEHAEDRPTMSTVVWMLGSEETEIPQPNPPGYCVRRSPHELDPSASRQLDDDESWTVNQYTCSVIDAR

SEQ ID NO: 16661 - protein, 389 aa, Solibacter usitatus Ellin6076
MKANCWRGKKKMEVEQVPDPKILNSQDAIVKITSTAICGSDLHLYNGFVPSMQDGDIVGHEFMGEVMEVGKDVGKLKVGDRVVVPFPISCGKCFFCEKQMYSLCENSNPNAWLAEKLWGHSPAGLFGYSHLLGGFAGGQAEYARVPFADVGPIRIENGFTDEQVLFLSDIFPTGYMAAEACDIQPGDTIAVWGCGPVGLFAIKSAFLLGAERVIAIDRFPERLKMAREKCGAVTLNYEHVDVLDTLKEMTGGRGPDSCIDSVGMEAHGHGAMYAYDRAKQALMLESDRPIALREAIMACRNGGTVSVPGVYGGLVDKLPMGSVMNRSLVIKTGQTHVQRYLRPLLQRIENGEIDPSFVVTHRLPLDEAPKAYDMFLNKTDDCIKVVLKP

SEQ ID NO: 16662 - protein, 778 aa, Nostoc punctiforme PCC 73102
MQEDFRLIVDLVLVLGVAACGGLLAALLRQPVLLGYLIGGMIVGPAGLGLIKEVIQVETLAQFGVAFLLFALGVEFSFAELKKVKAIALGGGGLQIALTILVTVVVSGLSGAWGTLPAKGMFLGCILSLSSTAVVLKCLMERNETETPHGQVMLGILVVQDLALGLMLAVLPALNQPAETIGIAVLTALLWIALFAAGAVAAGMWLIPPLLRLLARTESRELFLLGVVALCLGIALLTEHLGLSIEMGAFVAGLMISEVEYADQTLTYVEPLRDIFASLFFAAIGMLIDPVFLWNNLELILGLVALVFIGKFLIITPLVKLFRYPLKTAIIAGLGLAQIGEFSFVLASEGQSLGLVSRQIYLLILGTTAVTLMLTPFVLRLVPFLFNFAESMPWLKPYLEEQEALDVSEDLPFKDHVVVCGYGRVGKNLVKLLLQHNLPVVVIDQSESRIQQLREAGVSYVYGNCVSLHVLETAGVNHAKGMAIALPDPMSTRLCLKRALELRPELDLVVRATQDKNIEVLYQLGAREVVQPEFEASLEMATYLLTGLGLLSSAVVQREMQQIRNDHYLDLRPERSATEVARDLRQATRDLNQRWYPLPADSPLIGMSIEEADMRYLTGASLMAIRRANGDEIDYPNNQTKLEDGDRLLVVGADEELAALAEFAKGQAAVPGENSACQWVTVNADTPTLGKTLADLDINKQFGVQVQAIRRDGKFIRYPDGGMDLRVGDQVLLCGSLTGLSQIEQLFAIASSLPLSLPVLKAVQAEALKEFLPADSVD

SEQ ID NO: 16663 - protein, 968 aa, Triticum aestivum
MATASPPLATPFRPLAVAGGSGGLVVGARAVVPPRRGRRGFVVRSVASDREVRGPAPTEEELSAVLTSIDSSAIASNIQHHADFTPLFSPEHSSPLKAYHATAKSVFDSLILNWNATYDYYNKVNAKQAYYLSMEFLQGRALTNAIGNLELTGQYAEALKQLGQNLEDVASQEPDPALGNGGLGRLASCFLDSMATLNYPAWGYGLRYRYGLFKQIITKDGQEEVAENWLEMGNPWEIVRNDVSYPLKFYGKVVEGTDGRKHWIGGENIKAVAHDVPIPGYKTKTTNNLRLWSTTVPSQNFDLGAFNAGDHVKANEAHLNAEKICHVLYPGDESSEGKILRLKQQYTLCSASLQDIISRFESRAGDSLNWEDFPSKVAVQMNDTHPTLCIPELMRILMDVKGLSWNEAWSITERTVAYTNHTVLPEALEKWSLDIMQKLLPRHVEIIETIDEELMNNIVSKYGTADISLLKQKLKDMRILDNVDLPASVAKLFIKPKEEKGKLLVESLESIAEADEKTESEEEENILSETTEKKGESDSEEAPDAEKEDPEYELDPFAKYDPQLPRVVRMANLCVVGGHSVNGVAEIHSEIVKQDVFNSFYEMWPTKFQNKTNGVTPRRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDVGDLLKVVFVPDYNVSVAEKLIPASELSQHISTAGMEASGTSNMKFAMNGCILIGTLDGANVEIREEVGEENFFLFGAHAPEIAGLRQERAEGKFVPDPRFEEVKEYVRSGVFGTSNYDELMGSLEGNEGYGRADYFLVGKDFPSYIECQQKVDEAYRDQKLWTRMSILNTAGSPKFSSDRTIHEYAKDIWDISPVIMP

SEQ ID NO: 16664 - protein, 287 aa, Raphanus sativus
EFMNEVRLIARLQHINLVRILGCCIDADEKMLIYEYLENSSLDYLLFGKKRSSNLNWKDRFAITNGVARGLLYLHQDSRFRIIHRDMKAGNILLDKNMIPKISDFGLARIIARDQTEASTDNPIGTYGYMSPEYAMYGVLSEKTDVFSFGVIVLEIVTGKRNRGFYQSNPENNLICYAWTHWAQGRALEIVDPVIVDSLSSTFQPKEVLKCIQIGLLCIQERAVHRPTMSSVVWMLGSEATAIPQPKPPVYCLIPSFYANHPSSSRQSNDDESWTMNEYTCSVIDAR

SEQ ID NO: 16665 - protein, 475 aa, Burkholderia vietnamiensis G4
MSTQPQIVPTILCGGAGSRLWPVSRESHPKPFIRLEDGESLLQKAFKRGAQLPGVTEVVTVTNRELYFKTSDEFSTVNTGHLSTSFILEPFGRNTAVAIAAAALRVAATLGGNAILLVLPADHLVTDDAAFATAVQEAAALALKGALVTFGITPTFAETAYGYIEADGTRVKRFVEKPTVDVARQYVESGSFLWNSGMFCFTAAFLLAEMAKHCPEVLEATRACIAQSRQSEGGGVSLVELNGDQLNRTPDISIDYALMERSDKVAVVRCDIGWSDIGSWNALGDLLKPDDHGNRVDGEALLHDVSNCYIRSDNRLVGAVGVRDLLVVDTPDALLIADRNRAQDVRHVYAALKSQGHETFRVHRTVGRPWGMYTVLEESTRFKIKRIEVKPGASLSLQLHHHRSEHWIVVSGMALVVNNDEEFYLRTNESTYIPAGHKHRLTNPGVVDLVMIEVQSGDYLGEDDIVRFDDNYGRS

SEQ ID NO: 16666 - protein, 393 aa, Nymphaea alba
MTVPDARKDLLVVNMGPHHPSMHGVLRLIVTLDGEDVIDCEPILGYLHRGMEKIAENRTIIQYLPYVTRWDYLATMFTEAITVNAPEELGNIQVPKRASYIRVIMLELSRIASHLLWLGPFMADIGAQTPFFYIFRERELLYDLFEAATGMRMMHNYFRIGGVAADLPHGWIDKCLDFCDYFLTGVVEYQKLITRNPIFLERVEGVGFIGGEEAINWGLSGPMLRASGIQWDLRKVDRYECYDEFDWEVQWQKEGDSLARYLVRIGEMTESIKIIQQALEGIPGGPYENLEFRRFAGTKDSELNDFEYRFISKKPSPSFELSKQELYVRVEAPKGELGIFLIGDNSVFPWRWKIRPPGFINLQILPQLVKRMKLADIMTILGSIDIIMGEVDR

SEQ ID NO: 16667 - protein, 476 aa, Flavobacteria bacterium BBFL7
MPKTKKTKIVATLGPATSSKEVLLGMMKAGVNVFRINFSHADHEDVKERVQMIRDLNEEHGFATGILGDLQGPKLRVGVMKEEVVVNPGDIITISTGEPFKGTAERVYMNYEHFPRDVKAGERILLDDGKLMFEVVSTDGVKDVVTKVIQGGPLRSKKGVNLPQTDISLPALTEKDVVDAIFACELQVDWMALSFVRHSRDLMELQDLIKEHSEHKIPIIAKIEKPEAVTNIDKIVAYCDGLMVARGDLGVEVPAHEVPLIQKQLVLKAKQARIPVIIATQMMETMITSLTPTRAEVNDVANSVMDGADAVMLSGETSVGQYPIQVIEKMTSICLSVENSDLINVPHSAPHIKTKRYITKSICYHAAKMADEIDAKAITTMTNSGYTAFQISAWRPDAHILTFTSNKRILTQLSLLWGVKAFLYDRFVSTDETIEDVNQFAKDKKFVRKGDFLINLAAMPVTDKGMVNTLRVTEIE

SEQ ID NO: 16668 - protein, 290 aa, Raphanus sativus
EFMNEVRLIARLQHINLVRILGCCIDADEKILIYEYLENSSLDSHLFGEKRSSKLNWKDRFDITNGVARGLLYLHQDSRLRIIHRDVKVSNILLDKSMIPKISDFGMAIIFAREETEANTRNVVGTYGYMSPEYALDGVFSEKSDVFSFGVIVLEIVSGKRSRGFYSLNHENNLLSYAWSHWTEGKALEIVDPVITDSLSSLPSTFQPKEVLKCIQIGLLCVQERAEHRPTMSSVVWMLGSEATEIPQPNPPGYYVGRCPYENNPSSRRLCDDYESWTVNQYTCSVIDAR

SEQ ID NO: 16669 - protein, 409 aa, Amycolatopsis orientalis
MSTHQVVFLLLDLAVIVVLARLLGAVARRLDQPPVIGELLAGILLGPTLFGEGFAAALFPTDVRPFLAALANVGVAMFMFMVGLELEQTLLRGRGKLALTVSVSSIVLPFTLGVGLAFYLAMNRPVEHRLGFLLFIGAAMSVTAFPVLARILQDRGMLRTMLGGLALTCAAIGDVLAWCLLAVVVIVSGGASGTEQWLIVLGPIYVALMLWVVRPLLRKLFTAGVTGALPTVLAGALISGAVTELIGLHFIFGAFLFGVIVPREGTDTLRHRIIDRVEEFNSALLLPVFFIVSGLKVNLSTLSATGLVEFGLVLLVAIAGKFGGAFVGARLHGLPARKSAALATLMNTRGLTELIILTVGLQLGVLDQSLYSIMVAMAVITTAMAGPLLRLIYPASVIERDQAIEQARL

SEQ ID NO: 16670 - protein, 290 aa, Raphanus sativus
EFMNEVTLIARLQHINLVQVLGCCIEADEKMLIYEYLENLSLDSYLFGETRSSKLNWKERFDIINGVARGLLYLHQDSRFRIIHRDLKASNILLDKNMIPKISDFGMARIFERDETEAKTRKVVGTYGYMSPEYVMDGIFSEKSDVFSFGVIVLEIVSGKKNRGFYNMSNENNLLSYVWSHWKEGRALEIVDPVILDSLLSLPSTYQPQEVLHCIQIGLLCVQEHAENRPMMSSVVWMLGSEATEIPQPKPPGYCVIRSPYELDPSSSKKCDDNESWTVNQYTCSVIDAR

SEQ ID NO: 16671 - protein, 365 aa, Ralstonia eutropha JMP134
MNAAMLPPMLDVLAALAAGQRVVVLEDETDEALGCVLVAAERATEGDVNFMAAEARGLVCMAITEARRQRLQLPPMAANHRQRERYTVSIEAASGVSTGISAADRALTLRVAAARLAQPADLVQPGHIFPVVAQPDGVLRRAGFAEACSDLPSLAGCVASGAYAMLLDDAGDLLRGPALLAFAQRHGLPAVSISGLIHHRLLTEGALRRTRTSELNTPYGRFAVHAYHDVPVDALHLALVLGQPDPAKAVLTRVQTVEMQRDVLGFGTPALPAWNLERSLARIGAEGCGVLVLLDERESPQQRLERLAAPAAATPAPAFAQRALGVGAQILRDVGARKLRLLSHPVPYRTVAGFELEVTEFVPPA

SEQ ID NO: 16672 - protein, 280 aa, Rhizoplaca chrysoleuca
VEHGDVKVVAVNDPFIEPHYAAYMLKYDSQHGQFKGTIEVNGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 16673 - protein, 165 aa, Chlamydomonas reinhardtii
MLRQLATLLPGALRSASGVNSLALNRGFKAVADVEIDFNNREVLKKYVGIRDHLSKEPGTRGKLIEALTEVLSSIKAAPEGSDYRKAVEASCIYRLKVCKENESDAAIEEVLDAHLEELIKEAKEEARLVPLIAGNAPWDVPADYAVPVVDYTDAATILDAPPKK

SEQ ID NO: 16674 - protein, 280 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 16675 - protein, 277 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSEDAAMFVMGVNEKEYKPDIEIISNASCTTNCLAPLAKVMHDNYTIIEGLMTTIHSYTATQKTVDGPSSKDGRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATA

SEQ ID NO: 16676 - protein, 529 aa, Oryza sativa (japonica cultivar-group)
MDLESCSYVLPLLTCCLFLLYSITCYALAAAAGGGGSCGGSDDHAAPRSYPLVGCLLDFYRNRRRLLAWYTGLLAASPSQTIVVDRLGARRTVVTANPVNVEHVLRANFGNYPKGKAFTDVLGDLLGGGIFNADGERWFAQRKLVSHEFSARVMREAVGVALEREARARLLPALDAAAEGGGGVVVVDVQELLRQFAFNVICRVALGGGGGEVALALPLSRLAAAFDAAAAISARRGAAPVAAAWKVKRALGVGSERRLREEVKVIRDAIMEFVRDSSSRRRREQLLAAARGRDDLVSRMAAAGYPDEAICDMVVSFIMAGRDTTSSALTWFFWLMTRHRDVEREVLDEVDACMGDGGDGGGLAGVDLEGSRRARVLHAALCETMRLYPPVAWDSKHAAEDDVLPDGTRVGRGDRVTYFPYGMGRMEAIWGADAGEFRPGRWLAAAAAGGGVSPFKYPVFQGGPRTCLGKDMAFVQMKFVASAVLRRFELRPVAPEGSPEFVPLLTAHMAGGLKVTVRRRQRQNGTCET

SEQ ID NO: 16677 - protein, 142 aa, Zea mays
MQASRARLFKEYKEVQREKSADPDIQLICDDSNIFKWTALIKGPSETPYEGGVFQLAFAIPEQYPLLPPQTGEICLDILKNAWSPAWTLQSVCRAIIALMAHPEPDSPLNCDSGNLLRSGDIRGYQSMARMYTRLAAMPKKG

SEQ ID NO: 16678 - protein, 309 aa, Frankia sp. EAN1pec
MPVHPAESPGRRTAPVEPAISPPVAGHSPAPAVPPGARRPLDTDTLRPLAARLGLALAVVDEIDSTNAELGRIARGLPGAVGLPAVTRPPTVTDGAPAGLVLAAERQTAGRGRLDRSWESAAGAGLMVSVLVRPEIEPRWLGWLPMVVGTSLVRTLRRYAGVPAVLKWPNDVQVDGAKLAGILVELAPSPAVPPAAVIGFGLNVTARAAELPPRSTSLLLLGADPARLDRSALLGALLTDLVDALGRWEAAPERARGEYRDTCATLGRRVRVELPDGTSTHGTATDVDELGRLIVDGQAFSAADIVHLR

SEQ ID NO: 16679 - protein, 313 aa, Brucella suis 1330
MSHGEAPLKIFVFGSVNVDVSARMAALPRPGQTVNASGYGIGLGGKGANQAVAVAKLGGAIRFVGAVGHDAFGELALKQMREFGLDTGSVRVIDDVDTGMAIIQVEETGQNTIAVCAGANARWSSADIDAYGADIAKARITLLQREVPHEANLAVAKAVRAAGGTVLLDPAPVGDASQMADLIALSDIISPNETEAAEITGIEPTDLASAEAAGRKLLERGPKIVILKLGSRGALLVTADEVKHFTPFKVKVVDTVAAGDSFNGGFAVAFSQARPLHDCVRYGSAAGAIAVTRVGAGAAAPTAREVEELIGRA

SEQ ID NO: 16680 - protein, 469 aa, Xanthomonas campestris pv. vesicatoria str. 85-10
MSVENVEKLIKDNKVEFVDLRFVDMRGVQQHITFPVNIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 16681 - protein, 325 aa, Bacillus clausii KSM-K16
MMLEDKLYGSMEVEPVLRDLVNSRPLQRLKGVHQAGAAYLVCPEWNVTRYEHSIGVMLLIRRLGGSLKEQAAGLLHDVSHTAFSHVSDYVFKNEKEDYHEQLFHKRIAESDIPAILKKHQVDVNEIINEIEKWPLLEQPAPHLCADRIDYTLRDLYAYRFISLQEAHRFLEQLIVKKGKMVVQSLAAAEWFIEAYYKETIEFFMEPRNVYANWKISEALRLALERGAITESDLLAEDEELIKKLNESGDEQVRRLLAEIYSGVCVKEATGAYDHYHKNKVRIVDPLIDVGGAFVPVSKCSRKAADLISKAREKAEKGIYLKVMHN

SEQ ID NO: 16682 - protein, 476 aa, Caulobacter crescentus CB15
MIRARRSRIVATLGPASSSFDMIVTLAKAGADVFRLNFSHGAHETHAAVYAAIREAEKVVNRPLGVLADLQGPKLRVGKFADGPVMLKAGQAFRFDSDPAPGDETRVHLPHPEILTAMRPGATLLLDDGKLRMTVTDAGPGYANTKVVNSGKLSERKGVAVPDVVIPMSPLTAKDREDLAFALRLGVDWVALSFVQAPEDMAELRRIVEGRAAVLAKIEKPQALKVLGPILDLCDGVMVARGDLGVEMAPEEVPVAQKEILRAARERGIPVIVATQMLESMTSSPTPTRAEASDVANAVYEGADAVMLSAESAAGDYPEESVSMMNRIIERVERDPKWPELMYAEQSHDDVDADVLVVAAAGAAKSGSTKCLVAFTTTGATARRLSRERPLQPVLALSPEISAVRRMCLVWGVEPRVSAQPDSLEVVTTDASSKALELGLVAPGERLLVVAGTPFGAPGAANLLRLAHAPAPARRR

SEQ ID NO: 16683 - protein, 289 aa, Raphanus sativus
EFMNEVRLIARLQHVNLVRVLGCCIDADEKMLIYEYLENLSLDSYLFGKKRSFKLNWKDRFAITSGVARGLLYLHQDSRFRVIHRDMKVSNILLDKNMIPKISDFGMARIFAREETEANTSKVVGTYGYMSPEYALNGVFSEKSDVFSFGVIVLEIVSGRRSRGFYHLDHENNLLSYAWSHWTGGSALEIVDPVIVDSLSSLPSTFQPEEVLKCIQIGLLCVQERAEHRPTMSSVVWMLGSEATEIPRPNPPGYYVGRSPYENNPSSSGPGDDESWTVNQYTCSVIDAR

SEQ ID NO: 16684 - protein, 201 aa, Triticum aestivum
  misc_feature (172)..(172): Xaa can be any naturally occurring amino acid
  unsure (1)..(201): unsure at all Xaa locations
MVDPRFRTQPMGASSVAFHLLSSHTMAPTVMVSSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRXVIGFDNLRQVQCVSFIAFRPPGPPAPGKA

SEQ ID NO: 16685 - protein, 478 aa, Mycobacterium sp. MCS
MADKTADDIIKLIKDESVEYVDIRFCDLPGVVQHFSIPASAFDESVFEDGLAFDGSSVRGFQSIHESDMMLLPDPETARIDPFRHAKTLNMNFFVHDPFTREAYSRDPRNVARKAENYLISTGIADTCYFGAEAEFYIFDSVTFDSKINGTSYEVDSESGWWNTGEPFEADGSANRGYKVRPKGGYFPVAPYDHYVDLRDKMATNLINAGFVLERGHHEVGTAGQAEINYKFNTLLHAADDVLLFKYIIKNTAWQEGKTVTFMPKPLFGDNGSGMHAHQSLWKDGQPLFHDESGYAGLSDTARHYIGGILHHAPSLLAFTNPTVNSYKRLVPGYEAPINLVYSQRNRSACVRIPITGNNPKAKRLEFRCPDSSGNPYLAFAAMLMAGIDGIKRKIEPQAPVDKDLYELPPDEAASIPQAPTSLSAVIDRLEEDHEYLTEGGVFTEDLIETWISYKRENEIMPIQIRPHPYEVALYFDV

SEQ ID NO: 16686 - protein, 287 aa, Raphanus sativus
EFMNEVRLIARLQHINLVRILGCCIDADEKMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQESAEHRPTMSSVVWMLGSEATAIPQPKPPVYCLIPSFYANNPSSSRPSDDDESWTMNEYTCSVIDAR

SEQ ID NO: 16687 - protein, 263 aa, Synechococcus sp. CC9605
MQWMTDPRLPQYRGPHRGGGRLVAMYRRLAGASARCWAIRHVPVCSSTEELLGTWLRDQPSLMGPRAVIATHQRRGVGQSGRAWVSPPGGVWISAALPWRGHGSGQAGLLGLALALSVLQRLEQRGLSVQIKWPNDLFVNGRKLAGLLPGVVQRGSQLRLLRIGLGLNVRNAVPGHAIALRRLEGQLAADPIRWTAEVLLAFDHCHGIGGDGAWCLDGVQARLWSDQLVHPQDGQIWRIAGLERDGGLRLRQGSRTETWRRWP

SEQ ID NO: 16688 - protein, 540 aa, Corynebacterium efficiens YS-314
MGVFPGGFCMPAGIPPISRWHPRTINPGAPVPVAWWGQSHLSRKDTPMTDPLDVSALLTKVPTGLLIGDTWRDSSDGSTYTVDNPATGQTIATLASATSDDALAALDAACEVQSSWARTPARERSEILRRAFDLINERAEEFATLMTLEMGKPIAEARGEVTYGNEFMRWFSEEAVRTYGRHGQTPEGTHRMLTVRKPVGPCLLITPWNFPLAMATRKVAPAIAAGCTMVLKPARLTPLTAQYFAQTMLDAGLPAGVLNVVSGASASAISNPIMEDDRLRKVSFTGSTPVGKQLLKKAADKVLRTSMELGGNAPFIIFEDADLDLAVEGAMGAKMRNIGEACTAANRFLVHDSIAQDFSRRLAERFNQLTLGNGLDDGVTVGPLVEAKARENVAKLVDDAVTEGATVLTGGTAGEGEGYFYQPTVLVDVAPGARILTEEIFGPVAPIITFTTEEEAIQLANDTEYGLASYLFTRDYARMFRISDQLEFGLLGFNSGVISNAAAPFGGVKQSGIGREGGTEGIDEYTQLQYIGIRDPYTDR

SEQ ID NO: 16689 - protein, 80 aa, Glycine max
MESVTTRPSPNVVGVANSKHGVEWCGHFQMPLHYPRYTQADYEAMPEWRLDCLLKEYGLPIFGDVESKRKFAMGAFLWIK

SEQ ID NO: 16690 - protein, 225 aa, Aspergillus nidulans FGSC A4
MPSPTDPALQFDSIEDTIKAFSNGEFIVVLDSQDRENEGDLIIAAESITDAQMAFLVRYTSGLICAPITPEIAERLQLPQMVLENTDPKGTAYTVSIDSADPSITTGISAHDRALACRTLASPSARPQDFRRPGHIIPLQAKAGGVRQRKGHTEAAVEFCRLAGKAPAGVIAELVEDGEVVEGVAEIRGNNGMMRRDGCLKFGKKWGLKLYDRNIAYYILINWFI

SEQ ID NO: 16691 - protein, 290 aa, Raphanus sativus
EFMNEVTLISRLQHINLVQVLGCCIEGDEKMLIYEYLENLSLDSYLFGKTGKSKLSWKERFDITNGIARGLLYLHQDSRFRIIHRDLKVSNILLDKNMIPKISDFGMARIFARDETEANTMKVVGTYGYMSPEYVMHGTFSEKSDVFSFGVIVLEIVTGKRNRGFNNLDNENNLLSYAWVNWKEARALEIVDPVIVDSLSPLSSTSQPQEVIKCIQVGLLCVQELAEHRPTMSSVVWMLGSEATDIPQPKPPGYCVRRTPYELDPSSSRQYNDDESVTVNQYTCSVIDAR

SEQ ID NO: 16692 - protein, 157 aa, Zea mays
  misc_feature (62)..(62): Xaa can be any naturally occurring amino acid
  misc_feature (85)..(85): Xaa can be any naturally occurring amino acid
  misc_feature (109)..(109): Xaa can be any naturally occurring amino acid
  unsure (1)..(157): unsure at all Xaa locations
FHTTGRLIFCSFSFPSASVRRRLTRRRVSAETMVTEILLIMVERNPPESRLSELEDRQWPKXACGKRAKFPVTHYLASDGMTLTXPACRTKAKVNPEGLGDLLEEILAXYLVIFRKGMSCTWNVIKAADKHYYSRVAPPATMPEALDVNLLCSCTLN

SEQ ID NO: 16693 - protein, 280 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSEDAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 16694 - protein, 277 aa, Rhizoplaca chrysoleuca
VEHGDVKVVAVNDPFIEPHYAAYMLKYDSQHGQFKGTIEVNGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATA

SEQ ID NO: 16695 - protein, 451 aa, Silicibacter pomeroyi DSS-3
MLTFETLKAQVAAGTVDTVLVCLVDMQGRLMGKRFHAQNFLDSAYEETHCCNYLLATDLEMATPDGYRATSWQAGYGDYVMKPDLSTLRPLPWLEGTVMVLCDVLDHHSHEPVPHSPRQVLKAQIARAEALGLTPMMATELEFFLFEGTFDEIRKTGYRNLTPISGYNEDYHILQTSKEEHVMRPLRNHLFAAGIPVENTKGEAEAGQEELNIRYADALACADHHTIAKHATKEIAHQHGHAASFLPKWHHDRVGSASHVHLSLWRGSEPAFYDKDAPHGLSELGRQFCAGMIRYAPDYTFFLAPYVNSYKRFMKGTFAPTKTVWSVDNRTAGFRMCAEGTKGVRMECRIGGSDLNPYLAQAALLAAGLQGIEEKLELAPPTSGDVYDNAEAGEIPRSLRDAVGTLDGSAMLRAAMGDWVIDHYTRCAQWEQEEFDRVVTDWEIARGFEKA

SEQ ID NO: 16696 - protein, 349 aa, Pisum sativum
GSYADELVKTAKTIASPGRGILAMDESNATCGKRLDSIGLENTEANRQAWRTLLVTVPTLGEYISGAILFEETLYQSTVDGRKIVDVLVEQNIIPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYIGDGESEEAKKDCCQGYSY

SEQ ID NO: 16697 - protein, 748 aa, Arabidopsis thaliana
MELSLVRLWNTCFPSFFYISTVLFLLTGGGVYSHSEYLIGLGSYDITGPAADVNMMGYANMEQVASGIHFRLRARTFIVSEYGDLYTEQNVGISGIHTHAGPGGYLQYVVYIVTSLGFVRQSFDALVDGIENSIIQAHENLRPGSIFLNNGELLDAGVNRSPSAYLNNPSKERSKHKYNVDKEMTLLKFVDDQWGPVGSFNWFATHGTSMSRTNSLISGDNKGAASRFMEDWYEQNTAERSYSEEFISDEIPRRVSSLIENHQDSHHELLELASYFESQPGKPVTRISSSARRVRSALRKADKPGFVSAFCQTNCGDVSPNVLGAFCLDTGLPCDFNHSTCGGKNEMCYGRGPGYPDEFESTRIIGERQFKMALELFNKASEQLQGKVDYRHVYVDFSQLNVTLPKKDGKSEVVKTCPAAMGFAFAAGTTDGPGAFDFTQGDDKGNPFWRLVRNVLKTPDKKQIDCHYPKPILLDTGEMTKPYDWAPSILSLQVLRIGQLFILSVPGEFTTMAGRRLRYAVKTQLKNSGNKDLSGEIHVVIAGLANGYSQYVTTFEEYQVQRYEGASTLYGPHTLSGYIQEFKKLSKSLVLDMPVQPGPQPPDLLDKQLSFLTPVMMDTTPSGDSFGDVISDVPKNLSLKRGNGQVTVVFRSACPRNDLLTEGTFTLVERLEQKDKTWTPVYDDDDLCLRFKWSRHKKLSSRSQATVEWRIPESASPGVYRITHFGAAKKLFGSVHHFTGSSSAFVVT

SEQ ID NO: 16698 - protein, 513 aa, Zea mays
  misc_feature (204)..(204): Xaa can be any naturally occurring amino acid
  unsure (1)..(513): unsure at all Xaa locations
MAASARTTSSLPYLVAVSSPAAHRHGASHPIRASVGEATMDVVSEAELREKGFLGMRKTKLVCTVGPACVEALPALARGGMGVARINLCHGGREWHRAAMRSVRRLNEEGGFCVTLMVDTEGSQLLVADHGGATSVKAEDGSEWIFTNKKADEAHQFTMHVNFDKFSEGILVGDELVIDGGMATFEVTEKIGNDLRCKCTDPGXWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSRNRPNPPIFAFTDNANSRKSMNLYWGVIPLHLPLSNSMEDNFNKTISLMRSKGSVKPGDTVLVVSDSDLNQPCAATSVFQSIQVRLVE

SEQ ID NO: 16699 - protein, 885 aa, Zea mays
MEGDGVRLDPETEGGVGGNLLVTPPPALMGPAIAEMSIGEEGEQRVRPPMTNISSREMDSPQILRSHAKNIDPTIVPTVGMTFKDVDDAYKFYKRYAYEVGFPLKKYREKTFSKWINCSREATKIELVNLEHNHEFITDEAEKQHLRCNKIRDAEYINFVDAMHDSRVPQHCIVDFISEMHDGPENVPVTAQDLKNMRAARRRENCSNDVAKLLAFFRECKQQNPQFFCDFQLDDDGKIVSIFWSHASMQGEYADYGDAVTFDTTHKTNIYDKPLGMFVGANSHLQCTVFGFVLLGDETVQTFEWAFNSFKTCMGSEGPRVMLTDQDPAMPIALRTVFPKTVHRLCLWHVQNRFMPFLNEIYARFAVKDFKTTFQSIIHHPLTPHEFECAWEMMLEEFNLHEDITLRKLYEIRKEWIPAFFKNDFCGVMVSTQRSESMNRLVKQSHVDANTPLHEFAKQMMKMLHSRKMKESKEALVSKAQRTTNTLYRFEVRVSRAYTRAIMNRFEESMKYATAYKILKDPDGCDNEWIVQHTKRSNKIVWGQHQFKISADIEAGEYTCECKQWEHTGLLCVHLLRAFMHLQIEKIPSKYILQRYTVSSRKDVLFERIDKSFRGKDGVTKSYRQKMLLTKTMKVVRQACMSKAGYDKAIDVLDELDVVLSRLEPDIGCNESTDVSDNEEDKEEELNKINASDGMEDDNTITCHNKDSHNTRTGCEHALTIITTGNQENNMRFSHEVGDTSSPCHVAHEQMENIAASSEAKKRLDFNVDVINLSMPDRARPKGRTIKNSEDRIMRLGAKGEKKKNRRCHLCGIADGHNSRTCLSVEENRARLAKLSNRKRGRPAGSRLNNKTTAPQWNETSTAKKHRIDEEVENEEADEHMDLGE

SEQ ID NO: 16700 - protein, 469 aa, Pseudomonas syringae pv. phaseolicola 1448A
MSETTAPSGELKRGLKNRHIQLIALGGAIGTGLFLGSAGVLKSAGPSMILGYAICGFIAFMIMRQLGEMIVEEPVAGSFSHFAHNYWGGFAGFLSGWNCWLLYILVGMSELTAVGKYIHYWLPDIPSWVSAAAFFILINAINLTNVKVFGETEFWFAIIKVVAIIGMIALGSYMLVSGSGGPQASVSNLWEHGGFFPNGVGGLVMALAIIMFSFGGLEMLGFTAAEAEQPKTVIPKAINQVIYRILIFYIGALVVLLSLTPWDSLLASLNASGDSYSGSPFVQVFSMLGSDAAAHILNFVVLTAALSVYNSGTYCNSRMLVGMAEQGDAPRALAQVDRRGVPVKAIFASAAVTVVAVLLNYFVPQQALELLMSLVVATLVINWAMISYSHLKFRQHMNRTAQVPLFKALWYPYGNYVCLAFVLFILGIMLMIPGIQISVYAIPVWLAVMWVCYRAKNRRSVVMNAETGK

SEQ ID NO: 16701 - protein, 484 aa, Legionella pneumophila str. Lens
MLIFELSKTGRQAKAQIPRAVSKNYSIPEEFQRKSRPRLPACSELQVVRHFTCLSQKNFSIDTNFYPLGSCTMKYNPRGVHKAASLPGFINRHPLAMDNESQGFLETLYKLQNYISEITGMPGVSLTPMAGSQGEFAGVAMIKAYHQSRGDTARDEILIPDAAHGTNPASAVMCGFKVVEIATAPDGDIDLDELKRKVGPRTAGIMLTNPSTLGLFMRQIKEIASLVHQAGGLLYYDGANLNAILGKVRPGDMGFDVMHLNLHKTFATPHGGGGPGAGPVAVGKRLIPYMPLPVVKKTDSGYHWATRQDYPQSIGRLSCFMGNAGILLRAYFYMLVLGKEGLLRVSEFATLNANYLLKELTKVGYTAAYPDRRASHEFILTLNSEKKNYDVTAMDFAKRLLDYGVHAPTTYFPLLVPECLLIEPPETESKEELDAFVAVMKTIREEASKQPDILKAAPHTLPVKRLDDVKAARELDLNYFATHE

SEQ ID NO: 16702 - protein, 446 aa, Mycobacterium sp. MCS
MDRQKEFVLRTLEERDIRFVRLWFTDVLGYLKSVAIAPAELEGAFEEGIGFDGSSIEGFARVSEADMVARPDPSTFQVLPWADGSGKHHSARMFCDITMPDGSPSWADSRHVLRRQLGKASDLGFSCYVHPEIEFFLLKPGPNDGTPPVPADNGGYFDQAVHDSAPNFRRHAIDALEQMGISVEFSHHEGAPGQQEIDLRYADALSMADNVMTFRYVVKEVALGDGVRASFMPKPFAEYPGSAMHTHMSLFEGDTNAFHSPDDPLQLSDVAKSFIAGILEHACEISAVTNQWVNSYKRLVHGGEAPTAASWGAANRSALVRVPMYTPRKASSRRIEVRSPDSACNPYLTFAVLLAAGLRGVEKGYVLAPQAEDNVWSLTPEERRAMGYRELPTSLGVALGEMENSELVAEALGEHVFDYFLRNKRAEWETYRSHVTPYELQAYLSL

SEQ ID NO: 16703 - protein, 456 aa, Legionella pneumophila str. Lens
MPYIPHTPNDTKEMLAAIGAQDIQDLFDEIPASLQYAGFQNIPAGINEMEMLKEAQNQAQKNRNGICFIGAGCYEHHIPAAVWDIASRGEFLTAYTPYQAEASQGTLQLLYEYQTMICELTGMEVSNASMYDGATALAEAVLMAVRLNKHSKTNRVLIAGTVHPFYRETIETIVRNQHIEVITLPFDEQQGITDLGSLNQYTGEDITALVIAQPNFFGCLEQVDKMTSWAHHNKTISVACINPTSLALLKPPGSWGEHGVDIVCGEGQPLGSPMASGGPYFGFLSTRMAHVRQMPGRIIGRTVDKDGKTGFSLTLQAREQHIRRAKATSNICTNQGLLVTAATIYMSLLGPEGLSQVATQCHQNTHELITALTQIEGVEQAFKASFFHEALIKLNQPVQSVLQQLADAGIAGGYAPEQHYPQLANTLLVCATEVRTAEDIAKYAKTLKAIMSKRGA

SEQ ID NO: 16704 - protein, 757 aa, Arabidopsis thaliana
MAVSLPLFQFILFLLLLLLSRTVYAYLIGVGSYDITGPAADVNMMGYANSDQIASGIHFRLRARAFIVAEPQGNRVVFVNLDACMASQIVTIKVLERLKARYGELYTEKNVAISGIHTHAGPGGYLQYVTYIVTSLGFVRQSFDVVVNGIEQSIVQAHESLRPGSAFVNKGDLLDAGVNRSPSSYLNNPAAERSKYKYDVDKEMTLVKFVDSQLGPTGSFNWFATHGTSMSRTNSLISGDNKGAAARFMEDWFENGQKNSVSSRNIPRRVSTIVSDFSRNRDRLLDIAATYKSSRGHSVDKSLDVKTRVRNGSKRKFVSAFCQSNCGDVSPNTLGTFCIDTGLPCDFNHSTCNGQNELCYGRGPGYPDEFESTRIIGEKQFKMAVELFNKATEKLQGKIGYQHAYLDFSNLDVTVPKAGGGSETVKTCPAAMGFGFAAGTTDGPGAFDFKQGDDQGNVFWRLVRNVLRTPGPEQVQCQKPKPILLDTGEMKEPYDWAPSILPIQILRIGQLVILSVPGEFTTMAGRRLRDAIKSFLISSDPKEFSNNMHVVIAGLTNTYSQYIATFEEYEVQRYEGASTLYGRHTLTAYIQEFKKLATALVNGLTLPRGPQPPDLLDKQISLLSPVVVDSTPLGVKFGDVKADVPPKSTFRRGQQVNATFWSGCPRNDLMTEGSFAVVETLREGGKWAPVYDDDDFSLKFKWSRPAKLSSESQATIEWRVPESAVAGVYRIRHYGASKSLFGSISSFSGSSSAFVVV

SEQ ID NO: 16705 - protein, 592 aa, Zea mays
MVKRSKKSKSKRVTLRQKHKVLRKVKEHHRKKRKEAKKEGKAGQRKKVEKDPGIPNEWPFKEQELKALEARRAQALQELELKKEARKERARKRKLGLLEDEEIANLASAASAQGSEFAAKDAAKDKAPLTVAKSNDHSERSFYKELVKVIEASDVILEVLDARDPLGTRCIDMEKMVRKADPSKRIVLLLNKIDLVPKEAVEKWLTYLREEMPTVAFKCNTQEQRTKLGWKSSKLDKTNIIPQSSDCLGAENLIRLLKNYSRSHELKLAITVGIVGLPNVGKSSLINSLKRSRVVNVGSTPGVTRSMQEVQLDKKVKLLDCPGVVMLKSSNSGVSVALRNCKRVEKMEDPVTPVKEILGICPHEKLLSMYKVPSFSSVDDFLQKVSTVRGKLKKGGVVDVEAAARIVLHDWNEGKIPYFTLPPKRDAVEDSDVVIISEDGKEFNIDEIYKAESSYIGGLKSIEEFHHIEIPPNAPPAIDEEMLEDGSKPSEPAQENREEQMSDANDPQGSKPATASTQNDKLYTAEGILDPRKRKAEKKRRKANRFSVLNDMDADYDFKVDYQMEDAADGEDEDAGDEAKEDNEPMTGVDDS

SEQ ID NO: 16706 - protein, 751 aa, Streptococcus pneumoniae TIGR4
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIDLDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAVVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGEENIYIFGEDSETVIDLYAKAAYKSSEFYAREAIKPLVDFIVSDAVLAAGNKERLERFYNELINKDWFMTLLDLEDYIKVKEQMLADYEDRDAWLDKVIVNISKAGFFSSDRTIAQYNEDIWHL

SEQ ID NO: 16707 - protein, 282 aa, Mycobacterium sp. MCS
MSEQTVYGAASDQPTPKPRVKVRTTHLQKWKAEGHKWAMLTAYDFSTARAFDDAGIPVLLVGDSAANVVYGYDTTVPITIDELIPLVRGVVRGAPHALVVADLPFGSYEEGPRQALATATRFLKETGAHAVKLEGGERVAEQIATLSAAGIPVMAHIGFTPQSVNGLGGFKVQGRGDAAEQTIHDAIAVQEAGAFSVVMEMVPAELATQITGKLTIPTVGIGAGPNCDAQVLVWQDMAGLTSGRTAKFVKRFGDVGAELRRAASQYADEVAAGVFPAEEHSF

SEQ ID NO: 16708 - protein, 532 aa, Nostoc punctiforme PCC 73102
MTKAPVAPVVLVILDGWGYCEEKRGNAIVAAKTPIVDSLWAAYPHTLIRTSGKAVGLPEGQMGNSEVGHLNIGAGRVVPQELVRISDAVEDGSIALNPALVKICQEVRSRNSKLHLVGLCSEGGVHSHITHLFGLLDLAKNQQIPEVCIHAITDGRDTAPTDGVRAITMLQNYIDRTGIGRIVTLSGRYYAMDRDHRWDRVKRAYDVMTQDGVGDNRTAVEILQASYAEGVKDEFVNPIRIAPGAIEPGDGVIFFNFRPDRSRQLTQALVSPTFNGFERQQITPLSFVTFTQYDSDLPVAVAFEPQNLSNILGEVIANHGLNQFRTAETEKYAHVTYFFNGGLEEPFAGEDRELVSSPMVATYDHAPAMSAVAVTDVAIAAIQKGTYSLVVINYANPDMVGHTGQIDATITAIETVDRCLGRLLESVIKAGGTTIITADHGNAEYMLDDGGNPWTAHTTNPVPFILVEGEKVKIPGYGTNVELRSDGKLSDIAPTILEILQLPQPPEMTGRSLLKTADYELQRTRTPVQVGL

SEQ ID NO: 16709 - protein, 330 aa, Bordetella bronchiseptica RB50
MRTSTMKCLIVQPIHEEGLALLREAGVECIAPASAAMADVAAAIADCDAAITRNAGLDTRAIEAGRRLRVIGNHGTGTNMIDLAAAERLGIPVVNTPGANARSVAELALAMAMALLKRTVPLDQAVRQGNWNIRYEAGLRELSGMSLGIVGFGQIGRALAAMAIGGFGMRVHVYSPSVAPQDIAAAGCQRADSLPALAREADIVSLHRPARPGAGPLVDDALLLAMKPGALLINTARADLVDEAALARHLEAGRLGGAGLDVFSSEPPPADHPLLRLPQVVLAPHAGGSTDQALARTARAVAEQVIEVLRDARPAHLIAPHAWPRRRGAR

SEQ ID NO: 16710 - protein, 358 aa, Spinacia oleracea
AAVGEAATQTKARTRSKYEIETLTGWLLKQPMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWPDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 16711 - protein, 477 aa, Borrelia garinii PBi
MISKLTKIVATISDLRCEPEHIKDLYDAGVNVIRLNTAHQSHEDTIKVIDNVRKISNKIALMIDTKGPEVRTANIENPIIVKTGDNVIISTSPINEPNNLQTNYDGFVKEVPQGSKVLIDDGELEMTVVTKLPDRLICEIKNDGQIKNKKSINTPGISLKLQSVTEKDKGFIELAAKYNVDFIAHSFVRNSKDIQDVQRILNAAGNPDVKIISKIENQEGIDNIEEIVKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDVKAIIVDSLKGKTARIMATYRASVPLFITTNSERLARELSLSYGVYSNLVDNNFKRTTEFVVTSLKMLKEQNIVNDKDTVIIISGNPNRDTDKGTEFMEINTVEDAIKGRNI

SEQ ID NO: 16712 - protein, 397 aa, Bacteroides thetaiotaomicron VPI-5482
MNQLSDRLNSLSPSATLAMSQKSNELKAQGIDVINLSVGEPDFNTPDHIKEAAKKAIDDNFSRYSPVPGYPALRNAIVEKLKKENGLEYTAAQISCANGAKQSVCNAILVLVNPGDEVIVPAPYWVSYPEMVKMAEGTPVIVSAGIEQDFKITPKQLEAAITPKTKALILCSPSNPTGSVYSKEELAGLAAVLAKYPQVVVIADEIYEHINYIGAHQSIAQFPEMKERTVIVNGVSKAYAMTGWRIGFIAGPEWIVKACNKLQGQYTSGPCSVSQKAAEAAYVGTQEPVKEMQKAFERRRDLIVKLAKEVPGFEVNVPQGAFYLFPKCSYFFGKSNGERKIENSDDLAMYLLEDAHVACVGGTSFGAPECIRMSYATSDENIVEAIRRIKEALAKLK

SEQ ID NO: 16713 - protein, 250 aa, Bordetella bronchiseptica RB50
MYKLVLMRHGESQWNLENRFTGWTDVDLTETGREQARKAGELLKREGYAFDLAYTSVLKRAIRTLWIALDAMDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 16714 - protein, 500 aa, Oryza sativa (japonica cultivar-group)
MASGAAGDIDDGVEADGEEGGAGEWVDGKESTMAQIMMGGGRRRWRVAGGVGVDGGEDFPEDCCSTAPLALERREQGSRIVGQLLTLMDGKSSKLLPHLVVVASATRVDAIESALRRPGRFDSEIEVTVPTAEERFEILKLYTKNLHLGECVDLQSVAASCNGYVGADLQALCREAARRAYGRLSSSSESENVLTLIMEDWESAKSVAKNSVTRGVTKEIPAVSWDDIGGLKAVKKKLQQAVEWPIKHAASFDRLGISPIRGVLLHGPPGCSKTTLAKAAAHAAQASFFSLSGAELYSKYVGEGEALLRRTFQMARLASPSIIFFDEADAIAPKRTGPSGNSSGNATVGERLLSTLLTEMDGLELATGIIVLAATNRPNAIDAALLRPGRFDMVLYVPPPDAEGRYEILRIHTRKMPLGDDVDLWKVAERTELFTGADLEGLCREAGMAALRESLRSERFVCDDIHFQAALRSLRPSLTQSVVDEYSNAAIHGPLTRRKH

SEQ ID NO: 16715 - protein, 273 aa, Pisum sativum
MEILPILSDSYTLGFIGAGKMAESIAKGASRSGVLPSSRIVTAHSNPSRRAAFESIGITVLSSNDDVVRASNVVVFSVKPQLVKDVVLKLKPLLTKDKLLVSVAAGIKLKDLQEWAGHERFIRVMPNTPAAVGQAASVMSLGGAATEEDANLISQLFGSIGKIWKADDKFFDAITGLSGSGPAYIYLAIEALADGGVAAGLPRDLALSLASQTVLGAASMATLSGKHPGQLKDDVTSPGGTTIAGVHELEKGGFRGTLMNAVVAAAKRSRELS

SEQ ID NO: 16716 - protein, 404 aa, Bacteroides thetaiotaomicron VPI-5482
MEEIKMDRIEDAIADFKEGKFVIVVDDEDRENEGDLIIAAEKITPEKVNFMLKHARGVLCAPITVSRCKELDLPHQVSDNTSVLGTPFTVTIDKLEGCSTGVSASDRAATIQALADPASTPATFGRPGHINPLYAQEKGVLRRAGHTEATIDMARLAGLYPAGALMEIMSDDGTMARLPELRAMADEHGLKLISIHDLIAYRLKQESIVEKGVEVNMPTEHGMFRLIPFRQKSNGLEHMAIFKGTWNEDEPILVRVHSSCATGDILGSHRCDCGEQLHKAMEMIEKEGKGVVVYLNQEGRGIGLMEKMKAYKLQEDGMDTVDANLCLGHLADERDYGVGAQILRELGVHKMKLLTNNPVKRVGLEAYGLEIVENVPVETVPNPYNERYLRTKKERMGHTLHFNK

SEQ ID NO: 16717 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 16718 - protein, 100 aa, Arabidopsis thaliana
  misc_feature (81)..(81): Xaa can be any naturally occurring amino acid
  misc_feature (89)..(89): Xaa can be any naturally occurring amino acid
  unsure (1)..(100): unsure at all Xaa locations
MAWAMLSSGTMVASPAQATMDAPFNGLKSYAAFPATRNANNDITYITSNCGRVNCMQVWPPIGKKNVETLSYLSDLTDFQXAKEVDYLXIRNKWISLVKY

SEQ ID NO: 16719 - protein, 170 aa, Triticum aestivum
GELGPTSHAPGRHRGISVFAAEVLNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 16720 - protein, 180 aa, Pisum sativum
MASMISSSAVTTVSRASRGQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 16721 - protein, 155 aa, Triticum aestivum
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHRGVIPNINPVLLPKKTAEKSPKEPKSPKKTAKSPKKA

SEQ ID NO: 16722 - protein, 1873 aa, Oryza sativa
MAADPAVASAVAAISAVMDWRSSPDARSAAFAYLESVKTGDVRALANTSFLLVRKDQSSEVRLHGFKMLQHLVRLRWEELSVAERNEFANLTVNLIPEVVGPHEEWALKSQTAALVAEVVRREGVALWNTLLPSIVSLSNNGPIEAELVAMILRWLPEDITVHNEDLEGDRRRALLRGLTESLPQILPLLYSLLEKHFVAALSAHTNQQMELAKQHVGTITAVLNAANAYAEWAPVTDLAKYGLIHGSCILADVARTLHFLQQMLEYYQHYKITLHFQSLLFWLVVLREPSKAKSVARVSSDTPAAGNSASTGGGSTEREKKGVSVLITDEMYSTILDVTFKRMLKKSTSASSGLLELWSEELEGKSDFCNYRAKLLDLIKVIASQRPGITATSIVQRINIVFGDANEATKSSQDLDAMEGAQLGLEAVVSAIFDGSSDYSKIDQDTKFQIHRIFEGLLQQLLSLKWSQPNLAVIHGHYLDSLGPFLRHYPDAVACIVNKLFEILTSLPITIQDPSNNFRQARLQICSSFIRISRAADKALLPHMKCNSVNFFMTIVKTFKCKQVVTTWYQSHSPWLPILSEFFVSWVANVYMNKNIADTMAYLQGEGRLLRAEHNHLCEAFLVMASSAGIQQQQEVLAWLLEPINKMWTQVEWQNAYLSDPSGLTHMFADSQFMWSIYHNITLFEKALKRGGSKKSASAPQALATTVLLRCIHMLWAEPFSQSLAGEVKAAKSMTVAEQTSLLGETNKLTKGQVASADGLLDVQREGESKENTIRNWLRGIRDSGYNVIGLSASLGDPFFRCIEGSSITAALMENVQAMEFRHLRQLIHLVIIPLVKYCPPELWRMWISNLLQPLFVHCQQALDFSWSSLLREGRAKVPDNFGNLSGSDLKVEVMEEKLLRDLTREVCSVLWVLASPGLNSGLPSLEQLGPANRINSSLKDLELFVSSSITGFLMLNVSTAVPALRITVEVFSWTDSEAVTKIIPFCGALIHLAVATNRAELSQFVAKDLFSSILHGLSVELNSITSSELVGLCREIYIYLSDRDPAPRQNTTGREEEDKKVTGIGTSKSNLCPARHPSAELVLGTEVPPLMVIFRTLPSSAKPATKQKVAPKKTDVRAILRPLTVINCQKKDIQLRFSTDNMKRVDMASAILLSIAIMAQLSSISAQPAPGCQSHCGDMEIPYPFGIGTECAIEPGFVIYCNKTADGSMKPFLINVEVLNISLLHGQTRALNALSTYCYNDVTKSMESSRWSLDFSTWPYRFSNLHNKFVVIGCNTLSYIYNGEYTTACASVCAKAPTNDSCDGVGCCQNNIAKGLNSYNVTFFTVYNDSSNLQSNPCSYAALVETDTFRFKTEYVTTMKFNETYNGQQPVVLDWAIGKVGCKEANMTSYACRSKHSECVDSINGPGYLCNCTLGYHGNPYITDGCIDVNECEQNQSPCPKGATCRNTEGWYHCSCPVGRKLAKETNTCNPDISLIIGVSIGSIVLVIIIFFVRIIFERRKLTDVKKKYIQEHGGLLLFEKMKSDQGLAFKVFTQAELEQATNKFEKSQILGHGGHGTVYKGITKDNITVAIKKCALIDDRHKKEFGKEMLILSQINHKNIVKLLGCCLEVDVPMLVYEFIPNGTLFDLIHGKNRTLHIPFSSLLRIVNEAAEGLAFLHSYANPPILHGDVKTSNILLDENYMAKVSDFGASILAPNDEAQFVTMVQGTCGYLDPEYLQTCQLTEKSDVYSFGVVILEILTGQMPLKLEGSELQKSLSSSFLLAMKENNLEAMLDSQIKGHESMELLSGLAELAKQCLDMCSENRPSMKDVAEEISRLRKLSKHPWIQRDSETEGYLSGPSTSNFEIEQSTEYTRKDEQMPINPSTSYFIR

SEQ ID NO: 16723 - protein, 257 aa, Oryza sativa
  misc_feature (42)..(42): Xaa can be any naturally occurring amino acid
  misc_feature (144)..(144): Xaa can be any naturally occurring amino acid
  unsure (1)..(257): unsure at all Xaa locations
GLGFIDALRCCCVQNGTGEDVKKIVTVLNEAEVPSEDVVEVXVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMXEVVAAQTKAIAEKISDWTNVVLAYEPVWAIGTGKVATPAQAQEVHDALRKWLVTNVSPAVAESTRIIYGGSVNGANCKELAAKPDVDGFLVGGASLKPEFVDIIKSATVKSSA

SEQ ID NO: 16724 - protein, 397 aa, Bacteroides fragilis NCTC 9343
MNQVSSHVTRLSPSATLLMSQKSAELKAKGVDVINMSVGEPDFNTPGHIKKAAIEAIEQNYSYYSPVMGFLSLREAIANKLNNENGVNYSASQIICSNGAKQSVCNAILAVVNPGDEVIIPAPYWVSYPEMVKLAEGVPVVVPTEIEQDFKITPSQLEAVITSKTRAIILSSPNNPTGTVYSRQELQELANVLSKHEHVLILSDEIYEHVNYVDKHESIAQFPTIKERVIIINGVSKAYAMTGWRIGFVAGPEWVVKGCSKLQGQYTSGPCSISQKAAEAAYRGLQNCVEEMRLAFERRRDLVVRLGKEIAGLEVNIPEGAFYLFPKCSSFFGKRYKDWVINNSTDLVMYLLEVGHVAAVSGDAFGAPGYFRISYATSDENIVEAMKRIKSALELLV

SEQ ID NO: 16725 - protein, 488 aa, Anabaena variabilis ATCC 29413
MQIQTPDWVKNAVFYQIFPDRFAISKQSRKRLLRDVRWEDWDAMPTLQGYKGGDLWGIMEQLDYIQDLGIDAIYFTPIFQSASNHRYHTHDYYQVDPMLGGNAAFKELLDAAHERNIKVVLDGVFNHSSRGFFFFHDVLENGPHSPWVNWFKIEGWPLAPYTGELPANYVGWADNRALPVFNHDNPDVREYIMEIAEYWLKFGIDGWRLDVPFEIKTPGFWQEFRDRVKAINPEAYIVGEVWGDSREWLDGTQFDGVMNYLFAGPTIAFTAGDRVVLEQVQSRDYQPYPPLFAAEYATKIQEVLQLYPWEIQLTQLNLLASHDTARLMTIAGGDQASIELATLLLLTFPGAPSIYYGDEVGLPGGIDPDSRRGFPLEANWDREIYQTHRQLIALRHAYPALRTGEYQVIWAQGALYVFARTLGKEELIIAVNVGTAPAQANVDVASLQTQPDKILYGEAEFSWHNTEETKQLSLNLPPRSGCILGLGD

SEQ ID NO: 16726 - protein, 217 aa, Escherichia coli
MAQTLLSSFGTPFERVENALAALREGRGVMVLDDEDRENEGDMIFPAETMTVEQMALTIRHGSGIVCLCITEDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 16727 - protein, 560 aa, Zea mays
  misc_feature (106)..(106): Xaa can be any naturally occurring amino acid
  unsure (1)..(560): unsure at all Xaa locations
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALXASGKIYDGDGFNYIKESFESGTLHLIGLLSDGGVHSRLDQLQILLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPNANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 16728 - protein, 361 aa, Bacillus clausii KSM-K16
MEALNLYGAGDIRFEQSPKPTIMNDNEVIVRVETAGICGSDLSRYKKLGPYISGTTFGHECSGTIEEVGSNVSHLKEGMRVAVCPALPCGDCTQCRQGAFSRCPSLTVIGAVQPGAFAEYVKLPAENVLPLPNEIDADTAAFIEPAAVVAHGFYKTAIEPGADVAIIGCGSIGLLAIQWAKLFGARYVYAIDIDEQKLKVAKELGADQRVNPLDGPVHEQIHDLTAGEGVDVAIEAAGTPITSAQALALPKKGGEVVFLGIPYGDVTIERFYFEKIVRNELRVHGSWNGLSAPFPGKEWKTAIHSLQTGALQVNPLITHRLPLSDGPFVFKEMASGSPGYIKTLLYPGKTGQKERAINHLK

SEQ ID NO: 16729 - protein, 653 aa, Aegilops tauschii
MRRWLLRPLALLTTTTALLLNTSTSTSSSISTAHDLPALLSFKSLITKDPLGALSSWTINSSSNGSTHGFCSWTGVKCSRTHPGHVMALRLQGIGLSGTISPFLGNLSRLRVLDLSNNKLEGQIPPSLGNCFALRRLNLSFNSLSSAIPPAMGNLSKLVVLSIRKNNISGTIPPSFADLATVTVFSIASNYVHGQIPPWLGNLTALKDLNVEDNMMSGHVPPALSKLTNLRFLFLGTNNLQGLIPPVLFNMSSLERFDFESNQLSGSLPQDIGSTLPNLKEFSLFYNKFKGQIPSSLSNISSLERIVLHGNRFHGRIPSNIGQNGCLTVFVLGKNELQATESRDWDFLTSLANCSSLSTVDLQLNNLSGILPNSISNLSQKLETLQVGGNQIAGHIPTGIGRYYKLTVLEFADNLFTGTIPSDIGKLSNLRNLFLFQNRYHGEIPLSLGNMSQLNKLILSNNNLEGSIPATFGNLTELISLDLSSNLLSGQIPEEVMSISSLAVFLNLSNNLLDGPITPHVGQLVNLAIMDLSSNKLSSAIPNTLGSCIELQFLYLQGNLLHGQIPKEFMALRGLEELDLSNNNLSGPVPEFLESFQLLKNLNLSFNQLSGPVPDTGIFSNASIVSLTSNGMLCGGPVFFHFPACPYLAPDKL

SEQ ID NO: 16730 - protein, 126 aa, Vibrio parahaemolyticus
MNKNMKILIVDDFSTMRRIVKNLLRDLGFNNTQEADDGLTALPMLKKGDFDFVVTDWNMPGMQGIDLLKHIRADAELKHLPVLMITAEAKREQIIEAAQAGVNGYIVKPFTAATLKEKLEKIFERL

SEQ ID NO: 16731 - protein, 625 aa, Kineococcus radiotolerans SRS30216
MVGPLHRARRADRGRVRVGRARLRAPGPPRRTRSRLLRAVLTVDLPVPGLQERGGLRNDPQWYKTAVFYEALVRAFADSNGSGTGDFSGLTAKLDYLQWLGIDCLWLPPFYASPLRDGGYDISDYNAVLPEFGTLHDFQRLVTEAHQRGIRIVIDLVMNHTSDQHPWFQASRSDPEGPYGDFYVWSDTDEQYPDARIIFVDTETSNWTFDPVRRQFFWHRFFSHQPDLNFDNPAVEEAMFDTVRFWLDMGIDGFRLDAVPYLYVREGTNGENLPETHDYLHRLRRMVDEEYPGRVLLAEANQWPFDVVEYFGTEEAPECHMCFHFPVMPRLYYALREGRATPITEILSATPDIPTSSGQWGTFLRNHDELTLEMVTTEERAAMYGWYAPDPRMRANVGIRRRLAPLLDNSRPEIQLIHALVLSLPGSPCLYYGDEIGMGDNIWLDDRDAVRTPMQWTPDRNSGFSSADPGKLYLPTIQSLVYHYQSVNVEAQLATGSSLLHWVRNVLAVRRAHPAFGRGRYLPLPTRDDPRPDDGSCSNEAVLAFLRVLDPTPEEEGETVLCLNNLSDHPQAAVLRMPGQAGATARDVFGGAAFGEVDAEGTLTVMLGSRGFYWLALTGGRGVGA

SEQ ID NO: 16732 - protein, 267 aa, Zymomonas mobilis subsp. mobilis ZM4
MSHVKACSLEMKANQKAFAEKVDITTLWPEHSRIRVVEETESTNSDMRLLADQGLPEGFWLLANKQTKGRGRQGRKWQLPEGNLAISGLVRIRETDTSLSGLAFVAALALYQAASLFVKADWLSLKWPNDLMLKGAKCAGILIEGHQDAMIFGFGVNLKQAVKLDRPTAALADFADKIPEKKAFSEALVASFADWLDIWRKQGIEIIHDNWLKRAHNIHTPLTIHKENGELLSGYFAGLDPDGALKLRLQNDRICLFHSGDVLLARS

SEQ ID NO: 16733 - protein, 392 aa, Synechococcus sp. CC9605
MPRPPELSDRAVALKPSLTLEISAKAKALRDSGKDICSLSAGEPDFATPPFIVEAAQHALGSGFTRYGPAAGDPDLRAALAHKLSVENGIPTQPEQVLVTNGGKQAIYNLFQVLLNPGDEVLLPAPYWLSYPEMAALAGASTRIIATKAEEGFRLDLDLLEQQITPRSRLLVINSPGNPSGKVMTRAELEALAALVARHPQLMVMSDEIYEYLLADGQQHCSFAAIAEEIRSRCFTVNGFAKGWAMTGWRLGYLAGDAAVIKAASALQSQSTSNVCSFAQRGALAAIEGPRDCVREMANSYNRRRTLLIEGLQALEGITLTPPQGAFYAFPRLPDGVPDSMEFCRQALEQEGLAVVPGLAFGDDRCIRLSCAVADETINDGLLRLKRLLRSF

SEQ ID NO: 16734 - protein, 559 aa, Debaryomyces hansenii CBS767
MGNSPSKNDPLPTNSSANQTLNQSTSSNGELESDESIPPLSGLSGNKLNGSSKTSAIKIVNKNDNKFNSNYYNTNSNTPSSIYKKNGVQISPKKNSKSNGNHDLALDLEIGVSMAKLLSNSSPSAPGSNKLSLPSQQEYSSSFDSEKSEVSTVSPVFTTLGEYKDEDLLLSLGSSGPNDNFGVVKGDLDLDTIVEISLESTPEPRKVPDKSIDQPKKHLDTQISLTSSTSSLQSPVENSNVKRPQVNVDEIIDRLLEIGLKRPNNSSANSSRKNKDKLPLTSQEIKYVLNKSRSIFLDQPTLLRLSPPVKIVGDIHGQFHDLIRIFNSCGYPPYTNYLFLGDYVDRGYKSLETILLLLCYKIKYPENFFMLRGNHESANITKIYGFYDECKRRLPSISGNHKLWKTFVDVFNALPIAATINDKIFCIHGGLSPDLADLKQIENIKRPTDIPDNGLLADLLWSDPDPLIKNFSPTNWPKNDRGVSYCFGKKHVDYFCLKFKMDLIVRGHMVVEDGYEFFDKRKLVTVFLAPNYCGEFDNYGAIMSVDKSLCCSFELIKPQ

SEQ ID NO: 16735 - protein, 265 aa, Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 16736 - protein, 309 aa, Brassica napus
SIPTDATLDLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKYFTDLFDYLPLTALVDSEIFCLHGGLSPSIETLDNIRNFDRVQEVPHGGPMCDLLWSDPDDRCGWGISPRGAGYTFGQDISNQFNHSNSLKLISRAHQLVMDGYNWAHEAKGGTIFSAPNYCYRCGNMASILEVDDCRNHTFIQFEPAPRRGEPDVTRRTPDYFL

SEQ ID NO: 16737 - protein, 835 aa, Nicotiana tabacum
MVFPFFFFLLFLFCSTHCISFAAVSAHNRRVLHESFFPIDSPPPSQPPIPAPPAPPTPYPFQPSTPDNNNPFFPTYRSPPPPPPPPSPSSLVSFPANISDINLPNTSKSKHVSSKLIITAITCVLAAIIVLSIAICLHAKKRRRHFNDPKTQRSDNSNRLNHGSSKNDGNTNNSIPKLQQPSQTSSEFLYLGTIVNSHGGINSGSNPDTAPSSRKMASPELRPLPPLNGRNLSQNYRNTRNDDDFYSTEESVGYIESSFGAGSLSRRGFAAVEVNKFVGSSLSGSDSSSSSGSGSPNRSVSLSISPPVSVSPKRESCSRPKSPELIAVVTPPPPQRPPPPPPPFVHGPQVKVTANESPVLISPMEKNDQNVENHSIEKNEEKSEEILKPKLKTLHWDKVRASSDCEMVWDQLKSSSFKLNEEMIETLFVVKNPTLNTSATAKHFVVSSMSQENRVLDPKKSQNIAILLRVLNGTTEEICEAFLEGNAENIGTELLEILLKMAPSKEEERKLKEYKDDSPFKLGPAEKFLKAVLDIPFAFKRIDAMLYISNFDYEVDYLGNSFETLEAACEELRSSRMFLKLLEAVLKTGNRMNVGTNRGDAHAFKLDTLLKLVDVKGADGKTTLLHFVVQEIIKSEGARLSGGNQNHQQSTTNDDAKCKKLGLQVVSNISSELINVKKSAAMDSEVLHNDVLKLSKGIQNIAEVVRSIEAVGLEESSIKRFSESMNRFMKVAEEKILRLQAQETLAMSLVKEITEYVHGDSAREEAHPFRIFMVVKDFLMILDCVCKEVGTINERTIVSSAQKFPVPVNPNLQPVISGFRAKRLHSSSDEESSSP

SEQ ID NO: 16738 - protein, 344 aa, Helicobacter pylori
MILKRVTEALEAYKNGEMLIVMDDEDRENEGDLVLAGIFSTPEKINFMATHARGGMGVSLPKDSVKKFESPPVVPVNDSNPATAFTVSIDAKEAKTGISAFERHLTIELLCKDTTKPSDFVRPGHIFPLIAKDGGVLARTGHTEASVDLCKLAGLKPVSVICEITKEDGSMARRGDKFLSDFALKHNLKILYVSDLISYRLENESLLKMFCQEEREFLKHQTQCYTFLDHQQKNHYAFKFKGATTNGLAPLVRFHPIKEDFDFLTTGAFEVFFKALEYLKHEGGYLIFMNTHSKENNIVKDFGIGALVLKNLGIKDSTLLSSSEDRQYKALSGFGLKLVETISL

SEQ ID NO: 16739 - protein, 478 aa, Mesorhizobium sp. BNC1
MATYKAPLMLIGGEWTKGSGEPKEVINPATEEVIAMLPSATEADLDRALQSAQRGFREWQELSAEQRCDIIMRGCRILRERAAEIAPLITIEQGKPVEEARLEIIRAASIIEWDANEGRRAYGTIVPSDPGFNRYGIKLAIGPVAAFTPWNFPISSPGRKLGGALGAGCSVIIKSSEETPAATCALVQCLLDGGLPPEVINIVSGKSSMISAYLIASPVIRAITFTGSTPVGKHLAKLAAEAMKPVVMELGGHSPVIVFDDVDADKIARQAVAAKFRNAGQICTAPTRFIIQEKAHDAFVESFVKAASAIKVGNGLEADTQMGPLANSRRLRALEELVADARAKGATVATGGKRIGNRGYLFEPTVLTDVPDDADVVNVEPFGPIAPVVRFREFEEAIEIANRLPYGLCSYAFTNSQAYSHELAHRVESGIMSLNHFGTSQADTPFGGVKESGYGREGGYETLDAFMITKFVSQQITA

SEQ ID NO: 16740 - protein, 577 aa, Burkholderia mallei ATCC 23344
MPHDVSLIALLAAGFGLAMIFGYLASLLKMPPLVGYLLAGIVMGPGTPGFVGDLALAQQLAEIGVMLLMFGVGLHFSLGDLLSVRKIALPGAIVQIAVATALGAGLALWWGWSVGGALVFGLSLSVASTVVLLRALEGRGLIESVNGRIAVGWLVVEDLVMVLVLVLLPPLAALLGGGGAPAHGDAAVHAGEAGGSLWAALGVTLLKVAAFVALMLVVGKRVFPRILWLVARTGSRELFTLCMIAAAVGVAFGAAKLFDVSFALGAFFAGMMMRESEFSRRAADETLPLRDAFSVLFFISVGMLFDPRVLIDEPLHVLEVAAIVVLGKTLAAVALVLAFRYPLNTALTVGVSLAQIGEFSFILASLGRGLGLLSAEGQSLILAVALLSIALNTLLFAAVDPVLAWIRKRSAFARRLESRDDPLAALPMSTPQAHLTGQVVIVGYGRVGTRIAHALDARGIAYVVVEQNRETVEKLRADGVAVEPIVLVQAHIARAGMLVVTLPDVFDVRQIVDISRTLNPAIEIALCTNSDEEAALLANEGMGEVFVSETELAHGMTEHVLARMGAGEAHARRSAAH

SEQ ID NO: 16741 - protein, 391 aa, Chara vulgaris
MLIRKTNSMIVSMGPHHPSMHGVLRLIITLDGENVIDCEPVLGYLHRGMEKIAENRTIIQYLPYVTRWDYLATMFTEAITINAPEKLANIQVPKRASYIRVIMLELSRIASHLLWLGPFMADIGAQTPFFYILREREMIYDLFESATGMRMMHNYFRIGGVAVDLPYGWIDKCLDFCEYFLPKVNEYENLITQNPIFLKRVEGIGVINKEEAINWGLSGPMLRASGMEWDLRKVDHYECYDELDWSVQWEKRGDCLARYIVRVGEMRESVKIIQQALKAIPGGPYENLEARKLNTKKSTQWNDFEYQFISKKSSPTFKIPKQEHYVRLEASKGELGIFLIGDDNIFPWRWKIRPPGFINLQVLPPLVNGMKLADIMTILGSIDIIMGEVDR

SEQ ID NO: 16742 - protein, 266 aa, Campylobacter jejuni subsp. jejuni NCTC 11168
MVKAKKQYGQNFLIDKSVLAKIIQAIPKEMNNIIEIGPGLGDLTQELLKISQVKAYEIDNDLIPILKKKFQKELECGKFNLIHQDASEAFNPSLDEKPYFLVANLPYYVASHIILKALEDKNCLGLIVMAQREMAEKFCAKEGNSEFSSLGVLSAMICERKILFDVDPQCFNPPPKVMSAVMSLIKTKDFDELCEIENFKNFLKDCFKAPRKQLLGNLKTYKAKVLEVLSTLGLKENIRPHEICVDLYLKIYDKLKDEYGRKQRDK

SEQ ID NO: 16743 - protein, 882 aa, Saccharomyces cerevisiae
MVPFKLTNKVPTDTGPSLISAQSVPRPIVFMDNRNNTRIVTPTLPPNQHRGISGASTALPWSPESKNTGKYIWNRVKLKNSPFPRYRHSSSFIVTNDNRIFVTGGLHDQSVYGDVWQIAANADGTSFTSKRIDIDQNTPPPRVGHASTICGNAYVVFGGDTHKLNKNGLLDDDLYLFNINSYKWTIPQPIGRRPLGRYGHKISIIASNPMQTKLYLFGGQVDETYFNDLVVFDLSSFRRPNSHWEFLEPVGDLPPPLTNHTMVAYDNKLWVFGGETPKTISNDTYRYDPAQSEWSKVKTTGEKPPPIQEHASVVYKHLMCVLGGKDTHNAYSNDVYFLNLLSLKWYKLPRMKEGIPQERSGHSLTLMKNEKLLIMGGDKTDYASPNIHDLQTSETDQGEGTLLYTLDLSSLNELCPGIMCESLHAGESFSNSLSGGFTPSKSTESENQEIINILTPRLPDSKVLSYNDIDEGAGSYSSALDDKAFERKSDREEKKPQSSKVDSSINKESPGTGIKVSKKNFPVLRGLTVDSEEYGSSSYKDTSCQKGIPKNLFDDLNLNLQTLRLEAQQKELETARHISQLEKEVQRLMVIKEASKDSNFQTARLKNLEIQKTFLESRINDLKNLLMVKLSQASKLCDQITIQNNGLKTCSEHVTIKRDIIDLENKCDVLKRQNEILVNNMQKITPELHTYLNESSCYLGKLLKSYPTSARPPSSEKDNQIYEKDSLNKIEKVINEMHETVRAKEKLHLETQKLNDERDSLRANLLDNNNKLDALRKLSDGSSKSMDLTKKAIHLSQSELEKYRKNNDDLQKEIDRIKTEQAEQDDKQEQRGAITHGNFDAFHRMKINNLKAELYMSKENRDSLKDELLALKKKLYTLEQKK

SEQ ID NO: 16744 - protein, 378 aa, Prosthecochloris aestuarii DSM 271
MRITGLAKKMKAEGKDIVSLSAGEPDFPTPLFVSQAGIEAIDSGFTRYTANSGIAELKSAVIAKLKRDNQLDYTPDEVIVSNGGKQTLINAILALCQEGDEVIIPAPYWVSFPEMVRLAGASPVTVPTSIENGYKMTPEDLENAITDKTKLFILNSPSNPSGAVYNEQEVTALMQVLEGRGIFVISDEMYDKIVYGDVKPYSPARIEAMRDWVLVSNGVSKTYAMTGWRIGYLAGPKWIIKACDKIQSQTTSNPNSIAQKAAAAALNGDQQVVEDRRLEFEKRRDYMYKALNEIPGITASLPEGAFYIFPSVKGVLGKTFNGRYLANSSDVAEYLLLDHYVATVPGDAFGAPENLRLSYAASISELEEAVRRIRKAFE

SEQ ID NO: 16745 - protein, 550 aa, Hebeloma cylindrosporum
MENEKTEHEKRESSSNLEKGDHVVAQTNPQFHFDVHDLDRVQRRLKQRHVQMIAIAGTIGTGLFLGSGGALEAAGPLGALIAYALVGTVAYSSLCAVGEMSTWAPISGTFPHFAARWVDPALGFATGWNYFYTNAISTPVEITAAVILLTFWDHNSKHISLYTAILCVLVCMINIFGVRYFGESEFIFAIIKLTLIIGLLLVGLIVDLGGGPQGDRIGFRYWKNPGAIAGSGLDRNIFGLDRFLAILSVIVQAAFSFQGMELVVIAASETESPRRNIAKAVRRVFYRILVFYILGILMIGMLVAYNDKDLLFLQGNNTAAKSPFVIAINRAGIKVLPHIVNGAIFTSAFSAGNSFLFCSSRVLYGLALRGQAPKVLTYCTKKGLPLYAVLVASAFSFLSFMSVSSGSNRVFGWFVNLSTTGGFTSWFVMNVTYIFFRRGLLAQGYDPTTNSYHNRFQPYIAYWGAGWTLFFILINGFSVFWKFTAAGFLTAYINIPIFLVLYFGYKIVFRTKFWKPLEMDFVTGIPTLEETETPEKPPKNLGERIANIIF

SEQ ID NO: 16746 - protein, 342 aa, Bacillus clausii KSM-K16
MKALVKTAPGFGHVELQNKPEPAPGEKQVKIKVKYAGICGSDIHTYEGHYKVAFPVTLGHEFAGEIVEVGPGVQSFKVGDRVTSETTFSICGQCPYCQTKDYNLCSERKGLGTQQDGGFAEYVLAREESLHLLPDNVDFRSAAMTEPLACTHHALAKTTINAGDLCVVIGPGPIGLLAAQAAKSKGAKVMITGLNHDKVRLEKARALGIDYVVNGEETDVGEVVNELTNGYGADVVLECSGAVKAANQGLKLLRKKGQYSQVGIFAASEIPFDLETIIQKEIHVIGSRSQKPADWEPSLMLLKTGNVNARALVTHEYELHQWEEAYQAIKSGEAIKVLLKPE

SEQ ID NO: 16747 - protein, 400 aa, Chlorobium tepidum TLS
MSVESFERFLSRRVLSMQESQTMKITGLAKKMQAEGKDVVSLSAGEPDFPTPENVCEAGIEAIRKGFTRYTANSGIPELKKAIIRKLQRDNGLEYAEDEIIVSNGGKQALANTFLALCDEGDEVIVPAPYWVSFPEMARLAEATPVIVETSIETGYKMTPEQLAAAITPKTRILVLNSPSNPSGAVYNEAEVRALMQVIEGKEIFVLSDEMYDMICYGGVRPFSPARIPEMKPWVIVSNGTSKSYSMTGWRIGYLAAPKWIINACDKIQSQTTSNANSIAQKAAVAALDGDQSIVEQRRAEFEKRRDFMFRELNTISGIECTLPEGAFYIFPSIKGLLGKTFGGKVMKDSTDVAEYLLTEHYVATVPGDAFGAPENLRLSYAASIEELAEAVNRIRKAFS

SEQ ID NO: 16748 - protein, 204 aa, Triticum aestivum
EPSVINLVPFFYYYKQVDPDLNLVKGRGGALLREKMVEAASGKFVVVVDETKLVTGLGGSGLAMPVEVVQFCWKYNQYNQVRLQGLFNEEGCEAKLRLNEDDKPYVTDNSNYIVDLYFKTPIKDALGAGKEIATLEGVVEHGLFLNMASSVIIAGSDGVSVKTNGRRRSRRRRGAYGEFVNLKMICRLSLSKVLIGIGCACVCS

SEQ ID NO: 16749 - protein, 228 aa, Bacillus clausii KSM-K16
MDQLKRMAAEAAAEYVKDGMKIGLGSGSTVFEFVRVLGEKAKEGLNIQAVAASRKTEALAKACGIHIIDFPTMEKLEVAFDGADEIAPGLMLLKGGGGSLLREKLVAAAAKRLVVLADESKLVEELGAFKLPVEIIPFGWETTAMRIEALGGVASLRQTGKSPFVSDNHNWILDCDFGNIRDPYSLHEKVKKLVGVVETGLFLDMACEAIVASKNGIHHITKGDEFNV

SEQ ID NO: 16750 - protein, 395 aa, Flavobacteria bacterium BBFL7
MKNNLSDRINNLPVSATLAMAAKARELREQGKDIIGLSLGEPDFNTPDFVKDAAIQAINENYNSYTPVDGYVELKDAIILKFKRDNNLEYTRDQIVVSTGAKQSIANVAMVLLNEGDECILPAPYWVSYAAIVQLAEGVPVEVRAGVEQNFKITPDQLRAAITPRTKMILFSSPNNPSGSVYSKNELEELAAVLKDHPQIVVVSDEIYEHINYGDGHASMASVNGMYDRTVTINGVSKAFAMTGWRVGYIGAPAWIARACNKMQGQITSGTNCIAQRAVITALEAPVSEIQYMVDAFHKRRDLILELLSKIHGFITDIPEGAFYVFPDISSFFGKTIKGHKIENATDFSLLLLEEALVATVTGDAFGAPNCIRLSYAASEDQITEAIKRIDEVLS

SEQ ID NO: 16751 - protein, 732 aa, Arabidopsis thaliana
MKVQEGLFVVAVFYLAYTQLVKGQPRKECQTRCGNVAVEYPFGTSPGCYYPGDESFNLTCNEQEKLFFGNMPVINMSLSGQLRVRLVRSRVCYDSQGKQTDYIAQRTTLGNFTLSELNRFTVVGCNSYAFLRTSGVEKYSTGCISICDSATTKNGSCSGEGCCQIPVPRGYSFVRVKPHSFHNHPTVHLFNPCTYAFLVEDGMFDFHALEDLNNLRNVTTFPVVLDWSIGDKTCKQVEYRGVCGGNSTCFDSTGGTGYNCKCLEGFEGNPYLPNGCQDINECISSRHNCSEHSTCENTKGSFNCNCPSGYRKDSLNSCTRKVRPEYFRWTQIFLGTTIGFSVIMLGISCLQQKIKHRKNTELRQKFFEQNGGGMLIQRVSGAGPSNVDVKIFTEKGMKEATNGYHESRILGQGGQGTVYKGILPDNSIVAIKKARLGNRSQVEQFINEVLVLSQINHRNVVKVLGCCLETEVPLLVYEFINSGTLFDHLHGSLYDSSLTWEHRLRIATEVAGSLAYLHSSASIPIIHRDIKTANILLDKNLTAKVADFGASRLIPMDKEQLTTIVQGTLGYLDPEYYNTGLLNEKSDVYSFGVVLMELLSGQKALCFERPHCPKNLVSCFASATKNNRFHEIIDGQVMNEDNQREIQEAARIAAECTRLMGEERPRMKEVAAELEALRVKTTKYKWSDQYRETGEIEHLLGVQILSAQGETSSSIGYDSIRNVTTLDIEAGR

SEQ ID NO: 16752 - protein, 493 aa, Bordetella bronchiseptica RB50
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEADVVAAANATAFGLAAYFYSTDVRRIWRLADALETGIVGVNEGALAAEAAPFGGVKDSGYGREGSRHGLAEYMQIKYVCQGQLD

SEQ ID NO: 16753 - protein, 342 aa, Mesorhizobium sp. BNC1
MPMSSSNKFKVAVVGRAFGPEAQAIIQEVAPPEFDLSFSVDTTEKAHPLIRESDFCLVTTAITEKLLQESPKLRLVHKWGIGIDKIDLEGAERQGVYVAITAGSNAGAVAEHTIMLILAALRRLALADQSMREGKWIYTELRPLCRKLSGKTVGILGFGNIGRNVAQRLQGFDVEIIYHDPFRAPPEVEDRLKATYVSFDELIKRSNILTLHCPGGAANHHIINASALAKMQRGSVLVNCARGDVVDEEAMVAALQSGQLLAAGLDAFEPEPLPASSKLTQLTSVVLTPHTAGSVLDNVAPVAQHAFGNMLRMIRGEALPKSDLVVVPDKPRQFAGAGPVAV

SEQ ID NO: 16754 - protein, 809 aa, Arabidopsis thaliana
MGETGDDAGPSEQGPSNQTWWPSEFVEKFGSVYLGSQEETSSTKDSPRNLGQDGLPSSTASNILWSTGSLSEPIPNGFYSVIPDNRLKQLFNNIPTLEDLHALGDEGLKADVILVDFQKDKKLFRQKQLITKLVSGLNSKPATIIKKIAGLVADVYKQSTLQSPAKSTQSFENCGIQLLGQIKHGSCRPRAILFKVLADTVGLQSRLVVGLPSDGAAESVDSYSHISVTVLLNSVEMLVDLMRFPGQLIPLSTKAIFMSHISAAGESDSAENDSCDSPLEPNSPMFGYPEKFDHENAEKDENLSLHRKLDGSPNTSGPPSRNMLLRSASALERKLSFSQSESNMANEFWRQSRRKVIADQRTASSSPEHLSFRARTKSMLSGDKNLARDFTGDVATSSCKSVGGAKMETKRIRRRSISITPEIGDDIVRAVRAMNEALKQNRLSKGQGDDDSSPNSPNDRTESSHLQKNVSGFHLDVHDQVSGGRSTLSREPLDPQKAISLPSSPQNYRSQYEQSGSSHRNISHIWDKVLGSPMFQNKPLLPYEEWNIDFSELTVGTRVGIGFFGEVFRGIWNGTDVAIKVFLEQDLTAENMEDFCNEISILSRLRHPNVILFLGACTKPPRLSLITEYMEMGSLYYLLHLSGQKKRLSWRRKLKMLRDICRGLMCIHRMGIVHRDIKSANCLLSNKWTVKICDFGLSRIMTGTTMRDTVSAGTPEWMAPELIRNEPFSEKCDIFSLGVIMWELCTLTRPWEGVPPERVVYAIAYEGARLEIPEGPLGKLIADCWTEPEQRPSCNEILSRLLDCEYSLC

SEQ ID NO: 16755 - protein, 378 aa, Frankia sp. EAN1pec
MSAGRRLVVEADGGSRGNPGPAGYGALVRDAGTGQVLAERAASIGTATNNVAEYEGLLAGLRAAAELDPGADIEVRMDSKLVVEQMSGRWKIKHPSMRPLAAQAAEIAAGLGRVRFVWVPRARNGDADRLANEAMDAAAAGRSWEPSVPQSPDPLPHQAPTTNRLSGWMAPPAPPTTTVLLRHGQTPLSVEKRFSGTVEASLTDLGLEQAAAAADRLRGEPFDAVISSPLKRARQTADALGRDYLIDEDLRETDFGAWEGMTFAEVRERFPDELNAWLADPAVPPPGGESLLSTGARVAAARDRIMAQYPAGRVLVVSHVTPIKGLTQLALAAEPTVLYRLHLDLVSITTVDWYSDGPAVLRGFNDTHHVAHLVIPGE

SEQ ID NO: 16756 - protein, 268 aa, Rickettsia prowazekii
MLPSIVKHATSHKINPLKKHGQNFIFDSSLCDKIIRASNVLENSNVIEIGPGIGGLTRSILQKNPKSLTVIEIDERCIPLLNEIQEYYPNLNIIKQDVLKINLTDLIYDKVTVISNLPYHIGTELVIRLLKEVKLITNMTLMLQKEVVERICAIPSTKAYGRLSVICQILAKVEKCFNVAPTAFYPHPKVYSAIVKIIPLENPPSIALINKVEQITKLVFAGRRKMIKSSLRNLIPNIHEVLTQLKINCNDRAENLTPKDYLRIAMKL

SEQ ID NO: 16757 - protein, 474 aa, Legionella pneumophila str. Lens
MLRRTKIVATLGPASKEPEILRSMLAAGVNVVRINFSHADSSALQLIALVRKIADELNHPVAVMADLQGPKIRVGRFQNKSITLIDGQNFTLDCMAPDTLGDISGVSVAYPNLANELSIGDHLLINDGLIELEVIETSGSKIHCKVVEGGVLTDLKGLNRKGGGLAARTLTEKDRNDLRTAIEAEVDYISLSFVKDAEDIRQARALMKDYGAQITPIIAKIERMEALDHLTDIIREADAIMVARGDLGVEVGAAEVPAIQKHIIEQTRLLDKVVITATQMMESMISNPQPTRAEVSDVANAILDGTDAVMLSAETASGLFPVKVITMVNKICLSAEKHASFFYHSDPETCHYQRADQAIAMATMHTANHFPIQAIITLTESGDTALWISRQHSTVPIFAISANKRTIGRLSLVNNVFPIYIDFHQFNPEGLNQQILHELVKSGHLEKKGYVLLTRGTQIGTPGGTNCMEIIPVI

SEQ ID NO: 16758 - protein, 444 aa, Bacillus subtilis subsp. subtilis str. 168
MAKYTREDIEKLVKEENVKYIRLQFTDILGTIKNVEIPVSQLGKALDNKVMFDGSSIEGFVRIEESDMYLYPDLNTFVIFPWTAEKGKVARFICDIYNPDGTPFEGDPRNNLKRILKEMEDLGFSDFNLGPEPEFFLFKLDEKGEPTLELNDKGGYFDLAPTDLGENCRRDIVLELEEMGFEIEASHHEVAPGQHEIDFKYAGAVRSCDDIQTFKLVVKTIARKHGLHATFMPKPLFGVNGSGMHCNLSLFKNGVNAFFDENADLQLSETAKHFIAGIVKHATSFTAVTNPTVNSYKRLVPGYEAPCYVAWSAQNRSPLIRIPASRGISTRVEVRSVDPAANPYLALSVLLAAGLDGIKNKLEAPAPIDRNIYVMSKEERMENGIVDLPATLAEALEEFKSNEVMVKALGEHLFEHFIEAKEIEWDMFRTQVHPWEREQYMSQY

SEQ ID NO: 16759 - protein, 427 aa, Chlorobium tepidum TLS
MMSNNQFDSIESAIEDIKNGKLIIVVDDEDREDEGDFIAAAEHVTPEMVNFITKEARGLLCVAIPMERARELQLEPMVQRNTSQHETNFTVSIDAIAEGVTTGISAYDRYMTLKMLADPSSTADDFSRPGHIFPLRAMDGGVLRRVGHTEAAVDLCRLAGCQPAGLLCEILHDDGSMARVPELLKLKEKLGMKLITIKDLVAYRMQRSKLVHRAVESKLPTAYGEFKLIAYETIVDQQNHMAFVKGDVGNGEPVLARVHSQCATGDTFGSLRCDCGHQLETALRMIEKEGRGVLIYLMQEGRGIGLINKLKAYNLQDEGFDTVEANEKLGFKPDLRDYGIGAQILQDLGVRKMRLMTNNPKKIVGLEGYGLEIVERVPLEIEPNEVNRHYLQTKRDKLGHMIQMASGNERILFERLADEQLKQHKKD

SEQ ID NO: 16760 - protein, 337 aa, Coccidioides posadasii
MVVKVGINGFGRIGRIVFRNAVEHPEVEIVAVNDPFIETHYAAYMLKYDSTHGRFKGDVKFSENGLDVDGKHVRFYQERDPANIPWAETGADYVIESTGVFTTTEKASAHLKGGAKKVIISAPSADAPMFVMGVNNETYKSDIKVLSNASCTTNCLAPLAKVVNDNFGLVEGLMTTVHSYTATQKTVDGPSSKDWRGGRTAAQNIIPSSTGAAKAVGKVIPSLNGKLTGMSMRVPTSNVSVVDLTCRTDKSVTYDQIKEAMKKASANELKGIMSYSEDALVSSDLNGDPHSCIFDATAGIALNDHFIKLVAWYDNEWGYSRRVIDLIAYIAGVDAGK

SEQ ID NO: 16761 - protein, 326 aa, Mycobacterium tuberculosis CDC1551
MTPRPRALVTAPLRGPGFAQLRRLADVVYDPWIDQRPLRIYSAEQLADRITAVAADVLVVESDSVGGPVFERGLRVVAATRGDPSNVDIPGATAAGIPVLHTPARNADAVAEMTVALLLAVARHLIPADADVRSGNIFRDGTIPYQRFRGAEIAGLTAGLVGLGAVGRAVRWRLSGLGLRVIAHDPYRDDAGHSLDELLAEADIVSMHAAVTDDTIGMIGAQQFAAMRDGAVFLNTARSQLRDTDALVDALRGGKLAAAGLDHFTGEWLPTDHPLVSMPNVVLTPHIGGATWNTEARQARMVADDLGALLSGNRPAHVVNPEVLGS

SEQ ID NO: 16762 - protein, 212 aa, Prunus salicina
MCFIMSTGDGSYDYFQFVQQWPPATCRLSGKSCSKPRLQIFTIHGLWPSNYSNPKIPSNCKGALFEARKVYPQLQLNLKISWPDVKSGNETNFWQSEWNKHGTCSERTLNQMQYFERSDEMWNSYNITEILKNASIVPHPTQTWKYADIELPIKTATKRTPVLRCKRDPAQNKTGPKTQLLYEVVFCYDYHAKRQIDCNRTECWNKVDIKFH

SEQ ID NO: 16763 - protein, 207 aa, Prunus salicina
FCYVMSSGSYDYFQFVQQWPPTNCRVRNKPCSKPRPLQNFTIHGLWPSNYSNPTMPSKCTGSRFKKENVYPQLRSKMKISWPDVGSGNDTRFWESEWNKHGTCSEGTLNQVQYFQRSHAMWRSHNVTEILRNASIVPHPTQTWSYSDIVSPIKTATKRTPLIRCKYDKKTQLLHEVVFCYEYNALKQIDCNRTAAAGCKNPQAISFQ

SEQ ID NO: 16764 - protein, 333 aa, Legionella pneumophila str. Lens
MFQFNTSQHTLMQILGDGACHSGSELGNALKISRSAVWKQINQLNDLGIPIIRIPHQGYQLEKPLILLDSDEITKQLHSKGFSQPFNLHLFTSIDSTNRYLKDLPLSSAVEICCTEMQTQGRGRFGRHWHSPFGENIYCSTRWSFSCDISKLSGLSLVISLATVLTINEFIVSDSDKVKIKWPNDILWNNKKLCGILVEIIAESNATAQFIIGVGLNINSDTKNNPLPDKSWCSFFEITNQNYNRNSIVTRLLINLEKYLSKFINNDLNAFKDDWNKYDYLVGKKVKVSQALNSISGIALGINSFGQLILEDEFGNKHELSSGDTSLALSNFE

SEQ ID NO: 16765 - protein, 260 aa, Glomus intraradices
MERENQTSNKKVYMAKLAEQAERYDEMVSYMKDVAKLGVELTVEERNLLSVAYKNVIGARRASWRIISSIEQKEENKGNETQVQKIKAYRQKVETELSEVCSDILAVLDEHLIPSAEAGESKVFYYKMKGDYHRYLAEFASGEGRKEAATQAHEAYKHATDIAQTDLAPTHPIRLGLALNFSVFYYEILNSPDRACHLAKQAFDDAIAELDTLSEESYKDSTLIMQLLRDNLTLWTSDLQDAEGEKPEEAKQEVEAEESK

SEQ ID NO: 16766 - protein, 598 aa, Corynebacterium glutamicum ATCC 13032
MNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 16767 - protein, 517 aa, Oryza sativa
MQGANMLLDEPVRLTSVLTPVKPKVFPSLTKIVGTLGPNSHSVEVIQECLTAGMAVARFDFSWMDASYHQETLNNLRKAAQNVNKLCPVMLDTLGPEIQVHNSTGGPIELKAGNHVTITPDLSKAPSSEILPIKFGGLAKAVKKGDTLFIGQYLFTGSETTSSWLEVVETSGENVECLVTNTATLAGPMFTLHVSKAHVSLPTLSDYDKEVISTWGLHNSVDIISLSHTRSAEDVRELRSFLQSHGLQDTQIYAKVENTEGLDHFDEILQEADGVIISRGDLGIDLPPEDVFISQKTAIKKCNLAGKPVIITRVVDSMIDNLRPTRAEATDVANAVLDGTDGILLGAETHRGPYPVDAAESVYNQLVHFKKLVKHVGDPMPHEESVASSAVRTAMKVKAAAIVVFTFSGRAARLVAKYKPPMPVLAVVFPREGSDPTKWRSYGTTQARQCFAARGVYPLMASTEEAETGGLTREEYGIKLAQNYGRSVGMLKPYDRLIIFQKIGDSSVVKIIECDSS

SEQ ID NO: 16768 - protein, 278 aa, Arabidopsis thaliana
MEKSRSSNISVLKDRFIAAEDSALVSKDVAQKDIEILLRRVKTATALLTYLKSKATTVAAADLANLSLETDQLQDTIDEHDGTYVTEMLQHVETVTGVMESLARRAFIAESEAAIEKGKVVLSQEEIQRKVGQLENMSVKLEDMEKFALGTSSILCEMRQRVDDLVEETSRQKQRATENELELSRVRRDFESLKSYVTSLISVRETLVSSEKQFQTIERLFERLVAKTTQLESKKVQKEAEVQKLMEENVRLTALVDKKEAQLLAMNEQCKMMALSSI

SEQ ID NO: 16769 - protein, 366 aa, Frankia sp. EAN1pec
MTDGPQAVTVEAVVAVEKGAPVALTRIIVPPPGPGEARVRVQACGVCHTDLHYREGAINDDYPFLLGHEAAGTVESVGDGVTSVVPGDYVVLAWRAPCGTCRSCLRGAPWYCFDSRNAVNPMTLQDGTPLSPALGIGAFTPLTLVAAGQCVKVDPAVPPQAAGLIGCGVMAGFGAAVNTGRVTRGETVAVFGCGGVGDAAIAGASVAGARRIIAVDVDDRKLEWARGFGATHVVNSRNEDPVEAVRALTDGNGADVVIEAVGRPETYRQAFFSRDLAGRLVLVGVPDPSMTVELPLIEVFSRGGSLASSWYGDCLPTRDFPIIIDLHRGGRLDLAAFVTETVGIGDVERAFERMRRGDVLRSVVLI

SEQ ID NO: 16770 - protein, 469 aa, Idiomarina baltica OS145
MSASKIFDAIKEHDVKFVDLRFTDTKGKEQHVTIPVSQIDDDFFEEGKMFDGSSIAGWKGINESDMVLMPDAESLVLDPFTDEMTLNVRCDILEPDTMQGYSRDPRSIAKRAEEFLQASGVADSAFFGPEPEFFLFNDVRFHTDMSGSFYKIDAEEAKWNSGREYSEGNLAHRPGVKGGYFPVPPVDSAHDIRGTMSLVMEDMGLVVEAHHHEVATAGQNEVATQFNSLTKKADEIQIYKYVVHNVAHSYGMTATFMPKPLVGDNGSGMHVHMSLAKDGQNLFAGDQYAGLSETALYYIGGIIKHARAINAFTNPSTNSYKRLVPGFEAPVMLAYSARNRSASIRIPLVSSAKARRIEVRFPDPSANPYLCFTALLMAGLDGIRNKIHPGDAMDKDLYNLPPEEAKDIPTVCHSLEMALDALDKDRDFLKQGGVMDDDMIDAYIGLKYNEVETLKKTTHPVEFDMYYSV

SEQ ID NO: 16771 - protein, 388 aa, Nostoc sp. PCC 7120
MKLAARVSQVTPSITLAIAAKAKAMKAEGIDVCSFSAGEPDFDTPAHIKAAAAKALDEGKTKYGAAAGEPKLREAIARKLQKDNHLDYKPENVIVTNGGKHSLYNLIVALIDPGDEVIIPAPYWLSYPEMVTLVGGKSVIVPTDASTGYKITPEQLRKAITPKTKLFVLNSPSNPTGMVYTPEEIKALAQVVVDADIYVVSDEIYEKILYDGAQHISIGSLGKEIFNRTLISNGFAKAYSMTGWRLGYLAGPVDIIKAASSIQGHSTSNVCTFAQYGAIAALEDSQDCVEEMRQAFAKRRQVMLDRLNAIPGLSTAKPDGAFYLFPDISKTGLKSLEFCDALIEEHKVAVIPGIAFGADDNIRLSYATDLATIEKGLDRLEKFVRSRI

SEQ ID NO: 16772 - protein, 344 aa, Bacillus clausii KSM-K16
MNVKMAINGFGRIGRMVFRKAFLEGKVDITAINASYPADTLAHLIKYDSIHGPFMADVYAKDGQLFVNGKKIELLAERDPRRLPWEALGIDIVIEATGKFKTKEAAGAHLQAGAKKVIITAPAKGEDATIVVGVNESDYNPQEDHILSNASCTTNCLAPVAKVLDEKFGIESGMMTTVHSYTNDQKNIDNPHKDLRRARACGQSIIPTSTGAAKALSKVLPNLDGKLTGMALRVPTPNVSLVDLVVNLKTETTAEAINNAFWEASQGTLKGILGITDEPLVSIDFNGEEQSAVVDGQSTAVLNNRQAKVLAWYDNEWGYSCRVVDLMNHVAAQMSTKEEIHSAS

SEQ ID NO: 16773 - protein, 325 aa, Cryptococcus neoformans var. neoformans JEC21
MPKATSQTFRAQPASAAQRPKKGGESSAAAAAGGGARNHLFDTAKFGQHILTNPLVAQGIVDKANLKPTDVVLEVGPGTGNLTVRILPACRKVVAVEMDPRMAAEVQKRVLGKPEQKKLELIVGDFVKADLPYFDVLISNTPYQISSPLVFKLLSQRPIPRCAVLMFQREFALRLVATPNTKLWGRLAANVQLYARVEHVMKVGKGNFRPPPQVESSVVRIMPRDPPPPVKFEEFDGLNRIIFSRANKTLRAGFKAKGVVELLEKNYRTWCAEQGAIIEDNFDIREKVESILVETGFADSRAAKMDVDDLLKLLAAFNVEGIHFA

SEQ ID NO: 16774 - protein, 472 aa, Guillardia theta
MNKLFSIKIGPYYLGKTLGVGSFGKVKLGEHELCGQKVAVKILNRKKIKNLKMEEKVKREICILKLFMHPHIIRLYEVIETPTDIFVVTEYITGGELFDYIVERGRLNEDESRKFFQQMISGIEYCHNHMVVHRDLKPENILLDAHLNVKIADFGLSNIMKDGNFLKTSCGSPNYAAPEVINGKSYLGPEVDVWSCGVIMYALLCGSLPFDDENIPNLFKKIKSGIYILPGYLSDLSRDMIAKMLITNPLLRITINEIRDHPWFNSRLPKYLSFPTFKKNFVIQKKLNIDDNILELVSNKTFLSKKYIKLGIMKHERNSTAIIYHLIRESITPFDMITVDNSYIRDIIKKENVIKKSNEKEHNTSLHQAFLGIESPRENLKDILNEIQRAIKTFRSKTHNLNHFSVIIVINTNSLFETKYKKKKEIILRTTTILIQIFKRSMKYLIDLQKINGDSFFFLSTCNFIKQELNLK

SEQ ID NO: 16775 - protein, 404 aa, Shewanella sp. ANA-3
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLLPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 16776 - protein, 400 aa, Caulobacter crescentus CB15
MSLESAALRRIAPSATIAISAKARALKAAGRDVIALSAGEPDFDTPDNIKNAAIEAIKAGKTKYTDPDGMPELKAAICAKFKRENGLEYKPSQIHVAPGGKPVIYNALVATLNPGDEVIIPAPYWVSYPDMTLLAGGTPVSVETTAESGFKITPEALEAAITPKTKWLIINSPSNPSGGAYSRAELQAIADVLLRHPQVWVLTDDMYEHLVFDDFEFTTIAQVEPKLYDRTLTMNGVSKGYSMTGWRIGYAAGPEPLIKAMGKMISQTTSNPCSISQWAALEALNGTQDFIKPNAKLFQERRDLVVSMLNQATGLHCPTPEGAFYVYPSCAGLIGKTAPSGKVIESDEDFATELLESEGVAVVHGAAFGLSPFFRISYATSNEVLEDACSRIQRFCASVK

SEQ ID NO: 16777 - protein, 328 aa, Bacillus cereus ATCC 14579
MDLDVSGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 16778 - protein, 366 aa, Bacillus anthracis str. 'Ames Ancestor'
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVKEFVPYMREQLAGYHDLVSGNEIFLNRVKGVGIYSAEEAISYSLSGANLRCTGVNWDLRKDEPYSIYDRFDFDIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 16779 - protein, 326 aa, Desulfovibrio vulgaris subsp. vulgaris str. Hildenborough
MRIVALDGYTLNPGDISWAPIEELGELVVHPRTPSDKIIERAAGAHVVLTNKVPLDMSALQALPGLRFVSVLATGYDKVDVAAAGVLGIPVSNVPGYGTDSVAQHVFALLLELCRRTALHDHRIRAGAWTQSPDWCFWDSTQEELTGKTMGIVGFGNTGRRVGRIANALGMNVIAYAPRSRFDPDYRPFEHVGLDELFTSADVVSLHCPLTPETEGLVDARRLASMRPGSYLINTARGPLLDERAVAEALDSGRLAGAGLDVLSQEPPAADNPLLSAKNCLITPHLAWASRTARRTLMDSTAANIRSFIEGTPVNVVNAAHLRTKG

SEQ ID NO: 16780 - protein, 173 aa, Prunus salicina
FCYVMSSGSYDYFQFVQQWPPTNCRVRVKRPCSNPRPLQYFTIHGLWPSNYSNPRMPSNCTGSQFKKQNLYPYMQSKLKISWPDVESGNDTKFWEGEWNKHGTCSERTLNLMQYFQRSHAMWKSHNITEILKNASIVPHPTQTWKYSDIESPIKRATKRTPVLRCKRDPVQAN

SEQ ID NO: 16781 - protein, 167 aa, Prunus salicina
LCFIMSTGSHVYFQFVQQWPPTTCRLSSKPRYKHRPLQNFTIHGLWPSNYSNPTKPSNCNGSQFKILPPQLISKLKISWPDVESGNDTRFWEGEWNKHGTCSEQTLNQLQYFEQSYSMWKSYNITEILKNASIIPSATQTWKYSDIVSAIKTATKRTPLLRCKWDKN

SEQ ID NO: 16782 - protein, 177 aa, Prunus salicina
LCFIMSTGDGSYDYFQFVQQWPPATCRLSGKSCSKPRLQIFTIHGLWPSNYSNPKIPSNCKGALFEARKVYPQLQLNLKISWPDVKSGNETNFWQSEWNKHGTCSERTLNQMQYFERSDEMWNSYNITEILKNASTVPHPTQTWKYADIELPIKTATKRTPVLRCKRDPAQNKTGPK

SEQ ID NO: 16783 - protein, 333 aa, Thermotoga maritima
MARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 16784 - protein, 123 aa, Torulaspora delbrueckii
MPEVINHPETLPKWWKEASVYQIYPASFKDSNNDGWGDMKGIASKLEYLKDLGIDAIWISPFYDSPQDDMGYDIANYEKVWPTYGTNEDCFKLIEKTHEMGMKFITDLVINHCSSEHEWFKES

SEQ ID NO: 16785 - protein, 169 aa, Prunus salicina
FCYVMSSGSYDYFQFVQQWPPTNCRVRNKPCSKPRPLQNFTIHGLWPSNYSNPTMPSKCTGSRFKKENVYPQLRSKMKISWPDVGSGNDTRFWESEWNKHGTCSEGTLNQVQYFQRSHAMWRSHNVTEILRNASIVPHPTQTWSYSDIVSPIKTATKRTPLIRCKYDKK

SEQ ID NO: 16786 - protein, 419 aa, Bacillus subtilis subsp. subtilis str. 168
MDMNEHRNRRLKLIMISATFGGLLFGYDTGVINGALPFMARPDQLDLTPVTEGLVTSILLLGAAFGALLCGRLADRDRRRKMILNLSFLFFLASLGTALAPNVFIMAVFRFLLGLAVGGASAMVPAFLAEMAPHEKRGRMVTQNELMIVGGQFLAYVFNAILGVTMANTGHVWRYMLVICAVPAIMLFASMLKVPESPRWLISKGKNSEALRVLKQIREDKRAEAECREIQEAVEKDTALEKASLKDFSTPWLRRLLWIGIGVAIVNQITGVNSIMYYGTQILKESGFGTKAALIANIGNGLISVIAVIFGIWLVGKVRRRPILLIGLAGTTTALLLIAIFSIVLDGSMALPYVVLSLTVLFLAFMQGCVGPVTWLVIAEIFPQRLRGLGSGISVFFLWILNFVIGFAFPILLSSVGLS

SEQ ID NO: 16787 - protein, 290 aa, Exiguobacterium sibiricum 255-15
MNICVVTGANSGMGMVTIQELLERGDRVIATVRSQKKATLLIQLLREHAVSDANLEVEIVQLDQLDSVRRFADVLFDRIGRIDRLILNAGIMVPPYHVTKDGFESQFQVNYLSHFYLIERLLPLIEQGHDPRVISISSLAGEGGMIRTDIELEAIAHVRKEQYNPMKSYRESKLLQMVHMRELAEQYGTLATFVSVHPGIVNTDLFYRGKYGKVLKTVLKPVAQVGYWTGKLYTPEYGAKTALYLATTDDVIDNGGYYADSAPRLSNPVVEDEAYRQQARALSKRWVGLD

SEQ ID NO: 16788 - protein, 133 aa, Prunus salicina
  misc_feature (81)..(81): Xaa can be any naturally occurring amino acid
  unsure (1)..(133): unsure at all Xaa locations
LCFIMSTGDGSYDYFQFVQQWPPTNCKVRTKCSNPRPLQIFTIHGLWPSNYSNPPMPSNCNGSKFEDRKVSPQLRSKLKRXWPDVESGNDTKFWEGEWNKHGTCSEQTLNQMQYFERSHSMWYSFNITEILRN

SEQ ID NO: 16789 - protein, 393 aa, Staphylococcus aureus subsp. aureus Mu50
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQNFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMVTKKIKMGHLI

SEQ ID NO: 16790 - protein, 335 aa, Zymomonas mobilis subsp. mobilis ZM4
MPHNRYDIVAIGNAIVDVLAATDDQFLSEKNITKGSMQLIDADSAETLYQEMNPTHEISGGSAANTLVGVAALGGRCAFIGQVANDPLGQVFQQDIRAQNIHFDVPVQEATIPTGRCLILVSPDGERSMNTFLGVAQTLHQTAIKPEVIENAEILYLEGYLWDPEVPRSAMKEAIQIARKAGKKVALTLSDTFCIERHREDFKQLINNGLIDILFANEGELRSLVQHDDLDRGIEEVAAKLPLLVVTKGPDGAIAVQDMERTEVSAKKIDQVVDTTGAGDLFAAGFLAGQARNLSIAASLEMGAIAAAEIISHYGARPENDIKTMIESALNISLN

SEQ ID NO: 16791 - protein, 336 aa, Flavobacteria bacterium BBFL7
MARKNQTLGEFIIENQSEFQYSSGELSRLINSIRLAAKMVNHEVNKAGLVDITGSAGEINTQGEDQQKLDVLANDTFIRTLTNREIVCGIASEENDDFITIEGHKENHSNKYVVLMDPLDGSSNIDVNVSVGTIFSIYRRVTPVGTPVQLEDFLQPGNLQVAAGYIVYGTSTMLVYTTGHGVNGFTLNPALGTYYLSHPNMTFSEDGNIYSVNEGNYNHFPQGVKDYIKYCQQEEGDRPYTSRYIGSLVSDIHRNMIKGGIYMYPQSAKASNGKLRLLYECNPMAFIAEQAGGTASDGHTRIMDLKPTELHQRVPFFCGSKNMVAKLEEFIQKHDK

SEQ ID NO: 16792 - protein, 467 aa, Brucella suis 1330
MNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVSGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGRRASVVMVFIFFAFVLWALTQEPDTLAAMKVTPLWFVLLGIAYRVMKLKQKQS

SEQ ID NO: 16793 - protein, 37 aa, Brassica napus
RGRYQVYLCVDRSGSGLIECPVFPRGKCGDEINFPSF

SEQ ID NO: 16794 - protein, 287 aa, Cryptococcus neoformans var. neoformans JEC21
MFANSLRQGLRTASRSSARAFSTIPARAPRTNVVGALALGTAVAGYALYETTRSPVMLEGARTIAGEKGTVTERSFVMIKPDGVSRQLVGKASPTLPVSLVALGRSDETGSSPALRVCAFPLTRYGNLMHFLFGRAWLQARRASFISLSLGPITDIHPPFPAFATPKNSIKSLTPSDALAKEHYADLSARPFYPSLVKYITSGTPVVAMVWEGKDVIRQGRRIVGATNPLDADAGSVRGQYAVSVGRNLIHASDAFESATKEIGLWFAPEELSEYEPIAWPWVMADN

SEQ ID NO: 16795 - protein, 491 aa, Bacillus cereus ATCC 10987
MKNQDQALIFEVSKEGRIGYSLPKLDVEEVKLEDVFESDYIRVEDAELPEVSELDIMRHYTALSNRNHGVDSGFYPLGSCTMKYNPKINESVARFAGFANIHPLQDEKTVQGAMELMYDLQEHLIEITGMDTVTLQPAAGAHGEWTGLMLIRAYHEANGDFNRTKVIVPDSAHGTNPASATVAGFETITVKSNEHGLVDLEDLKRVVNEETAALMLTNPNTLGLFEENILEMAEIVHNAGGKLYYDGANLNAVLSQARPGDMGFDVVHLNLHKTFTGPHGGGGPGSGPVGVKADLIPYLPKPILEKTEDGYRFNYDRPEAIGRVKPFYGNFGINVRAYTYIRSMGPDGLRAVTEYAVLNANYMMRRLAPFYDLPFDRHCKHEFVLSGRRQKKLGVRTLDIAKRLLDFGYHPPTIYFPLNVEECIMIEPTETESKETLDGFIDKMIQIAKEVEENPEVVQEAPHTTVIKRLDETMAARKPVLRYEKPAPVQV

SEQ ID NO: 16796 - protein, 250 aa, Oceanobacter sp. RED65
MRRTFVAGNWKMNGSKAENQSRLEALVAALGQRQDIDMAVFPSMPYVAQCQQILGGSTVAWGAQNVSEHTGGAFTGETSSQMLRDFECRYVLVGHSERRELFAESNQQVAEKFKAAVDSELVPVLCVGETLEQREAGETQRIISEQIEAVLSLVGSDVFANGVVAYEPVWAIGTGKTASPEQAQEVHSAIRAQLAEANIAMAEAMQILYGGSVKPENAAAIFAQQDVDGALVGGASLKAEDFIAICDAAA

SEQ ID NO: 16797 - protein, 118 aa, Taraxacum officinale
ECKERATPEQVADYTLKLLHRRIPPAVPGIMFLSGGQSEVEATLNLNAMNQSPNPWHVSFSYARALQNTCLKTWGGRPENVKAAQDALLQRASSNSLAQLGKYTGQGESEEAKKGMFV

SEQ ID NO: 16798 - protein, 315 aa, Synechococcus elongatus PCC 7942
INGFGRIGRLCLRAGFDDPQLDFVAINDLVPPKNLAYLLHYDSTHGRLQQTVRAEEDRICAGDRCIQCFSETDPAAIPWGELGVDVVIEATGRFTDYRAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNE

SEQ ID NO: 16799 - protein, 337 aa, Microdochium nivale
MVVKVGINGFGRIGRIVFRNAIEHDDIEIVAVNDPFIETKYAEYMLKYDSTHGNFKGTIEVASDGLVVNGKKVQFFTERDPSAIPWGKAGADYVVESTGVFTTIDKAGAHLKGGAKKVIISAPSADAPMYVMGVNNETYDGKADVISNASCTTNCLAPLAKVIHDKFTIIEGLMTTVHSYTATQKTVDGPSAKDWRGGRTAAQNIIPSSTGAAKAVGKVIPDLNGKLTGMSMRVPTANVSVVDLTVRIEKGASYEQIKEAIKEAANGPLKGVLAYTEDEIVSSDMIGNPHSSIFDAKAGISLNDNFVKLVSWYDNEWGYSRRVLDLLAYIAKVDAGK

SEQ ID NO: 16800 - protein, 584 aa, Bacillus clausii KSM-K16
MRKTKIVCTIGPASESLEKLTALIEAGMNVARLNFSHGDFEEHGARIKNIREAAKRTGKTVAILLDTKGPEIRTQTVEGGAIELEKGQELILSMNEVQGTKEKISITYPGLCEDVEVGSTILLDDGLIGLEVKEIRDTELVTIVRNSGVLKNKKGVNVPNVSVNLPGMTEKDAADIVFGIEQKVDFIAASFVRRASDVLEIRELLEKHGAADTAIIPKIENQEGVDNIDEILEVSDGLMVARGDLGVEIPAEEVPLVQKQLIKKCNELAKPVITATQMLDSMQRNPRPTRAEASDVANAIFDGTDAIMLSGETAAGDYPVESVQTMHNIAERTEQALNYENMLRRKSKEVKTSITSAIGQSVAYTASNLNAAAILTATESGYTARMTSRFRPKSPILAVTSNERAYRRMALVWGVTPILGKQANTTDEMLDRTVEAAVATGVVKQGDLVIITAGVPVGESGTTNLMKVHMLGEVAAKGQGIGRRSASGKVVVARDAKEAIAKVTEGSVLVTKSTDKDMIEAFEKAAAVVTVEGGLTSHAAVVGLNLSTPVIVGVANALERFQDGDEVTVDCISGNIYSGQARVL

SEQ ID NO: 16801 - protein, 356 aa, Streptomyces coelicolor A3(2)
MKGYVFHGPGRSAWEDIPDPELKEPTDAIVRVDAVTICGTDLHILKGDVPEVRPGTVLGHEAVGEIVEVGTDVRTVRPGDRVLVSCITACGRCRYCREGVYGQCLGGGGWILGHLINGTQAEYVRVPYADLSVHSLPGAVTDEDAVLLADIFPTAYEVGVLNGRVSPGDTVVVVGAGPIGLAAVATARLFAPERIVVVDLATARLEAARKLGAEAVADAREDPEQLVADLTGGLGADVVIEAVGVPETFEMCTRVVRPGGHVANVGVHGRPATLHLEDLWSKNVTVTTGLVDTRSTPTLLRMAASGRLPTGQLVTHTFPLERMEEAYEVFSAAADTGALKVVLGGPKREVVAANAV

SEQ ID NO: 16802 - protein, 132 aa, Prunus salicina
LCFIMSTGSYVYFQFVQQWPPATCIRSNKPCTKHRPLPIFTIHGLWPSNYSNPRMPSNCRGSLFETRKLSPELQSKLKRAWPNVETDNDTKLWEHEWNKHGRCSEGTLNQTQYFQRSYSMWRSHNITEILRN

SEQ ID NO: 16803 - protein, 455 aa, Burkholderia sp. 383
MKNLQRHLSARHIRFLALGSAIGTGLFYGSASAIQLAGPAVILAYILGGAAVYMVMRALGEMAVRDPVAGSFGHYATENLGPFAGFVTGWTYTLEMVIVAIADITAFGIYMGFWFPDVPQWIWVLGVVAIICGLNLCHVKVFGELEFWLSIIKVGAIVAMIGGGVAILLTGMHFGHSADVPTFANLWNHGGFLPNGVGGLIASLSVVIFAYGGIEVIGMSAGEAKDPERVIPRAINAVPARILLFYVLTMVVLMSISPWTGVGNEGSPFVQIFSALGVKSAATILNLVVISAAISAINSDIFGAGRMMFGMARQGQAPRVLMTTSRHGVPWVTVVVMAAALLVGVLLNYLMPKDVFLMVAAIATFATVWVWLMILLSQVAMRRRLSSTEVAALKFKVPLWPVAPALTIAFMGFVIVMLGWFEDTRVALYVGAAWLALLALVFYARIRPKFAPASR

SEQ ID NO: 16804 - protein, 175 aa, Prunus salicina
FCYVLSSGSYDYFQFVQQWPPTNCKIRKKCSKPRPLQMFAIHGLWPSNHSNPTTPSNCNGAQFDDRKVYPRLRSKLKISWPDVENGNDTKFWEGEWNKHGRCSEQTLNQMQYFERSYEIWNLFNITNILKNASIVPSATQTWTYSDIVSNIKAVTQRTPLLRCRRNPAYNKSGPN

SEQ ID NO: 16805 - protein, 177 aa, Glycine max
  misc_feature (125)..(125): Xaa can be any naturally occurring amino acid
  misc_feature (169)..(169): Xaa can be any naturally occurring amino acid
  unsure (1)..(177): unsure at all Xaa locations
MASSMISSPAVTTVNRAGAGMVAPFTGLKSMAGFPTKKTNNDITSIASNGGRVQCMHVWPPFGKKKFETLSYLPDLDDAQLAKEVQYLLKKGWIPCLKFKLKHNFMYHEHNKSPKYYDKHYCTIXNLPIFNYTDTSQVFKELQHANTTYPNNFIHIIIFDNVQQVHDIXFHHYEPQS

SEQ ID NO: 16806 - protein, 170 aa, Prunus salicina
FCYVMSSGSYDYFQFVQQWPPTNCRVRIKRPCSNPRPLQYFTIHGLWPSNYSNPTMPSNCNGTQFKIQNLFPYLRSRLKMSWPDVESGNDTKFWEGEWNKHGTCSERILNIMQYFQRSQSMWKSHNITEILKNASIVPHPTQTWKYSDIASPIKSATGRTPLLRCKQDKS

SEQ ID NO: 16807 - protein, 606 aa, Rubrivivax gelatinosus PM1
MAVEAAGNEQLVRVVVLLAAGVVAVPLFKRLGLGSVLGYLAAGLAIGPFGLGLFVDAQTILHVAELGVVMFLFVIGLEMQPKRLWSLRREIFGLGLAQVVACGALLTGVGMLAGLSAPVAFVAAMGFVMTSTATVMLILDERGETATSRGQRVVSILLLEDLAIVPLLAIVAFLAPAHADVDSSIWRALLLALVAVGSVTIAGRWLLNPMFRLLAAARAREVMTAAALLVVLGAALLMQFGGLSMAMGAFLAGVMLSESSFRHQLEADIEPFRGILLGLFFLSVGMSLDLTVFASHWPQVLGGVVVFMLVKAAGIYVVARALGAPHGDALHRMVLMAQGGEFAFVLYSAGVSAGLLDGPMNAVLTAIVILSMALTPLAVGALRWMLPRGAASLEGVDRADGLTGSVLMIGFGRFGQVASQALLARGVDVAIIDSDTEMIQSADGFGFKVYYGDGTRLDVLHASGAATAEAIAVCVDDKAAALKIVELVKHSFPQARLLVRSFDREHALKLIAAGVDYQVRETFESASAFGEAALRALGATPDEAAQVAAEVRRRDDERLQLQITGGLRAGVGMMLSNRMKPTPLTKPARAGLALNEETASVTANAP

SEQ ID NO: 16808 - protein, 459 aa, Photorhabdus luminescens subsp. laumondii TTO1
MAGQSQRSTLKRGLKNRHIQLIALGGSVGTGLFLGIAQTIKMAGPSVILGYAIAGFIAFLIMRQLGEMVVEEPVAGSFSHFAYKYWGDFPGFLSGWNYWAMFTLVGMAELTAVGMYIHYWWPDIPTWVSATIFFVLINTVNLINVRLYGETEFWFSIIKVTAIICMIVFGSYLLVSGNGGPQASITNLWQHGGFMPNGISSLIMAMAVIMFSFGGLELVGITAAEAENPRISIPKATNQVVYRILIFYIGSLTVLLSLYPWGNVVEGESPFVMIFHNLDSFWVANILNIVVLTAALSVYNSGVYCNSRMLYGLAKQGNAPEMLTKVNESGVPIRAIVMSALATSIGVLINYVMPGKAFELLMALVVTTLVINWVMICMAHLKFRAEKVKQGIAPSFKAFWYPFGNYLCLVFLAFILVIILMMDSIRISVILMPFWVGVLWLGFLMSHSRRDKMKTEELG

SEQ ID NO: 16809 - protein, 452 aa, Silicibacter pomeroyi DSS-3
MADWTDNLPEAAQAYLENRRLDEVECIISDLPGIARGKAVPASKFARQDYFHLPDSIFYQTITGDWGDAAGEEGFIERDMILRPDYSTATAAPWTGDWTLQVIHDAYDRDGDPIPFSPRNVLRRVVSLYHAQGWKPVVAPEMEFFLVARNLDPAKEIEPMMGRSGRPAAARQAYSMTAVDEFGPVIDDIYDFAEAQGFEIDGITQEGGAGQLEINLRHGSPVRLADEVFYFKRLIREAALRHNCFATFMAKPIENEPGSAMHIHHSIVDMETGENIFSGPQGGETDAFYHFIAGLQNHLPSGLAVMAPYVNSYRRYVKDHAAPINLEWGRDNRTTGIRVPLSGPAARRIENRLAGMDCNPYLGIAVSLACGYLGLMEELRPRKQFKGDAYVGEGDIPQVMGDALDLFDEAKALHEVLGPEFARVYSIVKRAEYNEFLQVISPWEREHLLMNV

SEQ ID NO: 16810 - protein, 747 aa, Oryza sativa
MGTSVQVTPLSGAYGEGPLCYLLAVDGFRFLLDCGWTDLCDPSHLQPLAKVAPTIDAVLLSHADTMHLGALPYAMKHLGLSAPVYATEPVFRLGILTLYDYFISRRQVSDFDLFTLDDIDAAFQNVVRLKYSQNHLLNDKGEGIVIAPHVAGHDLGGTVWKITKDGEDVVYAVDFNHRKERHLNGTALGSFVRPAVLITDAYNALNNHVYKRQQDQDFIDALVKVLTGGGSVLLPIDTAGRVLGILLILEQYWAQRHLIYPIYFLTNVSTSTVDYVKSFLEWMNDSISKSFEHTRDNAFLLKCVTQIINKDELEKLGDAPKVVLASMASLEVGFSHDIFVDMANEAKNLVLFTEKGQLSNYKFGTLARMLQVDPPPKAVKVTMSKRIPLVGDELKAYEEEQERIKKEEALKASLNKEEEKKASLGSNAKASDPMVIDASTSRKPSNAGSKFGGNVDILIDGFVPPSSSVAPMFPFFENTSEWDDFGEVINPEDYLMKQEEMDNTLMPGAGDGMDSMLDEGSARLLLDSTPSKVISNEMTVQVKCSLAYMDFEGRSDGRSVKSVIAHVAPLKLVLVHGSAEATEHLKMHCSKNSDLHVYAPQIEETIDVTSDLCAYKVQLSEKLMSNVISKKLGEHEIAWVDAEVGKTDDKLTLLPPSSTPAAHKSVLVGDLKLADFKQFLANKGLRDFLQVEFAGGALRCGEYITLRKIGDAGQKGSTGSQQIVIEGPLCEDYYKIRELLYSQFYLL

SEQ ID NO: 16811 - protein, 446 aa, Silicibacter pomeroyi DSS-3
MQAKNWLRKNPQVRTIRVAAADLNGQPRGKRVPGRFADKAIEGGTRFPLSVMNLDIWGEDIEDSPLVLASGDRDGVLQPTERGFMPMPWLDTPTGLLPIWMFHEDGRPYEGDPRHALNTVVKRYKARGLKPVVAVELEFFLIDDSGRHLQVPQSPRSGKRRKAGEILSLRALDQFDHFFTELYDACEVMDIPADTAISEAGVGQFEINLMHQDDALRAADDAWLFKMLVKGLARKHGFAASFMAKPYEDYAGSGMHMHFSVLDEDGNNVFDDGTERGSDTMLHAVRGCLDAMSGSTLIFAPHDNSYARLVPNAHAPTGVAWAYENRTAAIRIPSGSPVARRIEHRVAGGDVNPYLMIAAVLGAALNGIEDGQMPPQPISGNAYKANLAQIPDRWDTAIDAFESDPAVARIFAPELIRNFVMTKRQEFRYFQELTEKEKTEVYLDTV

SEQ ID NO: 16812 - protein, 262 aa, Rhodobacter sphaeroides 2.4.1
MPAELSPIDTAKFAAARRAVDLVQDGMKLGLGTGSTAAWMVRCLAERVREEGLRVQGVPTSTRTAELARALGIQVVTLDEAKWLDLTIDGADEFDADFNLIKGGGAALLQEKIVATASDRMVVIADAAKEVAHLGAFPLPVEVIPFGWQSTKMLIEETLEGMDVLGREVTLRLSGDAPLLTDEKNYILDLHLKRIGEPRPLALALNQIAGVVENGLFIDICDTVVVGHGDGRVSLRDLQSGQAEEGSIDMDRARNIFADLGD

SEQ ID NO: 16813 - protein, 214 aa, Mannheimia succiniciproducens MBEL55E
MNQSLLASFGSSEERVIAALDTFKQGNGVLVLDDENRENEGDLIFPAETITTEQMAKLIRYGSGIVCLCITDELCQKLELPPMVAANTSVNKTAFTVTIEAAEGVSTGVSAADRVTTVKVAVADNAKPSDLHHPGHVFPLRAAENGVLARPGHTEAAVDLARLCGYKPAGVICEITNDDGTMARTPELVAFAQKFGYAVVTIEDLIAYRTKYNK

SEQ ID NO: 16814 - protein, 804 aa, Arabidopsis thaliana
MGKKRIVFFACLLLFTVLLRFSYAGITTESPLSVEQTLSSSNGIYELGFFSPNNSQNLYVGIWFKGIIPRVVVWVANRETPTTDTSANLAISSNGSLLLFNGKHGVVWSIGENFASNGSRAELTDNGNLVVIDNASGRTLWESFEHFGDTMLPFSSLMYNLATGEKRVLTSWKTDTDPSPGVFVGQITPQVPSQVLIMRGSTRYYRTGPWAKTRFTGIPLMDDTYASPFSLQQDANGSGFFTYFDRSFKLSRIIISSEGSMKRFRHNGTDWELSYMAPANSCDIYGVCGPFGLCIVSVPLKCKCLKGFVPHSTEEWKRGNWTGGCARLTELHCQGNSTGKDVNIFHPVTNVKLPDFYEYESSVDAEECHQSCLHNCSCLAFAYIHGIGCLIWNQNLMDAVQFSAGGEILSIRLAHSELGGNKRNKIIVASTVSLSLFVILTSAAFGFWRYRVKHKAYTLKDAWRNDLKSKEVPGLEFFEMNTIQTATNNFSLSNKLGQGGFGSVYKGKLQDGKEIAVKQLSSSSGQGKEEFMNEIVLISKLQHRNLVRVLGCCIEGEEKLLIYEFMLNKSLDTFVFDARKKLEVDWPKRFDIVQGIARGLLYLHRDSRLKVIHRDLKVSNILLDEKMNPKISDFGLARMYEGTQCQDKTRRVVGTLGYMSPEYAWTGVFSEKSDIYSFGVLLLEIIIGEKISRFSYGEEGKTLLAYAWESWGETKGIDLLDQDLADSCRPLEVGRCVQIGLLCVQHQPADRPNTLELLAMLTTTSDLPSPKQPTFVVHSRDDESSLSKDLFTVNEMTQSMILGR

SEQ ID NO: 16815 - protein, 447 aa, Bacillus cereus ATCC 10987
MLHRYLPMTEEDKKEMLQTIGVQTIDELFSDIPESVRFKGDLKIKEAKSESELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 16816 - protein, 310 aa, Flavobacteria bacterium BBFL7
MKVLHLDSNHDILAEMLEDAGYCNHYDYKSSKEDILKIISEYDGLIVRSRFPIDKAFLIAAKNLKFIGRVGAGLENIDLDVAQKLHIECYNAPEGNRNAVGEHALGMLLSLFNHLNRADQEVRNGIWLREENRGLELEGKTVGLIGYGNMGKSFARKLSGFDCKVIFHDLKSDLENENAIQVSLKELQSQADVLSLHTPQTDLTMGMVNKEFIAGFKKPFYLINTARGKSVIIADLVEALESGKVKGAGLDVLEYEKSSFTSLFDNEMPLPFKKLLKMDNVLLSPHVAGWTIESKYKLAQVIATKIIKNH

SEQ ID NO: 16817 - protein, 428 aa, Synechococcus sp. CC9605
MNTSHSQAIFGAAQALMPGGVSSPVRAFKSVGGQPIVFDRVKGPYAWDVDGNKYIDYIGSWGPAICGHAHPEVIAALQEAIEKGTSFGAPCALENTLAEMVIDAVPSVEMVRFVNSGTEACMAVLRLIRAYTGRDKVIKFEGCYHGHADMFLVKAGSGVATLGLPDSPGVPRSTTANTLTAPYNDLEAVKALFAENPEAIAGVILEPIVGNAGFIQPEPGFLEGLRELTKEHGALLVFDEVMTGFRISYGGAQAHFGVTPDLTTMGKVIGGGLPVGAYGGRADIMGMVAPAGPMYQAGTLSGNPLAMTAGIKTLELLKQPGTYEKLTATTQKLVAGIKDAAQSAGMSITAASVSAMFGFFLCEGPVRNFEEAKATDSERFGKLHRAMLEHGVYLAPSAFEAGFTSLAHSEADIEATINAFRESFAAVA

SEQ ID NO: 16818 - protein, 325 aa, Lilium longiflorum
GINGFGRIGRLVARVALQSDDIELVAVNDPFITTDYMTYMFKYDTVHGQWKHHEIKVKDSKTLLFGEKPVTIFGVRNPEEIPWGEAGADFVVESTGVFTDKDKAAAHLKGGAKKVIISAPSKDAPMFVMGVNHTEYKSDIHIVSNASCTTNCLAPLAKVINDKFGIVEGLMTTVHAITATQKTVDGPSSKDWRGGRAASFNIIPSSTGAAKAVGKVLPALNGKLTGMAFRVPTVDVSVVDLTVRLEKAATYDQIKAAIKEESEGGLKGILGYIDEDLVSTDFVGDSRSSIFGAKAGIALNDNFVKLVAWYDNEWGYSTRVVDLLR

SEQ ID NO: 16819 - protein, 116 aa, Schizosaccharomyces pombe 972h-
MKLAIGRLLSPLFLKNPQKPLIITKRFYSTPGERRIKDILTEKLSPSSLRVIDVSGGCGSMYQVAIKSKAFQGKNTLAQHRLVNSILKEEIRNMHGLNLSTEVEDDISAGGSTTSS

SEQ ID NO: 16820 - protein, 136 aa, Trichodesmium erythraeum IMS101
MVKYNQANLAPKLSIPSNLQGFTPTERPWGSFTILEEGNRYKIKRIEVKPGHRLSLQMHYHRSEHWVVVSGTAKVTCGNKEEILENNQSTYVPQCTPHRLENPGVIPLVLIEVQNGEYLGEDDIIRFQDDYARTNS

SEQ ID NO: 16821 - protein, 136 aa, Triticum aestivum
  misc_feature (80)..(80): Xaa can be any naturally occurring amino acid
  misc_feature (103)..(103): Xaa can be any naturally occurring amino acid
  misc_feature (125)..(125): Xaa can be any naturally occurring amino acid
  unsure (1)..(136): unsure at all Xaa locations
ADKTRPSNKCQRPLAVAAMESTFIMIKPDGVQRGLIGEIISRFEKKGFYLKALKLVNVERSFAEKHYADLASKPFFQGLXVDYIISGPVVAMVWEGKSVVTTXGRKIIGRHQPLASEPGTIRGDXAVDIGRNASWE

SEQ ID NO: 16822 - protein, 333 aa, Candidatus Kuenenia stuttgartiensis
MSVRIGINGFGRIGRNVFRVISKRNNIDVVAINDLADSKSLAMLLKYDSIHGRFDGSIQIKENALMVNDKEVRLLMEKDPAKLPWKSIGVDIVIESTGIFTSRSDCSKHLDAGAKKVLLSAPAKDKIDATIVVGVNNKDLRPEHKIVSNASCTTNCLAPLAKVLHDNFGIEKGLMTTIHAYTNDQRILDFMHKDIRRARAAAINIIPTTTGAAKAIGEVIPSLKGKLDGLAMRVPVPDGSVTDLVVMLAKEVDRDAINAAMKTAAEGDLKGILEYCGDPIVSSDIIGNPHSSIFDSALTYVIDKRMAKVISWYDNEWGFSNRMVDLIELMSRL

SEQ ID NO: 16823 - protein, 358 aa, Aspergillus oryzae
MGAPPKTAQNLSFVLEGIHKVKFEDRPIPQLRDAHDVLVDVRFTGICGSDVHYWEHGSIGQFVVKDPMVLGHESSGVISKVGSAVTTLKVGDHVAMEPGIPCRRCEPCKEGKYNLCEKMAFAATPPYDGTLAKYYVLPEDFCYKLPENINLQEAAVMEPLSVAVHIVKQANVAPGQSVVVFGAGPVGLLCCAVARAFGSPKVIAVDIQKGRLEFAKKYAATAIFEPSKVSALENAERIVNENDLGRGADIVIDASGAEPSVHTGIHVLRPGGTYVQGGMGRNEITFPIMAACTKELNVRGSFRYGSGDYKLAVNLVASGKVSVKELITGVVSFEDAEQAFHEVKAGKGIKTLIAGVDV

SEQ ID NO: 16824 - protein, 135 aa, Anabaena variabilis ATCC 29413
MTQSENNGQLDANDSSSHSGLRYWGNVEVIEEGESYRISRIEIKPRHGIKPQIHYHRNEHWVVVSGVAKVTCGDDEVLLGRNQSTYVPAATLHKVDNPGSIPLVILEIQNGEYLGEDDTERPYDLNLVKPGVEIK

SEQ ID NO: 16825 - protein, 443 aa, Desulfovibrio vulgaris subsp. vulgaris str. Hildenborough
MPFVPHSPEDVSVMLDAIGVNTIEDLFADIPAEMRPKSFALPKGLSEMDVCSRLEALSARNRTDVVSFLGAGFYDHHIPKAVDALSSRGEFYTAYTPYQPEAAQGTLQAIFEFQTAVCRLLDMDCANASVYDGGSALFEAMMMAVRATRRRKLVIDEALSPIYRTMLASYTSNLQLELVTVPHRDGLSDMDALKASVDDTCAAVVVQNPNFFGAITDFTDLFTHARAHKALGVISVYPVMQSVLKTPGEMGADIAVADGQSIGQPLSFGGPYLGIMTCTKPLVRQIPGRIVGRTQDVDGRTGYVLTLQAREQHIRRAKATSNICSNQALCALRSLIHLTLLGPEGLVRTAELSMERARYAAERLTALPGVELLHDAPFGNEFAVRLPVSAFEVVDRLTARGYVPGFPVGRYYPGMDNVLLVACTEKHSFEQVGILAEMLGGIL

SEQ ID NO: 16826 - protein, 109 aa, Taraxacum officinale
EYTVRALQRTMPPAVPAVVFLSGGQSEEEATVNLNAMNQYKGKKPWTLTFSFGRALQQSTLKAWSGKVENVEKAQAAFLARCKANSEATLGIYKGGSGLSEGASESLHI

SEQ ID NO: 16827 - protein, 323 aa, Triticum aestivum
  misc_feature (294)..(294): Xaa can be any naturally occurring amino acid
  misc_feature (309)..(309): Xaa can be any naturally occurring amino acid
  misc_feature (312)..(312): Xaa can be any naturally occurring amino acid
  unsure (1)..(323): unsure at all Xaa locations
LGDSIEQVCTKKLAGTGPEFPGYRRPTRPAARQSKAASRAALTTRCAIGDSLEEFLTKATPDKNLIRLLICMGEAMRTIAFKVPAASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNLTSPTGEGEXLRCCFEVAPLGFLIXKAXGTNTAAIGLER

SEQ ID NO: 16828 - protein, 447 aa, Lactobacillus sakei subsp. sakei 23K
MARKMLTAEAIKQLVDQENVKFLRLMFTDINGIIKNVEVPISQLDKVLSNKMMFDGSSIDGFVRIEESDMYLRPDLSTWLIFPWEAEHGKVARLICSVYTADGEPFLGDPRNNLKKMVREMQDKGFKDFNIGPEPEFFLFKLDEIGKPTLKLNDQGGYFDFAPVDLGENCRRDIVLELEKMGFEVEASHHEVAPGQHEIDFKYADAVDAADNIQTFKLVVKTIARKHGLHATFMPKPLHGVNGSGMHINMSLFNQDGTNAFFDENGKEQLSETVYHFLAGLLRHARAITAINNPTVNSYKRLVPGFEAPVYVAWSGHNRSPLIRVPQSRGLSTRLELRSVDPSANPYLAISSILAAGLSGLEQGLSPEAGVDRNIYSMDETERKENHITDLPSTLHNALKELAKDDIIKDSMGTYLYQSFMDSKSLEWAAYRQQVSEWEREQYLELY

SEQ ID NO: 16829 - protein, 84 aa, Yarrowia lipolytica CLIB122
MLTTDSLKDILMDRLEAHHVEVTDASGGCGQAFEVLIVSDIFKGKNKLMRHRLVNTKLKEEIAAIHAFTQKSQTVEEWEKSKEA

SEQ ID NO: 16830 - protein, 743 aa, Gibberella zeae PH-1
MAAAATPTAAARPSPAPADSREDSRSSSSSTSPAPADNEESDFFLGANDSQSSIGVPNFQDMQVEDACQPPVHRLPNEILISVFAKLSSTSDLFHCMLVCKRWARNTVDQLWHRPACTNWKNHASICQTLGMENPSFRYRDFIKRLNLAALADKVNDGSVMPLSVCTRVERLTLTNCRNLTDSGLIALVENSNSLLALDISNDKNITEQSINAIAKHCNRLQGLNISGCESISNESMITLATRCRYIKRLKLNECGQLQDDAIHAFAENCPNILEIDLHQCARIGNGPVTSLMVKGNCLRELRLANCELIDDEAFLTLPYGRTFEHLRILDLTSCHRLTDAAVQKIIDVAPRLRNLVLAKCRNITDTAVHAISKLGKNLHYVHLGHCGNITDEGVKKLVQNCNRIRYIDLGCCTNLTDESVKRLALLPKLKRIGLVKCSSITDESVFHLAEAAYRPRVRRDASGMLVGNEYYASSLERVHLSYCVNLTLKSIMKLLNSCPRLTHLSLTGVAAFQRDDFQPYCRQAPPEFTQHQRDVFCVFSGTMVSKFRDFLNTSPQFEDMWDNGWNRPAVFGSRRAVAASQPTAPPGDGVDDEMVDDENDFEGLDGSEMVVDAQAQNPVNGNGTVNPNGLTNQTFQQAIPIPPPLPLPGFPIGQHPTFFQPHTRFLSSSPFLRQDPRLFRPMFFQTSINNMTEGGISQPVTSQASAALLGYGGPANGESPTGASTATIHRPQENGDQSDSMN

SEQ ID NO: 16831 - protein, 427 aa, Lentinula edodes
MIVNFALSFIFASLALSSPLTSSNPLGLGGQFDVFARNVAISSGCSTTGTASCHNTSAVSNTCCFEAPGGLILQTQFWDTDPSTGPSNSWTIHGLWPDNCDGTFSENCDPSRDQSAITSLLESAGATSTLSFMQTYWKNDPDDGSDEELWSHEWDTHGTCYSTLEPSCLPSGSPSGTDAVAFYETVVRLFQTLPTYTWLANQGITPSSSTTHTLTSLENALAAEAGVTPMLTCDGSNLNEIAWYFNLKGSIIDGTFVPIDSPVDSDCPSSGIKYPLKTGSPVSTTSVSSTTTTTTTTGTPTSTGTPGPLPTKAMIVAIHNGAQVGGLLTLGTWSTQTLATMTLAGSTSSFTMTSSKGSCGVSGGELTCGSGVSATSFTAISSGGSLLVASGGSTAFSSSAVPSGETVETVFTGSSEAQTYTLAIVST

SEQ ID NO: 16832 - protein, 100 aa, Arabidopsis thaliana
MVKPEANTGPKERSIRAPWCVPCKKIEPVFRDLASRYPSMIFVTVDVEELAEFSNEWNVEATPTVVFLKDGRQMDKLVGAETSELQKKTAAAADLFLRKP

SEQ ID NO: 16833 - protein, 108 aa, Zea mays
MFFQIIQGVFTGVEALALLAFAGITLGGSAVGLALSTPLFILFSPILVPATIATTLLTTGFTTSGGLGIVALRIFWKLFKRLRKKGKGTPKIPGLAPGAPDSNSVSGG

SEQ ID NO: 16834 - protein, 175 aa, Zea mays
MLRRSRHGGVRLGRKLLGLWRRALCGGRRRRRRGGYRRLKQQQQQPCAGTPERAARKLAPALLRWGRSLARRLRLGWRAGGGRRMLAGAEAEVATTPKGQVAVYVGGGGGEAAQSLRYVVPVVYLNHPTFGELLREAEEEFGFQHPGVITIPCPAARFEQAAALAAAGKKGFARW

SEQ ID NO: 16835 - protein, 417 aa, Triticum aestivum
VSDIPLSLPCLGKKKKKKRGLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 16836 - protein, 550 aa, Arabidopsis thaliana
MVSKECCRNEIRAAIRQLSDRCLYSAAKWAGEQLVGIEQDPSNFTPANTRFQRGSSSIRRRFSTNESISTPLPSVGFSQAATPLPEEDEAIDGDIYLLAKSYFDCREYRRASHMLRDQVSKKSLFLRYYALYLAGEKRKEGEMIELEGPLGKSDAINRELVSLERDLSALRRTGAIDSFGLYLYGVVLKEKGNESLARASLVESVNSYPWNWSAWSELQSLCTSIEILNSLNLNNHWMKEFFLGNAYQELRMHTESLAKYEYLQGIFSFSNYIQAQTAKAQYSLREFDQVEIMFEELLRNDPYRVEDMDLYSNVLYAKEACAALSYLAHKVFLTDKYRPESCCIIGNYYSLKGQHEKAVMYFRRALKLNKKYLSAWTLMGHEYVEMKNTPAAIDAYRRAVDINPTDYRAWYGLGQAYEMMGMPFYALHYFRKSIFFLPNDSRLWIAMAKCYQTEQLYMLEEAIKCYKRAVNCTDTEGIALNQLAKLHQKLGRNEEAAYYFEKDLERMDAEGLEGPNMFEALVFLATHFKNHKKFEEAEVYCTRLLDYSGP

SEQ ID NO: 16837 - protein, 277 aa, Staphylococcus aureus subsp. aureus Mu50
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKAKNIGVSNFEPEHLEALLAQVSIKPVINQVEYHPYLTQHKLKLYLAAQHIVMESWSPLMNAQILNDETIKDIAQELGKSPAQVVLRWNVQHGVVIIPKSVTPNRISENFQIFDFELSDEQMTRIDGLNQDKRIGPDPKTFEG

SEQ ID NO: 16838 - protein, 427 aa, Pseudomonas aeruginosa
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGSLTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHDELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 16839 - protein, 475 aa, Arabidopsis thaliana
  misc_feature (441)..(441): Xaa can be any naturally occurring amino acid
  unsure (1)..(475): unsure at all Xaa locations
MASQSSVAVISSAAARGESFPDSKKPIGSVRFQQPLRLSFSYCKSGNMSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDXSCIRISYATSLDVLQAAVEKIRKALEPLRATVSV

SEQ ID NO: 16840 - protein, 462 aa, Triticum aestivum
  misc_feature (111)..(111): Xaa can be any naturally occurring amino acid
  unsure (1)..(462): unsure at all Xaa locations
MAVAVLLAAILALSPLPLSLASPSAAAAADRITRLPGQPPVNFSMYSGYVTVDAAAGRALFYWLVESAAAKPESAPLVLWLNGGPGCSSVGYGASEELGAFRINADGRTLXVNPYSWNKMANVLFLDAPAGVGYSYSNTSSDLLAPGDNKTAHDSYTFLVNWLERFPQYKYRDFYIAGESYGGHYVPQLSQLVYRNNKGVRKPILNFKGFMVGNAVIDDYHDFVGTFEYWWTHGLISDDTYQKLQLACEFDSSEHASDACNKIYDVAEAEEGPIDAYSIYTPTCKKTSLHRRRQIKGRRPWLPRGYDPCTEQYSTKYYNLPEVQKAFRANVTGIPYAWTGCSDVLFEYWKDSPRSMLPIYRELIAAGIRIWVFSGDADSVVPLTGTRYSIDALYLPTVTNWYPWYDEEEVAGWCQVYKGLTLVTIRGAGHEVPLHRPRQALKLFEHFLQDKPCLGLYLAFSF

SEQ ID NO: 16841 - protein, 367 aa, Oryza sativa (japonica cultivar-group)
MEESVGSRGGGGGGLDAQIEQLMECRPLSEPEVKTLCEKAKEILMEESNVQVIRFSSIAHIHIDVNESRYICVPRFINIYMNVGNARKSYNMKRRKYLSGIGMKPVKSPVTICGDIHGQFHDLVELFRIGGKCPDTNYLFMGDYVDRGYYSVETVTLLVALKVRYPQRITILRGNHESRQITQVYGFYDECLRKYGSANVWKIFTDLFDYFPLTALVESEIFCLHGGLSPSIDNLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCRNHTFIQFEPAPRRGEPDVTRRTPDYFL

SEQ ID NO: 16842 - protein, 294 aa, Spirulina sp.
AKTDIPVNIYKPKNPYIGKCLSNEELVREGGTGTVRHLIFDISGGDLRYLEGQSIGIIPPGTDNNGKPHKLRKYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLWALFFGIPYSPNILYQQELEELQEEFPENFRLTLAISREQQNPEGGKMYIQDRIKENADQLWELIQKPNTHTYICGLKGMEGGIDEGMSAAAGKFDVDWSDYQKELKKKHRWHVETY

SEQ ID NO: 16843 - protein, 148 aa, Zea mays
MEQTFIMIKPDGVQRGLVGEIICKFEKKGFTLKGLKLITVDRPFAEKHYQDLSAKPFFNSLVDYIISGPVVAMIWEGKNVVLTGRKIIGATNPAASEPGTIRGDFAIDIGRNVIHGSDSVESANKEAALWFPDGPVNWQSSLHSWIYE

SEQ ID NO: 16844 - protein, 243 aa, Campylobacter jejuni subsp. jejuni NCTC 11168
MLYILANGSMATALAYGLKDDYEICIVGRSIEKLQALAKEGFKTLLYKDFNIEGKDVILAFKPYALENIAQMLKGQARILISVLANVDFEKLQTIKAQNYVRIIPNTAAKYKASTTPYILKNSHFENEILDILKTFGSAYKLDNEIQMNAAMAISGCAPAFLALIAESIANAGVYEGLSKELSLNLTRSLFKSSNALLEHEHPAIIKENICSPGGVTIKGIKILEQKGIRGSFFEAINASSAK

SEQ ID NO: 16845 - protein, 337 aa, Glomerella lindemuthiana
MAPIKVGINGFGRIGRIVFRNAVEHPDVEIVAVNDPFIETKYAAYMLKYDSTHGIFNGEIAQDGNDLVINGKKVKFYTERDPAVIPWKETGADYVVESTGVFTTIDKAKAHLQGGAKKVIISAPSADAPMYVMGVNEKSYDGSAVISQASCTTNCLAPLAKVINDKYTIIEGLMTTVHSYTATQKTVDGPSAKDWRGGRTAAQNIIPSSTGAPKAVGKVIPELNGKLTGMSMRVPTANVSVVDLTVRIEKGATYDEIKQAIKEAAEGPLKGVLAYTEDDFVSTDMIGNPNSSIFDAKAGISLNNNFVKLVSWYDNEWGYSRRVLDLLAHVAKVDASK

SEQ ID NO: 16846 - protein, 1030 aa, Cryptococcus neoformans var. neoformans JEC21
MLPRAHRLVNQRPGIALRPHASHVSSAATSAVRRSVASQAQVAQPPIHPEIDGTFNDLIGEGTMNMGMKPRGSDRTSLPYRNINEIELADHQPVRHSGRKWSSLGLRIEQSDLVIDESPEVYNSASEGEYHDFGREERRSPAAVLGSKRLGMVVLPEEMQRGIQRQIDLMDNPRDIRKSYLALPNVPTPISATKSERRDKPFRTPEGELAKASAILPGEYGAVKNVLEELERRLGREWLTSAKEGEILEFSSSLGSGLWAIMDVMGGLLSSRRRWQEGQDKLKYQFVHSSRHGLDLVQRIAEVIPEESADVQFNRRHVHSSTPSLILSTFHLTSFPTLPTRQLYLRQLLELSSPYIVLIERSTPQGWAAISQARSYLLEKSTSENPLHVVAPCPHDGKCPLVGTKDVCGYSQRLQRPSFLRKTKHSSRGEEEKGYCYLVIAKGERPSVGTVAEDMKVAGRMGKVGREAAEKALIKSQGRSIIQEVEGHEAVMEVVRLHEIEPGMENYFEETSPSVNSEELEENLRKEAYSWPRMVAPPMKRKGHVTMDTCCADGNIQRLTYTKSHSKQSYHDARKSSWGDLFPHTSKGKPVIRTRGVRRLAKSENNGDADAVISELLSASLEEEMELEKAMEAVEVDELKELEMLGIKTPRAEVSKERQDDDMLVWKSNKNGPFASGQKRSYRTLTSTRSTSQPKTPPSIQTRSMSARPAPPIRPKATLSSLLSLAKSGTPISVLTAYDYPTALLSESCNLDMTLVGDSLSQVALGHETTTAITLDEMIHHARTVVRGAKTPFVFADMPFGSFETSLEEGVRSVLRMVKEGGVDGVKIEGGREIVPLVRRLSAIGIPVMPHLGLQPQRATSLSGYLVQGRTAQAAYEILQSARELANAGAFAFLLEAMPSKVAKLVTEEVGKKGVFTIGIGAGNGTNGQVLVITDVLGIYAEDPPEDIATPNVTGETELVSTSRDFTKPLDAPRFVRQFGSLGQEMRRAVRAYVQAVKGRSFPDSKESYGMKKEEWETFLEMVKREKDQH

SEQ ID NO: 16847 - protein, 185 aa, Arabidopsis thaliana
MKDGDSLPISTSSVAATTVTGKKETGYSALFSKGRYKFWALAAILLLAFWSMLTGTVNLRWSAGNINHFTDDLVFPIHEDLDVLEMEEREKVVKHMWDVYNNGRRIRLPRFWQEAFEAAYEELTSDVPDVVEAAISEIARMSIRSIVIDPPPLHSTNVRELTKTLKLADKGRATQISKPSSRRLK

SEQ ID NO: 16848 - protein, 655 aa, Idiomarina loihiensis L2TR
MNGTFSSLLLLLAVAVILVWLFRRVKLPAILAYLVAGIIAGPDVMGWIADPDDYHLVAELGIVLLLFSLGLEFSLPKMIAMRRWVFGLGAAQVLGSLLIFLLIGFIWLDEWAASLAIAGALALSSTAVVIKQLKESAQTSTRRGQMSVAILLFQDIAVVPLLIIIPLLASDNGNIGYTLLLALAKGAAVIAVLMTIGKWVLPYLFKEIAKQRTDELFVLATLLVALVAGGMTHVFGLSMALGAFLAGMMLGESQYKHQLEADIRPFRDILMGLFFTTIGMQLQLYGFVQNFHWILLALIVMAVIKIALISSVARFMGERDEDAWGSGISLFQMGEFGFVIVALASSHGLLSKEIVTSMIGIGVLSMAITPIVIHRLKPLVNLVVRHPDPLVDIEQQRTTGSEGLENQVLICGFGRVGQTMSRFLDAEGITHIAVDNDPMRVQEAVAGGARVYFGDSARKDILRAVGAESVDLIIISFADDLRALEVLKELRQLNPDAYIIVRSRDDTRLTQLQEAGASQVVPDTLEASLMLISHVLSRSGIPIRRILARLDKERRNHYGEMHGFFQGDETEITPELADKLEFLRALTLPEGAWATGKRIDELDWEKHQVQLKALRRDDEEIQEPDGDTELQPQDVVLLVGKPRYVEAAERWLLEG

SEQ ID NO: 16849 - protein, 408 aa, Ralstonia metallidurans CH34
MHHATPLISTIVGGIVLAFILGAIANKFRLPPLIGYLCAGIVVGPHTPGYTADQTLAPELAELGVILLMFGVGLHFSVKDLMAVKRIAIPGAIVQISIATALSMLVAWGFDWSWGQGLVYGLALSVASTVVLLRALQERDLIESPQGRIAVGWLIVEDLAMVLTLVLLPAMARLLGGGDANATAPTTMEVLIEVLSTLGKVAAFVAVMLVIGRRFIPWMLERIVWTGSRELFRLGVLATALGVAFGAYALFGVSFALGAFFAGMVLAESEFSHRAAEESLPLRDAFSVLFFVSVGMLFDPMVLVNDPWGVLATLLIIVVGKSLAALGIVRAFGLNNRTGLTIAVSLAQIGEFSFILASLGVYLDILPERGQALILAGALLSIVLNPVLFHLLDRYTAREDKQGDPQPA

SEQ ID NO: 16850 - protein, 256 aa, Shewanella sp. ANA-3
RPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSTEFLSLCTIAMSA

SEQ ID NO: 16851 - protein, 270 aa, Frankia sp. EAN1pec
MAKGAPARGSAGTGRRTLVAGNWKMNLNHLEAIALVQKVAFDLKPAELERVEVVFLPPFTDLRSVQTLIDGDKLAVGYGGQDLSPHGSGAYTGDISGPMLARLGCSYVVVGHSERRTYHHEDDALVASKVLAAYKHGITPILCVGEHEDIRAAGTHVEHVLAQLEGSLAGVSAEQAATLVVAYEPVWAIGTGRTASAQDAQDMCAAVRGQLTKLYDEPIAAGIRVLYGGSVKAANAAELFTMPDVDGGLVGGASLVAEEFVGIIRSGPAA

SEQ ID NO: 16852 - protein, 512 aa, Onion yellows phytoplasma OY-M
MTKKFVGLTILDGLGLTDQKENNAFHLAKTPYLDYLLKNFPNTTLKASGEEVGLPQGQMGNSEVGHLNLGAGRVVYQSLTQINKAIRDKSFFTNKQFLQAIEHVKKNNSKMHLLGLISDGGIHSHLDHFKALFDLLKENNLANNTFLHAFTDGRDTSPHSGINYIKDLLDYGFNIASVVGRYYALDRDNNWNRINLVYNMLTSKQAPVIDLPLEDTIQNFYNQGITDEFITPFITNPNGLINDNDAVIFVNFRPDRAMRLATALSNPCATNAFCSEGKTNFCGTKLLNNLFLVTMTKYSAQVKSVVAFEKITLKNIYGEVIANLGMHQLRIAETEKYPHVTFFFDGGKELQLKNADRILIPSPKVKTYDLKPEMSALEITTHAKTAILSGKYDTLILNFANPDMVGHTGFLDATIKAIQTVDSCLKEVLNAIFAVKGKACIVADHGNAEQMTDNQGNPHTAHTTNLVPFIVTDKNVVLKPGSLCDVAPTMLDLLEIKKPQEMTGNSLIKKLV

SEQ ID NO: 16853 - protein, 446 aa, Onion yellows phytoplasma OY-M
MNKTKIICTLGPASYDKNILQALIQTGLNVARFNFSHAQYEQTKLLMKTIKTISDKLDKNTGLMLDTKGPEIRTHEFDGVVTIQKDSEVKISMTEVLGNAKLFSVSYSNLYNELKVGDMVNIDDGYLSLEVVGKDEAKQQLVTKAKNTHSIKSRRGVNVPKVNLEMDFISPKDYQDIVFAAQQDFDYIAASFVRRAQDVKDIRKILQEQGNSNIQIISKIENQEGVDNLEEIIQESDGIMVARGDLGIEVDGELVPLYQTRMITKCLEYGKPVVVATQMLESMQRNPRPTKAETSDVFNAVREGTTFTMLSGESASGEYPVEAVTYMKKINYQAEKVVNYQALSQVYQPKNSKENLLLSAVELALRTDVKAIVVYDLKDAYNVSKFHPSVPVLALVKTEQEARRLVLNFGVCPFVSETKLQTKLEELTQNQSSNCLVVKDGMLYFK

SEQ ID NO: 16854 - protein, 965 aa, Thermus caldophilus
MDPLWYKDAVIYQLHVRSFFDANNDGYGDFEGLRRKLPYLEELGVNTLWLMPFFQSPLRDDGYDISDYYQILPVHGTLEDFKRLLDEAHGRGMKVIIELVLNHTSIDHPWFQEARKPNSPMRDWYVWSDTPEKYKGVRVIFKDFETSNWTFDPVAKAYYWHRFYWHQPDLNWDNPEVEKAIHQVMFFWADLGVDGFRLDAIPYLYEREGTSCENLPETIEAVKRLRKALEERYGPGKILLAEANMWPEETLPYFGDGDGVHMAYNFPLMPRIFMALRREDRGPIETMLKETEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRNAGFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREGLLNALAQTLKEKSWLALKPQKVALLDALRFQKDPPLYLTLLQLENHRTLQVFLPLLWSPQRREGPGLFARTHGQPGHFYELSLDPGFYRLLLARLKEGFEGRSLRAYYRGRHPGPVPEAVDLLRPGLAAGEGVWVQLGLGQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVEGGHPLLGRGLGAFLELEGEVYLVALGAEKRGAVEEDLARLAYDVERAVHLALEALEAELWAFAEEVADHLHAAFLQAYRSALPEEALEEAGWTRHMAEVAAEHLHREERPARKRIHERWQAKAGKA

SEQ ID NO: 16855 - protein, 531 aa, Rhodococcus sp. RHA1
MSQPGRPVVLIADKLAPSTVEALGDGVEVRWVDGPDRPALLAAVPEADAILVRSATTVDAEVLAAGTKLKIVARAGVGLDNVDVAAATERGVMVVNAPTSNIHTAAEHAVALMLATARQIPAADATLRDREWKRSKFNGVEIFGKTVGVVGLGRIGQLFAQRLAAFETHVIAYDPYVSAARAAQLGIELVTLDELLERADLISVHLPKTPETKGLLGTENLAKTKKGVVIVNAARGGLIDEAALAEAIKSGHVRAAGLDVFETEPCTDSPLFDLPEVVVTPHLGASTTEAQDRAGTDVAKSVLLALAGDFVPDAVNVSGGAVGEEVAPWLEIVRKQGVLIGALSGELPVNLSVDVRGELASEDVEVLALSALRGVFSAVIEDAVTFVNAPALAEERGVTAEVTKAAESPNHRSVVDLRAVFGDGSVINVSGTLTGPQQVEKIVNINGRNFELRAEGLNLVVNYTDQPGALGKIGTQLGNAGIDIQAAQLSQDAEGEGATILLRVDREVPSEVRDAISTAVGATKIELVNLA

SEQ ID NO: 16856 - protein, 189 aa, Brassica napus
SLAFSGSLRLGPTAQPVRVKYTQLLRNPRRSSLYYVNLVAIRVAKKVVDIPPAAIAFNPTTGAGTIFDSGTVYTRLSKPVYEAVRNEFRKRVKPRTAVVTSLGGFDTCYSGKITVPTITFMFKGVNMTMPADNLMLHSSAGSLSCLAIASSPENVNSVVNVIASMQQQNHRVLIDVPNGRLGLARERCS

SEQ ID NO: 16857 - protein, 445 aa, Rhodobacter sphaeroides 2.4.1
MKDWLRKHPQVRTIRVAAADLNGQARGKRIPARFADKVVKDGTRFPFSVLNLDIWGEDIDDSPLVFEQGDADGILRPTERGFMPMPWLEAPTALLPIWMFREDGRPYEGDPRHALRAVLDRYKARGLTPVVAVELEFFLIDDSGKTLQVPPSPRSGKRRKAAEALSIRALDAFDIFFTDLYDACEEMDIPADTATSETGLGQFEVNLMHCDDALRAADDAWFFKLLVKGLARRHGFAASFMAKPYPEYSGSGLHMHFSVLDAQGRNVFDNGGPTGTAMMRHAVAGCLNAMHDSTLVFAPHANSYDRLVPGMHAPTAISWGYENRTTAVRIPAGNPAARRIEHRVAGGDVNPYLLVATILGAALTGIEDQEEPPQAIMGNAYALEDLPQIPPSWEAAIQSFENSAIMPRILPRELIRNYVLTKRQELHYLAELSPEEQVELYLDTV

SEQ ID NO: 16858 - protein, 451 aa, Rhodobacter sphaeroides 2.4.1
MSDWTDRLPEAARAYIADRRVDEVECILSDIAGVARGKAMPAFKFGKQTSFFLPNSIFLQTITGEWADNPSGAFTEPDMILIPDYSTATAAPWTADITLQVIHDAVDQQGRPVPVSPRNVLRRVVELYNAEGWTPIVAPEMEFFLVARNIDPNMPVMPPMGRTGRRAAAKQAYSMSAVDEYGKVIDDIYDFAEAQGFEIDGILQEGGAGQVEINLAHGDPVALADQIFFFKRLIREAALRHDCFATFMAKPIEGEPGSAMHIHHSVVDSASKLNIFSDAKGGETEAFLHFIAGMQTHLPAAVALLAPYVNSYRRYVPDFAAPINLEWGRDNRTTGLRVPISGPEARRLENRLAGMDCNPYLGLAASLACGYLGLKERKMPQPECTGDAYMSETDLPYNLGDALDLLEEDAALRDVLGPEFCGVYDSVKRNEYKEFLQVISPWEREHLLLNV

SEQ ID NO: 16859 - protein, 471 aa, Fremyella diplosiphon
MTTPQEVLKLIQDQKIQMIDLKFIDTPGTWQHLTVYYNQIDESSFTDGVPFDGSSIRGWKGIEESDMTMVLDPNTAWIDPFMKEPTLSIICSIKEPRTGEWYNRCPRVIAQKAIDYLVSTGLGDTAFFGPEAEFFIFDDARFDQTANSGYYYVDSVEGRWNSGKDEGPNLAYKPRFKEGYFPVAPTDTFQDMRTEMLLTMAACGVPIEKQHHEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGTNPKAKRLEFRCPDATSNPYLAFAAMLCAGIDGIKNKIHPGEPLDRNIYELSPEELAKVPSTPGSLELALEALENDHAFLTESGVFTEDFIQNWIEYKLVNEVKQLQLRPHPYEFYLYYDC

SEQ ID NO: 16860 - protein, 344 aa, Mesorhizobium sp. BNC1
MTNMMKALVKAKPEEGLWMERVPLPEIGPNDVLIKVRKAAICGTDVHIWNWDEWARKTVPVPLVTGHEFVGEVVDVGSAVTEYRIGQRVSGEGHIVCGHCRNCRAGRGHLCRNTLGVGVHRPGAFAEYISLPQHNVVAIPDDVPDEIAAIFDPLGNAVHTALSFDLVGEDVLVTGAGPIGIMGALVAQCVGARKVVITDINPGRLALAKKLGVRHVVNAREEKLTDVMRKLGMTEGFDVGLEMSGSASAFRDMIDVMNNGGKIAILGIAPTGFEIDWNKVIFKMLHLKGIYGREMFETWYKMIALVQGPLDISGLITHRISADDYREGFAAMRSGEAGKVVMDW

SEQ ID NO: 16861 - protein, 274 aa, Anabaena variabilis ATCC 29413
MAGEFNQQKLETALQTARKYGYLPFSLHIFSTVASTNKTLWGLIDQGASTGSVVIATQQTAGRGQWGRQWVSPTGGLYVSVALTPKVDANASYQITLATAWGIACQLRESGVNVGIKWPNDLVLEGRKLGGILTETKVSQGQISQAVVGVGINWSNSVPETGINLESWQADQIHKPISCLETLTSKVLLGIESGMVCLFQEGISILLSRYSELLVNMGDRVHVNDLSGIVVGVTPQGDLRVSLETACVTDTKAPELYLEPGTISLGYRRSLGTY

SEQ ID NO: 16862 - protein, 358 aa, Brassica napus
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGDRCKKYYEAGARFAKWRAVLKIGENEPSELSIHENAYGLARYAVICQENGLVPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 16863 - protein, 92 aa, Oceanobacter sp. RED65
MPVASACHILVKDKKLAEELKQRLAKGEDFGKLAKQYSTCPSKKQGGNLGEFHKGDMVKAFDDVVFKRPILKVHGPIKTRFGYHLIKTIYRS

SEQ ID NO: 16864 - protein, 311 aa, Aspergillus oryzae
MGLFSSAEPPLTEANLSNQSGMTFVVTGATSGYGLHLATILYQHGGKVYLAARNASRAQSVIDDITRRHPESKGQLVYLHLDLGDLSTIKKSAEEFLTKESKLHVLWNNAGVMIPPQGSTTAQGYELQLGTNVIGPFLFTKLLYPALAKAAADSPPNSVRVVWLSSSAVRMAPTPAIDFSNMDYHKDEGAWTKYGRSKAANVLLAVEFARRSKKDGVASIVGPLKRISPAENNALLASRCRVGQRPEVGAYTELFAGLQPDIDPVNSGNWSLTCRVVVPPGRVVAGRKDLYDPELSEKFWQWNEEQVRSYL

SEQ ID NO: 16865 - protein, 461 aa, Xanthomonas oryzae pv. oryzae KACC10331
MSIRTRSRKATPKQPESALRRWLKERSITEVECLVPDITGNARGKIIPADKFSHDYGTRLPEGIFATTVTGDFPDDYYALTSPSDSDMHLRPDASTVRMVPWATDPTAQVIHDCYTKEGDPHELAPRNVLRRVLDAYAQVKLQPVVAPELEFFLVQKNTDPDFPLLPPAGRSGRPETARQSYSIDAVNEFDPILDLMYDYCDAMELDVDTLIHESGAAQLEVNFTHADPLSRADQVFLFKRTMREAALRHGVYATFLAKPMETEPGSAMHIHQSLLHADTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIRENLEPTAPISSNGKEQGYDLPRSLGEALDELEGCDALQEMLGQRFVRAYISVKRKEYETFFRVISSWEREFLLLNV

SEQ ID NO: 16866 - protein, 442 aa, Aspergillus nidulans FGSC A4
MHLILLGTLDTKRSEVLYLHSQLHQTASRLNTPLSITLIDCGVRSEIDSDPAITVSHTDLITKYPYASDLDSPSPTKDLFVLPRGEAISIITACATKCVSELLQTQDVHGIIGVGGSGGTSLISAVMRSAAKIGLPKLIVSTVASGNTGPIVGETDLTLMYSVVDIAGSNRLLKDVLENAAGAMVGMASAYKARLEASISATPAQSEKSRLRVGVTMFGVTTPCVDTIRSHLETNYAVEVYVFHATGHGGKAMERLVEEGHLDAMLDLTTTEICDLIAGGEMACDRRRLETSLKKGIPTIISVGATDMVNFGPIETVPPKYQGRKLFVHNPSVTLMRTSREECEAVGRFIVEKVNGCVREGKAGLVEVVIPKGGVSKISTTGGVFEDKQADEALANVLMVGLEGKVRVVQDPRDVNDRGFAVDIAERLMTLVAAAGEKREKV

SEQ ID NO: 16867 - protein, 288 aa, Idiomarina loihiensis L2TR
MSKNQGGNKHQGGSKTHLGHRARKRFGQNFLNDDYIIEQIVDAINPLPGENLIEIGPGLAALTEPTVDRSGHLKVIEIDRDLVERLQHHPFLSSKLEVIQADALSIDFSQFAEEGPARVFGNLPYNISTPLIFHLLKFADDVKDMHFMLQKEVVDRLAAEPGSKSYGRISVGVQQACKVTPVVAVPPSAFTPPPKVESSVVRLEPYAESPHPVKDKAQLHSLCLTAFNQRRKTIRNNLKQLVPAEQMEALGIDPGARPETLSVDDYCRISDWLTEHSLTKQAEKNDSQ

SEQ ID NO: 16868 - protein, 438 aa, Triticum aestivum
MIFQDFLQLSCLPAWNRAARPGFWRQFTVREGRSPAQAVVAQDTQTQISEVMIIIQVCSTGVDEVLMKDEFAKLSKTLVQGAATCSPPLPLTTIVVQDHVGISNVAPADCPLIPLLAPEVDQSEEGAVDKTRIHDHISNLRFSLSPTAFFQVNTLAAERLYTLAGDWANLNSDTLLFDVCCGTGTIGLTLAHRVGMVVGIEMNESAVVDAQRNALINGIKNCRFVCGKAEDVMGPLLTEYLGSPQRHIAASESNSEVNGTGKKEDIVGGAENNGKSTESLTEKNESGEINEDLDDGVSKELEGGHEQCNEVVRNQNSEEASSLVNEESVDVKAADCSEHSKTREEGSSISKNDVLAATACQFKNFVAIVDPPRAGLHPTVIKEKNKGHRGWRNMSSAGLARQRTKSMPNSEPFVPKRAMAVDLFPHTSHCEMVMLFER

SEQ ID NO: 16869 - protein, 225 aa, Halobacterium sp. NRC-1
MKQAGGSAEQKRRAGEAAVAEEVTEGAVVGLGTGSTVAHAIRALGAEASDVSGVATSFESRRRAVDAGVTVTSLEAASVDVAIDGADQVADGVLVKGGGAAHTREKYVAASADRFVVVADPSKESDVVDVPVPVAVVPDAWPVVVDRVEALGGTATLRDAERKDGPVVTDTGSLVVDCDFGAIETPEAVAASLSAVPGVVEHGLFVGMADAVYVGTDDGVRVRDP

SEQ ID NO: 16870 - protein, 262 aa, Silicibacter pomeroyi DSS-3
MTGELSPIDKAKFVAAKRAADLVEDGMRVGLGTGSTAAWLVRCLGDMVRKEGLKMRGVPTSTRTAQLAREVGIEVITLDEARWLDITIDGADEFDGDLNLIKGGGGALLQEKIVATASDQMVVIADLGKEVSRLGAFPLPVEVIPFGWQTTQALLEETLISMDVLGRTATLRMNGDTPFVTDEGNHILDLHLQRIGNARQLALVLNQIPGVVENGLFIDICDTVVVGHGDGRVEIRDINQGTVEHDRLDFVESDNLFTDLAD

SEQ ID NO: 16871 - protein, 616 aa, Schizosaccharomyces pombe
MVLPKSKNQIGLGRAIQSDFTKNRRNRKGGLKHIVDSDPKAHRAALRSVTHETDLDEFLNTAELGEVEFIAEKQNVTVIQNPEQNPFLLSKEEAARSKQKQEKNKDRLTIPRRPHWDQTTTAVELDRMERESFLNWRRNLAQLQDVEGFIVTPFERNLEIWRQLWRVIERSDVVVQIVDARNPLFFRSAHLEQYVKEVGPSKKNFLLVNKADMLTEEQRNYWSSYFNENNIPFLFFSARMAAEANERGEDLETYESTSSNEIPESLQADENDVHSSRIATLKVLEGIFEKFASTLPDGKTKMTFGLVGYPNVGKSSTINALVGSKKVSVSSTPGKTKHFQTINLSEKVSLLDCPGLVFPSFATTQADLVLDGVLPIDQLREYTGPSALMAERIPKEVLETLYTIRIRIKPIEEGGTGVPSAQEVLFPFARSRGFMRAHHGTPDDSRAARILLKDYVNGKLLYVHPPPNYPNSGSEFNKEHHQKIVSATSDSITEKLQRTAISDNTLSAESQLVDDEYFQENPHVRPMVKGTAVAMQGPVYKGRNTMQPFQRRLNDDASPKYPMNAQGKPLSRRKARQLTALELGVSPEALSSATSKKHNKKNKRSKQRSGVVIDDY

SEQ ID NO: 16872 - protein, 296 aa, Salinibacter ruber DSM 13855
MERSHVGRDCGSRSSPRAFSVPTSNVPMKMSIPFRPKQSLGQNFLHDPNMAEKIVGTLTAPPEAHVVEVGAGTGVLTERLAERHDRLTALEIDERAVEVLRERVPEADVRETDVRETDWAALADEKGGPLRVISNTPYYLTSPILFALLGQRDCLAEAVLTMQKEVAERIVAEPSTKAYGILSVLLQLFAEPTLCFTVPPQVFSPQPDVTSAVVRIRFGPDTEPEDLHFDDARRYVRAAFNQRRKMLRNSLSAWTKEQDVGFPNDWGRKRAEALTPDEFATLARHLDAHADPVPDA

SEQ ID NO: 16873 - protein, 391 aa, Bordetella bronchiseptica RB50
MSAQISSLNAGAAPESFGIASVPEIIAELRAGRIVILVDEEDRENEGDLVMAAEFVTPEAINFMVTHGRGLVCLTLTEERCRQLDLPLMASRNGTRYGTNFTQSIEAAEGVETGISAADRARTIQVAVARDAQPSDLVQPGHIFPVRAVPGGVLVRAGHTEAGCDLTAMGGLTPAAVICEILKPDGTMARLPDLVEFAREHKLKIGTIADLIQYRSEHESIIARMGERMMQTPWGDFRCIAYRDDATRSPHLALVHGNIDPERETLVRVHEPASLLDVLDTGASPHSWSVGQALHAIAASPAGVLVLMNCQSSTEHLFGQIANWAGPAERAAAQEGDRFGLRTYGIGAQILRDLNVGRMKLLARPRKMPSMAGFALTITGYDCAPPNLRND

SEQ ID NO: 16874 - protein, 827 aa, Oryza sativa (japonica cultivar-group)
MDRSDALACITSVLILLAPPCASDDRLVPGKPLSPGATVVSDGGAFALGFFSPSNSTPEKMYLGIWYNDIPRRTVVWVADRGTPVTNSSSSAPTLSLTNSSNLVLSDADGGVRWTTNITDDAAGGGSTAVLLNTGNLVVRSPNGTTLWQSFEHPSDSFLPGMKMRVMYRTRAGERLVSWKGPDDPSPGSFSFGGDPGTFLQVFLWNGTRPVSRDGPWTGDMVSSQYQANTSDIIYSAIVDNDDERYMTFTVSDGSPHTRYVLTYAGKYQLQSWDNSSSAWAVLGEWPTWDCNRYGYCGPFGYCDNTARAPAVPTCKCLAGFEPASAAEWSSGRFSRGCRRTEAVECGDRFLAVPGMKSPDKFVLVPNRTLDACAAECSSNCSCVAYAYANLSSSGSKGDMTRCLVWSGELVDTEKEGEGLSSDTIYLRLAGLDLDAGGRKKSNAIKIVLPVLGCILIVLCIFFAWLKIKGRKTNQEKHRKLIFDGEGSTVQDFELPFVRFEDIALATNNFSETNKIGQGGFGKVYMAMLGGQEVAIKRLSKDSRQGTKEFRNEVILIAKLQHRNLVRLLGCCVEGDEKLLIYEYLPNKGLDATLFDGSRKMKLDWTTRFNIIKGVARGLLYLHQDSRLTIIHRDLKAGNVLLDAEMKPKIADFGMARIFGDNQQDANTQRVVGTYGYMAPEYAMEGIFSTKSDVYSFGVLLLEIVTGIRRSSTSNIMNFPNLIVYSWNMWKEGKSKDLVDSSIMDSCLLHEVLLCIHVALLCVQESPDDRPLMSSIVFTLENGSSVALLPAPSCPGHFTQRSSEIEQMKDNTQNSMNTFTLTNIEGR

SEQ ID NO: 16875 - protein, 392 aa, Arabidopsis thaliana
MEFSGGNDGDVSISSVHACFNTLNSLSGVGILAIPYALSSSGWISILFFFLIGVTTWYTGLLLQRCLKLDPMVRSYPDLANKAFGKKGRLLVSFFIYIELYFVATAILILEADNMYHMFPHHLFIVIASLIVVPTMWLETQDFLSYISAGGILVSCIQVMSILWIGAIDGVGFKNKGVLVKWSGIPTAVSLYLVCYTAHHVFPTIYNSMKNKKHFSKILSISFALSSIIYAVVAIFGYLMYGEEVQSQITLNLPTHNISAVIAISTTIVSPLTKYALILSPIMEAINTRLIQANYKRRSLRMLTGTGLVLGTILVALVVPLFGYVMSLIGALLSSCTSIVFPCVIYLKISKGYRRCLEFESVVLVVIIVMGLVLMVTGTYSAIVGITLHLWF

SEQ ID NO: 16876 - protein, 376 aa, Aspergillus oryzae
MSSTVGKAAIAWAAGEPFSVEDVEVAPPKAHEVRIKIIHTGVCHTDAYTLSGKDPEGAFPVILGHEGSGIVESVGEGVTTVKPGDQVIALYTPECGECKFCKSRKTNLCQKIRTTQGKGVMPDGTSRFRARGKDILHYMGTSTFSQYTVVADISVVAVTTKAPTDRACLLGCGITTGYGAATVTANVEQGSNIAVFGAGCIGLSVIEGAVKNKAGKIIVVDVNDGKEQWARKFGATHFINPTKVKNGKTIQEELIELTDGGCDYTFDCTGNVGVMRAALESCHKGWGESIIIGVAAAGQEISTRPFQLVTGRVWRGCAFGGIKGRSQLPGLVDDYVAGYLKVDDYITHRESLGTINTAFQHMKSGDCIRCVLDMKV

SEQ ID NO: 16877 - protein, 115 aa, Glycine max
MRLVLRRNQQSAIRSERDMEGIEGNSSRYSLKPSRICNEDVLICVDVDPQCLVEMKGATGPNGRPLTRLDSIKQAIVLFVNAKLTINPEHRFAFATLSNTLVSWVSFFLVLFSFN

SEQ ID NO: 16878 - protein, 162 aa, Candida glabrata CBS 138
MARISKELLKIRKALEHGDSEFLVDLAPVDDSDLSRWFAVIKGPAETPYYPYEFKLAIEVPASYPMVPPTIKFVSDAKAGIRVPPHCNVDRRTGEICLDILKPEGWSPIWDILHVVQAIHILLQEPVPDSPLDVDMANILKNNDMSAYNGIIRYFLTEIDSP

SEQ ID NO: 16879 - protein, 452 aa, Cryptococcus neoformans var. neoformans JEC21
MLRNLRPLLRTVPAPSRSVIRPLSTTSKAFATAQSSPVRAHSVEELHALTAEEILKEGGVRKEAEMRHFTVNFGPQHPAAHGVLRLILELNGEEILRADPHIGLLHRGTEKLIEYKNYTQALPYFDRLDYVSMMTNELSYSIAVERLLNIEVPERAKWIRTLFGEITRVLNHLMAVLTHAMDVGALTPFLWGFEEREKLMEFYERVSGARMHAAYVRPGGVAFDLPHGLLDDIFKWATQFSSRVDEVEEVVTGNRIWKQRTIGIGPVTAQQALDYSFSGVMLRGSGIPWDIRKVAPYDAYDKVEFDVPVGKNGDCYDRYLCRVQEFRESLRIIGQCLNKIPDGAYKVDDHKIVPPPRASMKESMESLIHHFKIFSEGYSVPPGETYAAIEAPKGEMGVYLVSDGTNRPYKCKIRAPGFAHLAGADFMMRHHFLPDAVAIIGTMDLVFGEVDR

SEQ ID NO: 16880 - protein, 89 aa, Triticum aestivum
TTAAAAKASWMVAMSVGALEALKDQAGLCRWKYALRSIHRAAKANVRSGVSQGNKQLPAIVAAVAERWRAEKAEEGLRTVMYLSCWGLN

SEQ ID NO: 16881 - protein, 338 aa, Synechococcus sp. CC9605
MSSETRFPSDCCSLDVVGIGNAIVDVLVQTDDSFIAEHGLQKGGMALIDEQQAEALYKASGTGLETSGGSVANTMVGIAQLGGRAGFIGRVRDDQLGSIFSHDIRAVGARFETPAATSGATTARCLIYVTPDAERTMCTFLGASTQLEPEDLDLSMVKQAKVLYLEGYLWDSPAAKRAFIAAAEACREAGGKVALSLSDGFCVDRHRASFLELVNGHVDVLFANDVEIQSLYETDNFDQALERVRGCCSVIAITRGAQGSVVLSGDQRRDVGIFGLGDLVDTTGAGDLYAGGFLHGFTHGESLERCGELGALCAGQIVTQLGARSQVSLKQLAETHLN

SEQ ID NO: 16882 - protein, 471 aa, Mesorhizobium sp. BNC1
MTVTPIIISGGAGSRLWPLSRDAHPKPFIELPDGTSLISRTYGRAARLQGVERIVTVTNRDLLFLTADVYAASDAPRRSNGYLLEPFGRDTAAAVALATLHVNEAEGPDAVLLVLPADHLIADEDAFAEAVGKAVEMAQTGRIVTFGIVPERAETGYGYIEAKGGRVLRFVEKPDAKKAADYVASGRFYWNSGMFCFPARTMLEAMEAHCPEVLVGARAAYRAARKFNADDREVFEIDRDSFAATPAISLDYAVMEKAENVGCIALDCGWSDIGSWSAVAELTPADENGNRLRGEVLLEDTSNSFVHSEHRLVGLVGVSDLLVVDTPDALLVAHKEKAQEVKRLFNRLKEQGHHAAKLHCTAHRPWGTYTVLEEGDRFKIKRIEVKPGARLSLQAHHHRSEHWVVVSGTAKIVNGDQEILLATNQSTYIPCGFKHRLENPGILPLVLIEVQSGDYLGEDDIIRFDDVYGRN

SEQ ID NO: 16883 - protein, 141 aa, Ralstonia solanacearum
MAIERTLSIIKPDAVAKNVIGQIYARFEGAGLKVVAAKMIHLSRAEAEQFYAVHKERPFFKDLVDFMISGPVMVQALEGESAIVKNRDLMGATDPKKAEKGTIRADFADSIDANAVHGSDAAETAAVEVAFFFPGLNIYSR

SEQ ID NO: 16884 - protein, 443 aa, Zea mays
NYIKESFENGTLHLIGLLSDLGVHSRLDQLQLLLKGVSERGAKKIRVHILTDGRDVLDGSSVGFVETLENDLLELRGKGIDAQIASGGGRMYVFLDRYENDWDVVKRGWDAQVLGEAPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 16885 - protein, 223 aa, Brassica napus
  misc_feature (210)..(210): Xaa can be any naturally occurring amino acid
  unsure (1)..(223): unsure at all Xaa locations
RPTRPQTSSFNSLIMVFEASIAIFCFIPLCFFLFMNPRDNLLRNWPVLGMLPGLLVEFHRIYEFSVEILRSSNLTFTFKGPWYSGMDMLFTVDQANIHHIVSSNLSNYTKGPDFKEVFDVLGDGILTADSELWKNLRKASKVMFSHQGFRRLLMSTTRRKINDGLIPLFNHLAEEGAVVDLQDVFVRVTFDTTLVMVTGSADPRSLCVEXPEADEFAKAPNDV

SEQ ID NO: 16886 - protein, 131 aa, Brassica napus
  misc_feature (128)..(128): Xaa can be any naturally occurring amino acid
  unsure (1)..(131): unsure at all Xaa locations
MAAGGGGSSSAGRTPTWKERENNKKRERRRRAITAKIYSGLRAQGNYKLPKHCDNNEVLKALCLEAGWIVEEDGTTYRKGFKPSPTNFSTNSSIQPSPQSSAFPSPAPSYHGSPVSSSFPSPSRYDQXPSS

SEQ ID NO: 16887 - protein, 332 aa, Aspergillus nidulans FGSC A4
MTSVFVCSFRDNIPVSASHQLFTFPFSPSSQRAIRWHHQPPAPRFCRASVPRSKRASLSSALEPVWNPAIPLMVSHTELTSTGIGLSAKSVEAGGGDLIIIYNSGRFRMAGHGSLAGLMPYSNANEVVVEMASEVLPVVKHTPVIAGVCGTDPLRDIPRFLSQLKGMGFAGVQNFPTVGLIDGQFRANLEETGMGYDKEVEMVRAASELGLLTTPYVFNVGEAEAMAKAGADILVAHMGLTTSGTIGAKTGKTLEQCVDEIQAIRDVAVKINPDVILLCHGGPIARPEDARFILGRVAGLHGFYGASSMERLPVEVAIKDTTAEFKKIALRH

SEQ ID NO: 16888 - protein, 340 aa, uncultured beta proteobacterium
MWPCKIWPVHTRPHKALFPILRRLSDGVFHSGQDLAYEFDLSRASIFNVLNQAEAMGLNVHAVRGRGYRVPEAIEWLDEAAVVSRLDELAPYYSVRVLDSVDSTNSALMAAATTGAPDGTVLCAEHQGAGRGRRGRHWHAVLGGSLTFSVLWRFDGGLQSLAGLSLAVGLAIARAVNRHSRHTARLKWPNDVLVDYRKLAGILVEVQGDMNGSAFAVVGVGLNVSLNEAQRDAVDQAVVDLSEMGVSVGRNQLLADCLRELHGVLGIFRQHGFAALRADWMALDAFAGRAVTLQLPNAQGVQGVAAGVDDTGAFLLRGTHAAQVAYNGGEISLRLDMLQK

SEQ ID NO: 16889 - protein, 481 aa, Xanthomonas oryzae pv. oryzae KACC10331
MFPGEPMSSASIDGAPDAGENTRFIILISCVATIGGFLFGFDSGVINGTVDGLKQTFQSTAAETGFEVASMLLGCAIGAFFAGRLADRSGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSLLFLLLLLVIPESPRYLVVKGRREQALVVLKRLYGNAAAQTKLGEISASMSADRHKPKFSDLINQATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDLNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKCVYETKGKELEQMEG

SEQ ID NO: 16890 - protein, 271 aa, Blastopirellula marina DSM 3645
MNSVVKPVKTRDIRGKLILLGTGTSVGVPAIGCGCPVCTSRDPHNKRMRCSVIWGLPEGNLLVDTPPDMRSQLLREEIGIVHAVAYTHQHADHLYGLDDLRVFQFYLGHGVPLYCEPNVERQIRAAFSYAFSEITPTHVGATPALEFQRIGLNPFTVLGAQVTPIRLKHGPRFEVLGFRIGNVAYCTDTNEIPAESFALLQGLDVLILDALRFDPHPTHFSLDEAVAMAEKIGAKQTYFTHISCRMDHQETNAKLPDHMQLAYDRQEIPLS

SEQ ID NO: 16891 - protein, 138 aa, Brassica napus
  misc_feature (97)..(97): Xaa can be any naturally occurring amino acid
  unsure (1)..(138): unsure at all Xaa locations
PQNFFQGEKFFPPWGQNLFGKIFKTFFFPGGGSPPDYVELFPPPPPPEIKYPNWSKKVAPFWPGVLPPPLTWKGLGFFFWGGLKRKKGAFPIPFIIXGAKKGVFKFGIIPCQNPFLVFFYQKNFCFRPFFPNFFPFFK

SEQ ID NO: 16892 - protein, 427 aa, Idiomarina loihiensis L2TR
MSRSEELYTKAQISIPGGVNSPVRAFNGVGGSPIFFESAEGAYMIDADGKRYIDYVGSWGPMILGHNHPAVLEATLQAAKRGLSFGTPTEVEITMAETIRKIVPSIEKVRMVNSGTEATMTAIRLARGYTGRDKILKFEGNYHGHADSLLVKAGSGALTLGVPNSPGIPEDFAKHTLTATYNDIESVKQIFAEMGDEIACIIVEPVAGNMNCIPPVDGFLEGLRSICDDHGSVLIFDEVMTGFRVAPGGAQDRYKIKPDLTTLGKVIGGGMPVGAFGGKKEVMDYIAPVGPVYQAGTLSGNPVAMAAGLAALQQLSTPGLYDQLYQRVDTLLDGLQERADRAGVPMTTNRAGSMFGFFFTEEPEVTTYAQATQCNMEHFKTFYHAMLEQGVYLAPSAFEGGFMSAAHSEEDIQNTLNAAEKAFAKLV

SEQ ID NO: 16893 - protein, 140 aa, Mesorhizobium loti MAFF303099
MALERTFSMIKPDATRRNLTGAITKMLEDAGLRVIASRRVWMSRREAEGFYAVHKDRPFFGELVEFMSSAPTIVQVLEGENAIARNREVMGATNPANAAEGTIRKVHALSIGENSVHGSDAPETAAQEIKYWFSDTEIVG

SEQ ID NO: 16894 - protein, 495 aa, Kineococcus radiotolerans SRS30216
MSVEKDTGPGVGVQRDFSHEDGGLHKGLKNRQLQMIAIGGAIGTGLFLGAGGRLVTAGPGLFIVYGVCGFFVFLILRALGELVLHRPSSGSFVSYAREFYGEKAAFVAGWMYWFNWAMTAIVDITAIATYMHFWDTFSAAPQWLLALIALVVVLGLNLVSVKIFGEMEFWFALIKVIALTAFLLIGIVFLAGRFPVEGQPTGLSVISGNGGWFPTGAVPLVVVVSGVVFAYAAVELVGTAAGETENPEKIMPRAINTVILRIVVFYCGSLVLLALLLPHTAYSADESPFVTFFSKIGVPGAGDVMNFVVLTSALSSLNAGLYSTGRIVRSMAQNGSAPKFTAKLNKGGVPFGGIAITGVVAVLGVGLNYVAPGRAFEIVLNASALGIIASWGTIVLCQLRLHAWSKKGIVTRPDYRLFGAPYTGYLVLAFLVAVLGIMAYDEDSRPTVYALGVIVPLLVLGWFAVRKRVLAAAEERMGYTGEFPVKANRPADGGK

SEQ ID NO: 16895 - protein, 226 aa, Oryza sativa (japonica cultivar-group)
MLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVRDRIYGYPT

SEQ ID NO: 16896 - protein, 495 aa, Xanthomonas oryzae pv. oryzae KACC10331
MACCNERMRGSVMARDAAVGTAQRASDSLPRLAGALTADAALDSAETVAPQGLCRCEHSVAATQSHTPSGIVADPIAALHCPMSPKRTSFPKQDIRVLLLEGISPTAVDVFRAAGYSQIELHAKSLPEDELIARIADAHIVGIRSRTQLSAEVLAHAKRLIAVGCFCIGTNQVDLDAAEVAGIPVFNAPYSNTRSVAELVIAEAILLLRGIPQKNAECHRGGWSKSAAGSHETRGKVLGIVGYGHIGTQVGVLAESLGMQVIFHDIETKLSLGNARAAIDLDDLLARADVVTLHVPETPSTKDMIGAAEIARMKHGAHLINASRGTVIDIDALDAALTSGQIGGAAVDVFPIEPKGNGDAFASPLTAHDNVILTPHVGGSTLEAQDNIGIEVAAKLVRYSDNGSTLSAVNFPEVTLPEHPDSLRLLHIHRNVPGVLSQINELFSRHNLNIDGQFLRTDPKVGYVVIDVSASEELAAILKDGLAQITGTLRTRVLY

SEQ ID NO: 16897 - protein, 219 aa, Shewanella sp. ANA-3
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGKFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 16898 - protein, 584 aa, marine gamma proteobacterium HTCC2207
MNPNSLSDALTRHLTTIYQGVDGVDSDNHGQLGNKLIELMGLQQATTEPTRYVNHWDEKDCLVISYGDSVLQPEETPLQTLKRFLDRYVEDCISGVHILPFYPYTSDDGFSVLDYSSVNESLGDWSDIEAIAADYSLMSDLVINHCSARSPWFENFLNDREPGHNFFATASPDDDLSAVVRPRTNALLKEVETVRGSQFVWCTFSHDQVDLNFRNPEVLKQFVSIIRQYLDSGVRIFRLDAVAFLWKEPGTSCINLEQTHEVVRLLRTLIEHAQPDAIIVTETNIPNRENLAYFGNANEAHWVYNFSLPPLLVNSLITGDCNYLKQWMMSMPPARNGTAYFNFIASHDGIGLRPAEGLLKETEIDILVDTMQSFGGRISWRTGDQGQRKPYEINISLFDALQGTTEGPDQWGLQRFLCAHAIMFALEGVPGIYIHSLVGTHNDYQRVENAGHNRAINRHQWQYSELQARLANANSSEHQVFGGISELLKIRRQQSAFHPNATQFTLHLGSGLFGFWRQSIDRQQSIFCISNITSEVQMLNLSDINLIDNENWVDLISQLPCDGLMQSVAMEPYQTLWITNQVNG

SEQ ID NO: 16899 - protein, 187 aa, Delftia acidovorans
MSVEGSGNDLVQVVSLLGAAVVAVPLFKKLGLGSVLGYLAAGLAIGPFGLKLFSDPQAILHTAELGVVMFLFVIGLEMQPSHLWSLRRQIFGLGSLQCIVCGALLTLVGMAFGFPLAVSFVCAMGFVLTSTAIVMQLLGERGDIAAPRGQRIVSILLFEDLLIVPLLAAVAFIAPPALDAQAVVPSR

SEQ ID NO: 16900 - protein, 376 aa, Photobacterium sp. SKA34
MTDKFIKSKAAIAWGPKQPLSIEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPDISLAKISKEAPLEEVCLLGCGVTTGMGAVLNTAKVEEGSTVAVFGLGGIGLAAIIGATMAKASRIIAIDINEDKFELARKLGATECINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 16901 - protein, 482 aa, Escherichia coli O157:H7 EDL933
MSDAPIIAVVMAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYMTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 16902 - protein, 471 aa, Escherichia coli
MLLPVIMAGGTGSRLWPMSRELYPKQFLRLYGQNSMLQETITRLSGLEIHEPMVICNEEHRFLVAEQLRQLNKLSNNIILEPVGRNTAPAIALAALQATRYGDDPLMLVLAADHIINNQSAFHDAIRVAEQYADEGHLVTFGIVPNAPETGYGYIQRGMALTDSAHTPYQVARFVEKPDRDRAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRVEHWVILAGTGQVTVNGKQFLLSENQSTFIPIGAEHCLENPGCIPLEVLEIQSGSYLGEDDIIRIKDQYGRC

SEQ ID NO: 16903 - protein, 266 aa, Idiomarina loihiensis L2TR
MATTKTSIATLQKMKREGTKISSLTAYDSSFAKLMTEQGVDFILVGDSLGNVVQGRDSTVPVTVDDMIYHTQCVRRGASNAFVIADMPFMTYSTPEQAYDVAAALMQAGANMVKLEGGHWLVETIEGLKTRGIPVCAHLGLLPQSVNVLGGYKVQGKEQQQADDTLNQALALEQAGAQLLVLECVPASLGKRITEQLSIPTIGIGAGADTDGQILVMHDMLGMNSDYLPKFAKDFLAQGGSLADAFRLYSEQVRSGEFPTAEHSYK

SEQ ID NO: 16904 - protein, 173 aa, Arabidopsis thaliana
MRCKVVYAARTTTRTKETKTISKTISMGLQGQLSDVSSDSIPLMLLALLATFFRHVRSLLLFPSSAPVVVVTSNLSVLADQLNLNRLFSYRYSDNAASDCIVCLSKLKTGEEVRKLDCRHVFHKQCLEGWLQHLNFNCPLCRSPLLPHHHQGHGSDASISAFPLRSTSTASSH

SEQ ID NO: 16905 - protein, 418 aa, Schizosaccharomyces pombe
MAQACKTTYSSRLKTGNTCLIQKNVAVSTRSHSSYTGRNSLRNVPAVNYAAFEQGEDFETPVETPEKEEEKFETDDRGLAVGRPTGNNIYPRFATKTRHIYVTDEQLKCAAEERDVYIPIRLDIELPNNYRLKDTFLWNMNEQVMTPDVFAQILCADLDLSTNVYGTQISSSIRAQIEEYAPVAEVPMPKGQEMLVVFNIQVQLAQLSYNDQVEWNLTSPLTPEEFSVLTCNDLGLSGESRPEIAYAIHECLLKLKKNACEGDLPDYDSDAVPGTKAGPRQDMDTLGALWQPVLETVSLEDAKKNENNRENLVKQWRREASKFGGFAADVSAERWRAAALGNLSQSETANLPSASVSDAQTLLEQERPRWRCRWCNVLGTGTFCVRRGPEGNKSLCNACGVAYAKTGQLPYWRKSLYT

SEQ ID NO: 16906 - protein, 100 aa, Glycine max
KTKNDPLSLLPVSGAAPPHKSVLVGNLKLAELEEFLSSKGVQVEFAGGALRCGEYVTLRKVGDASQKGGGSGAQQIVIEGPLCEDYYKIRDYLYSQFYLL

SEQ ID NO: 16907 - protein, 482 aa, Escherichia coli O157:H7 EDL933
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 16908 - protein, 577 aa, Desulfitobacterium hafniense Y51
MRRTKIVCTIGPSSESNEKIRQLLKAGMNVARLNFSHGTHGEHGKRIRTLREEAQKLGVHLGVLLDTKGPEIRTGTVPEEGVQLNSGDTFILDTDLSTLGSAERVGITYLQLWQEVHQGTHILLDDGLIDLEVIASEEGKIITKIQNGGVLKSKKGVNVPGVPIQLPAITEKDRDDIIFGLREGIDFIAASFARKAADILAVRRLVEEEGANVKIIAKIENREGIEHLDEILEVADGLMVARGDLGVEVPVEEVPIHQKDMIEKCHHLGKPVIVATQMLDSMIRNPRPTRAEASDVANAILDGTDAIMLSGETAAGQYPVEAVEMMNKIALQIEKHYEPRKIYDPHINIAEAISHASYTVARDLEAAAILTPTHSGLTARMISKYRPTSLIIAATPFVHVARQLSLTWGIYPLLIPESLGTDQLLSVSVNEAISHHLIKTGDVVVITAGVPVGKVGTTNIIKVQVIGDVIAKGTGIGRKAYSGTARIATSAALELFQKGDILVAPYTDKELIPLIAKAGAILVEEGGLTSHGAIAALNYGIPAIVGAADVLMKVKDGQVLTVDALAGVVYEGTVSII

SEQ ID NO: 16909 - protein, 548 aa, Cryptococcus neoformans var. neoformans B-3501A
MWSKVVTTALLAIALGSVIEAASDPSALRGRGPAALAAKEAKKEAPANNASNSDASKMEKCRAFLERHPKRKFYNNRTSEFLIESLPEVPFDLGEVYSGLIPIDYNNQSEALFFVFQPKLGEDSDDLTIWLNGGPGCSSLEGWFQENGLWTWQPGTYAPVINPYSWVNLTNMLWVEQPIGTGFSIGTPKATTEEEIAQDFIKWFKNFQDTFGIKNFKIYVTGESYAGRYVPYIGAAMLDAQDKTYYNLSGALMYDPTIGESVFVQEQITTYPFVEANANLFNFNKTTMAELKDLHEFCGYKEYIERYLTFPPTENQPPLFFDYYDLDNITCAIFDIVNNMALRINPCFDIYEINLMCPLLWDVLGMPTQLSYAPGGIYFNRSDVKAAIHAPEHIDWTACATRAVFVGGVEQGPQGRGDLSLDPIQKVLPQVIEATNRVLISNGDYDMVIITNGTLLAIQNMTWNGYLGFQSPPSEDIFIDIVDTQWSSIFESNGFDGYPGPQGVMGIQHYERGLMWAETFQSGHMQPQYQPRSSYRHLQWLLRHVDRL

SEQ ID NO: 16910 - protein, 409 aa, Shewanella sp. MR-4
MAKHSLDKDKIKILLLEGVHQSAVDVFERAGYTNIEYHKASLGDEALLESIKDAHFVGIRSRTQLTADVLKRAEKLIAIGCFCIGTNQVDLATAELLGIPVFNAPFSNTRSVAELVLGEIIMLMRGIPERNAIAHRGGWMKTAAGSYEVRGKTLGVIGYGHIGTQLGILAETLGMRVVFFDIEDKLPLGNAQQIHSMEQLLAQSDVVSLHVPETAQTKDMISAAEFAAMRKGSIFINASRGTVVDIDALTVALKERHLAGAAIDVFPVEPQSNDDEFISPLRGLDNVLLTPHVGGSTAEAQENIGIEVAGKLAKYSDNGSTVSAVNFPEVSLPMHKGISRLLHIHQNRPGVLIKINKAFSEKGINIAAQYLQTTAEIGYVVMEVDTHQAEEALVELKAIEGTLRTRVLF

SEQ ID NO: 16911 - protein, 401 aa, Arabidopsis thaliana
  misc_feature (308)..(308): Xaa can be any naturally occurring amino acid
  unsure (1)..(401): unsure at all Xaa locations
MAMSGTFHLTSDYVPGYTLSDSRCFFNSAVSRRTLAILPCSSCLDHKNGRLKSVPNRSSFVCRASSGGYRRNPDFSRLNKHGYRGNNRQSGGREDFDIENSDMLSSRNGPLFNLSSSPKFQATSSPGPIEKEIVELFRKVQAQLRARAAAKKEEKKIEEASKGQGKESETVDSLLKLLRKHSGEQSKRQVSKFSSQGEVQGDTVDKQDRTGNLVTSGNKDNNASSFTRPTSSFRRKSPVPRSQLPPAYSSEATFDQSSSYSVTWTQKKDTVELHDEPEHEPAYDHEHEPENESEPGPVTTMLEPDSEXKPKSSSFYQEEEDDDVTFDVLSQDDGILDVLSDDDESLDDADEDSDEAEEEAVKDLSELKLVELRSIAKSRGLKGLSKMKKAELVELLGSDSS

SEQ ID NO: 16912 - protein, 362 aa, Triticum aestivum
  misc_feature (209)..(209): Xaa can be any naturally occurring amino acid
  misc_feature (215)..(215): Xaa can be any naturally occurring amino acid
  misc_feature (240)..(240): Xaa can be any naturally occurring amino acid
  misc_feature (273)..(273): Xaa can be any naturally occurring amino acid
  misc_feature (324)..(324): Xaa can be any naturally occurring amino acid
  misc_feature (337)..(337): Xaa can be any naturally occurring amino acid
  unsure (1)..(362): unsure at all Xaa locations
MAMAMRRAAALGARHILAASASASSRAASRRHMGSLDAGAAMEKIRAAGLLRTRGLIGGQWVDAYDGKTIEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKXGPPMAXGCTVVVKPSEFTPLTALAAADLALXAGIPAGALNVVMGNAPEIGDELMQSTQVRKIAXTGSTAVGKKLMAGSANTVKKVSLELGGNAPCIVFDDADIDVARKGSLAAQXRTGEQTFVCSTRXLVQKGILQKIRKVFWQSVVQNLKFG

SEQ ID NO: 16913 - protein, 335 aa, Gracilaria gracilis
MTVPQVGINGFGRIGRLVLRAAIEKDTMSVVAINDPFIDLEYMAYMFKFDSTHGRYAGSVETKDGKLIVNGKSITIYGHRDPAEIPWAEAGADYVVESTGVFTLKEKAEKHFTGGAKKVIISAPSKDAPMFVCGVNEDKYTPDLNVISNASCTTNCLAPLVKVIHEKYGIEEGLMTTVHATTATQKTVDGPSQKDWRGGRGAGANIIPSSTGAAKAVGKVLPELNGKLTGMAFRVPTSDVSVVDLTVRLATETSYDDIKATMKAAAEDSMKGILKYTEEAVVSTDFIHEEASCVFDAGAGIMLNSRFCKLVAWYDNEWGYSNRVVDLIAHVAKLQ

SEQ ID NO: 16914 - protein, 272 aa, Yersinia pseudotuberculosis IP 32953
MNNRVHQGHFARKRFGQNFLNDQFVIDSIVSAIHPVPGEAVVEIGPGLGALTEPVAARMDHMTVIELDRDLAARLASHPQLKDKLTIHQQDAMKVNFSELSEQAGQPLRVFGNLPYNISTPLMFHLFSYTDAIRDMHFMLQKEVVNRLVAGPNSKAYGRLTVMAQYYCNVIPVLEVPPTAFTPAPKVDSAVVRLIPHVQMPHPVGDVRMLSRITTQAFNQRRKTVRNSLGDLFTSEQLIELGIDPILRAENISVAQYCKLANWLSAQSTPQK

SEQ ID NO: 16915 - protein, 344 aa, Candidatus Kuenenia stuttgartiensis
MKAVVKANRASGLELVKMPEPKLGPKDVLIKVQVASICGTDVHIDDWTYWAQQRFTPPRIIGHEFAGYVQEVGKEVTFVKAGERVSAETHISCGYCYQCKNGYREVCRKSKLLGIDYDGTFAEYLSLPEHVLWKDDPRIPDEWATIQEPFGNAVDTVMSEDISSKTVLILGAGPIGLFAVGIARACGASLIIVSDPNDYRLDIGKKMGADIVANPKNTDILNCVLEATEGNGVDVVLEFSGNKLALDQGLKSLTPGGRISILGIYETPVDIDLNREVIFKKIRIYGITGRKIFSTWYKTSRFLSSGLVDPGPVITHTFLLEDYEKGMQLMRDGMCGKVVLQVMP

SEQ ID NO: 16916 - protein, 228 aa, Ralstonia solanacearum
MTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGRFVCIADGSKLVDVLGAFPLPVEVVPMARAAVARQLAALGGQPRLRMTKEGQIYQTDNGNVILDVSGLRIGEPKTLEAQINDIPGVVTVGLFAKRGADVLLLGTEAGVQRRDF

SEQ ID NO: 16917 - protein, 140 aa, Rickettsia prowazekii
MTIQYTFSMIKPDVIKRNKIGQVNTYLENAGLKIVAQKMKFLTKYEAECFYDEHRARSFFNSLVEYITSGAVVLQVLKGEDAITLNRTIMGATNPAEAKEGTIRKDLGESIEANSIHGSDSENSAKREIKFFFSKSEIIE

SEQ ID NO: 16918 - protein, 168 aa, Avena clauda
VMASSATSVAPFQGLKSTAGLPVSRRSASSLGSVSNGGRIRCMQVWPTEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 16919 - protein, 289 aa, Glycine max
  misc_feature (80)..(80): Xaa can be any naturally occurring amino acid
  unsure (1)..(289): unsure at all Xaa locations
DDRRPRASNPKPSYVSHHFLLHRPLGPLTPSTAGPLRRVDLDSGTNGWASPPGDLFLLRSPNYFTKRQKSPAGDYLLSPXPGMDWLKSQSKLDNVLSRPDNRMAQALRQAQAQGKSLKSFIFAVNLQVPGKEHHSAVFYFSTDEPITSGSLLSRFIEGDDAFRNQRFKLVNRIVKGPWIVKKAVGNYSACLLGKALTCNYHRGPNYFEIDVDIGSSAIANAILRLALGYVTSVTIDMGFVVEAQSEEELPERLIGAVRVCQMEMSAATVVDAPNAPRGNKVNHLSGNDE

SEQ ID NO: 16920 - protein, 168 aa, Avena clauda
VMASSATSVAPFQGLKSTAGLPVSRRSASSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 16921 - protein, 576 aa, Oryza sativa (indica cultivar-group)
MEEVRVRESKDHRGGGGGGDGDGERTGRWRAEEVIAGNRAVLEALRELVTYPVLYAREARVLGLNFPRGLLLHGPSGTGKKSMVRAVVRECNAHLTVIDSISVHKPHAGEGEKFMREAFTEAYSQASQGRPAVIFIDELDDICPPRGSRREQGSRIVGQLLTLMDGKSSKLLPHLVVVASATRVDAIESALRRPGRFDSKIKVTVPTAEERFEILKLYTKNLHLGECVDLQSVAASCNGYVGADLQALCREAARHAYGRLSSSSESENVLTLIMEDWESAKSVAKNSVTRGVTKEIPTVSWDDIGGLKAVKKKLQQAVEWPIKHAASFDRLGISPIRGVLLHGPPGCSKTTLAKAAAHAAQASFFSLSGAELYSKYVGEGEALLRRTFQMARLASPSIIFFDEADAIAPKRTGPSGNSSGNATVGERLLSTLLTEMDGLELATGIIVLAATNRPNAIDAALLRPGRFDMVLYVPPPDAEGRYEILRIHTRKMPLGDDVDLWKVAERTELFTGADLEGLCREVGMAALRESLRSERFVCDDIHFQAALRSLRPSLTQSVVDEYSNAAIHGLLTRRKH

SEQ ID NO: 16922 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 16923 - protein, 452 aa, Escherichia coli
RELYPKQFLRLFGQNSMLQETITRLSGLEIHEPMVICNEEHRFLVAEQLRQLNKLSNNIILEPVGRNTAPAIALAALQATRYGDDPLMLVLAADHIINNQSAFHDAIRVAEQYADEGHLVTFGIVPNAPETGYGYIQRGVALTDSAHAPYQVARFVEKPDRERAEVYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGHVTVNGKQFLLTENQSTFIPIGAEHSLENPGRIPLEVLEIQSGSYLGEDDIIRIKDQYGRC

SEQ ID NO: 16924 - protein, 327 aa, Idiomarina loihiensis L2TR
MKRLLPTLRADQTSESLISVINTIQIAAKEISFRLHQGALAGVLGSTLDENIQGETQKKLDVVANQLLKTLLLESPNVHAVASEEEDSIVESPNSGHYLVAFDPLDGSSNIDINGGVGTIFSILRKPEGEETSENMFLQPGKAQVAAGYVLYGPATMLVMTTGKAVRIYTLDQTVGEFLLTHEKAEIPKDTKEFAINMSNRRHWADPIRAYISDLLEGEEGPRGKNFNMRWNAAMVSDVHRVISRGGLFTYPWDARKPEKPFKLRLLYEAAPMAMLVEKAGGKATDGYSRLMEIVPEHIHQRVSVVMGSANEVDVCMDYHKQHPKPY

SEQ ID NO: 16925 - protein, 593 aa, Bradyrhizobium sp. BTAi1
MTREAYRPAVSLQIDRRLTIRRGSTACAIKRMQDLLAISVVLIAAAAIAAGLCARMRIPTLLGYILAGVIIGPSVGRLVQPGDALTFLSEIGVILLMFTVGLELSVAELWATRWRVLSAGGLQFALGSVAFGGVAYLLGASPSAAVMVGAAAAVSSTAICAKQLADQGELTTRHGRTSVAVLLFQDIATAPLLAALPLLASRTEAGTQIAIEVVRILAILGIIVLVGKPILYRSLAWVARHGHSEAFLLASILLVLITAWISHYLGIEPALGAFIAGLVLGESDFRHRIEDDIRPFRDLMVGLFFITTGVQLNLALVTQSPLSVIFWLFLLVPIKIVISAIALRLAKLGSLDAGRGAIILGHGGEFGLLLVSLGISADFLPATIGQPAMIAIAISMALAPLLIREHDRLVQHIFRAHRQPHHPQLEELEGFDQSKDLQQHVLVCGAGSLGRIVSRALLKAGISHLLFETRYEPFVQAKELGLPVILGDASRLATLEAAGVERARAVVVTFHQHRPAFRILRALRHRFPNLALIASARTEAAAEELQLIGNVNVFHEHIAAGLALARQCLQEVGLPRDRLEVLFSQMRRELHTE

SEQ ID NO: 16926 - protein, 466 aa, Escherichia coli O157:H7 EDL933
  misc_feature (345)..(345): Xaa can be any naturally occurring amino acid
  unsure (1)..(466): unsure at all Xaa locations
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAXFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 16927 - protein, 174 aa, Zea mays
  misc_feature (44)..(44): Xaa can be any naturally occurring amino acid
  misc_feature (70)..(70): Xaa can be any naturally occurring amino acid
  misc_feature (94)..(94): Xaa can be any naturally occurring amino acid
  misc_feature (102)..(102): Xaa can be any naturally occurring amino acid
  misc_feature (111)..(111): Xaa can be any naturally occurring amino acid
  misc_feature (122)..(122): Xaa can be any naturally occurring amino acid
  unsure (1)..(174): unsure at all Xaa locations
MSAYCGKYKDELIKNAAYIGTPGKGILAADESTGTIGKRLSSIXVEDVEENRRALRELLFCCPGALQYIXGVTLFEETVYQRTKMEGFFGDASXEGGALPGXIKVDRHPLXVGGPDKETTTXGHDDFGKRCAKYYKEGPAFAGGGLVSRIALRAITICPDWNARGRGRDGTPGG

SEQ ID NO: 16928 - protein, 478 aa, Escherichia coli O157:H7 EDL933
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPENDPLMLVLAADHVIADEDAFRAAVRNAMPYAEAGKLVTFGIVPDLPETGYGYIRRGEVSAGEQDTVAFEVAQFVEKPNLETAQAYVASGEYYWNSGMFLFRAGRYLEELKKYRPDILDACEKAMSAVDPDLDFIRVDEDAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 16929 - protein, 439 aa, Thermotoga maritima
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTADNAQTVKLVIKTMAIFHGYHATFMPKPFYGVNGSGMHVHMSLFRGDKNAFYDPDDPLGLSKELRYFVGGILKHAKALAAVTNPTINSYKRLVPGYEAPVYISWSVGNRSALIRIPKARGKATRLEYRSPDPSCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 16930 - protein, 264 aa, Shewanella sp. MR-4
MSKVTSSTLLKYKQEGRKFTALTAYDASFASAFDGEGIDVLLVGDSLGMVLQGHDDTLPVTTADIAYHTRCVRRGIERSLLIADMPFMSYATPEQAMENATALMQAGANMVKLEGGHWLLETVTKLTERGIPVCAHLGLTPQSVHVFGGFKVQGRDAENAQRILDEAKALEAAGAQLLVVECIPESLATAITQALTIPVIGIGAGATTDGQILVMHDVLGISSGYIPRFSKNYLKQTGEIRSAVRAYIEEVANGTFPSSEHTFS

SEQ ID NO: 16931 - protein, 426 aa, Rhizobium etli
MSFSSIDEAIEAIEAGEMVIVVDDENRENEGDLVVAAEKITAEHIAFMMKYARGLICVPLPAERLDKLEIPLMVTRNSDSLQTAFTVSVDCKHGTTTGISAEDRAATVKSLIDPQTRPEDLSRPGHIFPLRANRLGVLGRPGHTEAAVDLARLAGLAPAGVICEIANDDGTMSRLPDLEKFAIEHGLHIVTIDALIEYCRSRDTRVKRYAQSFMPTRFGDFKAIAYRDSLTGTEHLALTLGELCEKEDVLVRVHSECLTGEAFRSMRCDCGQQLEMALRAVQLAGAGCVIYMRGQEGRGIGLGNKIAAYSLQDHGRDTLEANRELGFASDSREYNAAADIIRDLGIGSVRLLTNNPTKIEALRTSGVIVSSRQSLIAASSASNITYFKTKRDRFGHLLDQDTSAEHVGRSNVFSVFGAQVFSGPLG

SEQ ID NO: 16932 - protein, 581 aa, Pseudomonas putida KT2440
MAAEGNAGLLLGVITLLSAAVVAVPLLKRIGFGSVLGYLLAGMMIGPFGLQLVNDPHTIIDVGELGVVMFLFVIGLELNPSHLWALRAQIFGLGSLQVLICAVLLTVVGKAFGFPWQVSFVCAAGFVLTSTAIVMQVLSERGDLTEPRGQRIVSILLFEDLLIVPLLAVVAFLAPTAAVPEPTSPLWQRMAIAAVSLSALVIIGLWLLNPLFRVLAQARAREVMTAAALLVVLGAALLMEIGGLSMAMGAFVAGVLLSESTFRHQLEVDIEPFRGLLLGLFFLGVGMALDLQVVARNWLLISSGVLALMVVKALCIYGVARLAKSQHGDALDRAVLMAQGGEFAFVLFTEALKLKVVSAEINANMTAIVVLSMALTPVNLLLLKRFARPRAVSMDGVEPAQNLQGHVLIIGFGRVGQIACQAPLAHGAKLSIIDMDPEVIRAVEPYGFKVYYGDGARHDLLHAAGARHARTIIVCVNDKKAATRIVESTRQYCPQVKVLVRAFDREHALELVKHDADYIVRETFESSLLLGRQAVLTLGASSVEADAVTDEVRTRCRTFCPGNIRRSICRASVGSGKYRAH

SEQ ID NO: 16933 - protein, 620 aa, Salmonella enterica subsp. enterica serovar Typhi
MDSHTLLQALIYLGSAALIVPIAVRLGLGSVLGYLIAGCIIGPWGLRLVTDAESILHFAEIGVVLMLFVIGLELDPQRLWKLRASVFGGGALQMVVCGGLIGLFCMFLGLRWQVAELIGMTLALSSTAIAMQAMNERNLTVSQVGRSAFAVLLFQDIAAIPLVAMIPLLAASGASTTLGAFALSALKVAGALALVVLLGRYVTRPALRFVARSGLREVFSAVALFLVFGFGLLLEEVGLSMAMGAFLAGVLLASSEYRHALESDIEPFKGLLLGLFFIGVGMSIDFGTLVENPLRILLLLAGFLAIKIVMLWLVARTLGVPAKQRRWFAVLLGQGSEFAFVVFGAAQMADVLEPEWAKALTLAVALSMAATPIFLVLLTRMEKTATGEAREADEIDEEQPRVIVAGFGRFGQIAGRLLLSSGVKMVVLDHDPDHIETLRKFGMKVFYGDATRMDLLESAGAAKAEVLINAIDDPQTNLQLSELVKTHFPHLQIIARARDVDHYIRLRQAGVAMPERETFEGALKSGRQALEALGLGRYEARERADLFCHFNTRMVEEMAKGENDPLSRAAAYKRTSAMLSEIITEDREHLSLIQRHGWQGTAEGKHSGKAADEPEVKPSI

SEQ ID NO: 16934 - protein, 507 aa, Zea mays
MTSNFTPNVWAWIASLPPFTQWRTSTMSLCICATPSASSSQPQPQPSINLSATKTTSIAQPPYVIFSVFASYSMPVSLWKSQPFHLKTKAQQSLDEQDIIHIFVNIVDSVLRYCPDKNSSFRFPGAQQPRGNFSDVFNIAFLSLAFLLCIFEVPRDLRPGCLGSLGAQLTGSRCRDAAKSLVRMLGANLEDQWMQTMNLAVTNWIVELRSSSRSSGPPSPLFSYAVSASGLWKVQLYCPVIAMGMEEAAETPQDERLLFSLIYQQVECVIQLAYRTTRRDNWIDVEVKVDNVRCDVDSLVSETLMAERGYGSEEKHFPSRVMLQITPTQQSDVLSVSVGKSNDNPTHEFGIEKGFEGSFEPPNAFGLKASVTESLTLAMKPWKFEQSVHGNTATLNWFLHDGVNGREVYSSKPSKISLLQPKAWFRDRYSNAYRPFTKQGGVIFARDEYGDSVWWKVCGAALGQTMNWQIRGWIWLTYWPNKQRTFHNETRWLEFRECLQLPLTKFP

SEQ ID NO: 16935 - protein, 492 aa, Campylobacter jejuni subsp. jejuni NCTC 11168
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLKKLLAKCKRVHIIGLYSDGGVHSMDTHFKAMLEICAKNGNEVFAHAITDGRDVSPKSGLNFIKDLKEFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNATIKAVEAVDTCLGEILECAKKHDYAFIITSDHGNCEAMQDEKGNLLTNHTTFDVFVFVQARGVSKIKDNMGLSNIAASVLKILDLEIPKEMNEALF

SEQ ID NO: 16936 - protein, 273 aa, Salmonella enterica subsp. enterica serovar Typhi
MNNRVHQGHLARKRFGQNFLNDRFVIDSIVSAINPQKGQAMVEIGPGLAALTEPVGERLDKLTVIELDRDLAARLQTHPFLGPKLTIYQQDAMTMNFGELSAQLGQPLRVFGNLPYNISTPLMFHLFSYTDAIADMHFMLQKEVVNRLVAGPNSKAYGRLSVMAQYYCQVIPVLEVPPSAFTPPPKVDSAVVRLVPHATMPYPVKDIRVLSRITTEAFNQRRKTIRNSLGNLFSVETLTEMGIDPAMRAENISVAQYCQMANYLSENAPLKES

SEQ ID NO: 16937 - protein, 670 aa, Oryza sativa (japonica cultivar-group)
MLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLCPNNRGAHIIYDGCVLTFSGRDFLGAATNPADMERKLRNTENVTVSDVGEFNGAIYEVLNATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSTAMSLNDVTVTEPEPR

SEQ ID NO: 16938 - protein, 462 aa, Erwinia carotovora subsp. atroseptica SCRI1043
MAEDVKQEKLHRGLEARHIELIALGGTIGVGLFMGAASALKWAGPSVLLAYIVAGIFVFFIMRSMGEMLYLEPVAGSFAVYAHKYMHPFFGYLTAWGYWFMWMAVGISEITAIGVYVQYWFPELPQWIPAIVAVALVAGANLAAVRLYGEIEFWFAMIKITTIVVMILVGVGIIFFGFGNHGQATGFSNLTEHGGFLAGGWKGLLFALCLVVASYQGVELVGITAGEAKNPQVTLKRAINNILWRILIFYVGAIFVIVTIFPWNEIGTSGSPFVLTFAKIGIVAAAGIINFVVLTAALSGCNSGMYSCGRMLYSLANNRQLPAWLGKVTASGVPAAGVMISILCLVAGSLLNYVIPNPEKVFVYVYSASVLPGMVPWFVVLISQLRFREQHRVALASHPFKSILFPWVNYLTMAFLLCVLVGMYINIDTRMSLLVGVAFLAVVSLCYFALGLGKKTSLAGGK

SEQ ID NO: 16939 - protein, 452 aa, Escherichia coli
RELYPKQFLRLFGQNSMLQETITRLSGLEIHEPMVICNEEHRFLVAEQLRQLNKLSNNIILEPVGRNTAPAIALAALQATRYGDDPLMLVLAADHIINNQPAFHDAIRVAEQYADEGHLVTFGIVPNAPETGYGYIQRGVALSNSAHSAYQVARFVEKPDRERAEAYLSSGEYYWNSGMFMFRAKKYLIELAKYRPDILETCQAAVNAADNGSDFINIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGAYLGEDDIIRIKDQYGRC

SEQ ID NO: 16940 - protein, 582 aa, Moorella thermoacetica ATCC 39073
MRHTKIVCTMGPASERVEVIKAMIRAGMNVARFNFSHGSHAEHGARMAAVRQAAAELGARVALMLDNKGPEIRLGEIQGEVTLKDGDQVTLTTEPIIGDARRLPVSFAGLPGDVRPGQIILLDDGLVELEVLATTATEIHCRVRHGDVISSHKGVNVPGAEISLPPFTEQDIKDLEFGLQQGIDFIALSFVRTAGDVLAVRRELEKRNARVAIIAKIENHAGVNNIHEILEVADGVMVARGDLGVEIPVEEVPLVQKKIIEACNLAGKPVITATQMLESMIHNPRPTRAEASDVANAIFDGTDAIMLSGETATGRYPVEAVATMARIARRAERGLPYGDLLTKKGLAAERTATDAISHASCTIAYELDAAAIITPTASGSTARRVAKYRPRAPILATSPNEKVLNQLCLVWGVEPLLVEPTSGTDEMVNAAVAAAILSGRVKQGDLVVITAGVPAGVPGTTNLLKVHIVGEVLVRGRGIGKEVTSGPVRLVKTAADAVARVKKGDILVTTETGPEFLPAMERAAAVITETGGLSSHAAVTGLSLGIPVVVGAKGATEKLTDDLVVTIDVVRGLVYRGQTRVL

SEQ ID NO: 16941 - protein, 423 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKLLGREGYCKVEDTPKGWFMTYIDRDSEQAVKDRLKRKRIKSDMAEDERQERMIARQIERAHKSLAKPNDGDAAEGEPESGGEEEYSGSDDDGEELEDVSKEANKATGKIAIALQTAVRGPKVNPFEDKPEVKFRFDEEGDLGTGEEKDELAKKKGKDVKAAEARRSALEELMKEEEMAKERSNRKDYWLCPGIVVKVMSKSLAEKGYYKQKGVVRKVMDKYVGEIEMLESKHVLRVDQDELETVIPQIGGLLRILNGAYRGSNARLLSVDTEKFCAKVQVEKGLYDGKVLRAVEYEDICKISS

SEQ ID NO: 16942 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 16943 - protein, 487 aa, Arabidopsis thaliana
MVKQQDWSATTCVLLFLFLASQIHCRSGIHVSKRLEGSKQGDGKSGDTSFNVLRRVLSPKEKDLIKKLPGQPSGVSFRQYGGYVPVNEPSSRFLYYYFVEAIKPNTSTPLVIWFNGGPACSSLGGAFLELGPFRVHSGGRKLFRNPYSWNNEANVLFLESPVTTGFSYSSNPIDLEELGEKGDKATAEDNYIFLMNWLERFPEYKGRDIYIAGQSYAGHYVPQLAQIIIHRNKKTLVNLRGILIGNPSLLTSIQDPYGYEFMLSHGLMSQQQMDNYNQFCLRDDLYDNDKCALSVKTIDDAKKHLDTYNIYAPVCLNSTLSRISKKCTTVLEVDPCSKDYLKAYLNRKKVQKAIHANTTKLPYEWTSCNNELTENWSENDRDTPMIPILHELMGEGVRVMIYNGDVDLEIPFASTLAVVKEMNLTVVKEFRPWFTGGQLGGFTEDYKGNLTFVTVKGAGHSVPTDQPIHALNIFTSFIRNTPLPHTA

SEQ ID NO: 16944 - protein, 206 aa, Zea mays
TACSETVKFGHVIFFWNGNRSGYFDQNLEKYEEIPSDAGIPFNVQPKMKALEIAQKARDAILSQKFDQVRVNIANGDMVGHTGDMEATIVGCKAADEAVKIILDAVEQVGGCFVVTADHGNAEDMAKRDESGEPLRDKDGKVQTLTSHTLNPVPIALGGPGLAPGVRFRTDLASAGLANVAATVMNLHGFEAPDHYEPTLIQVVDE

SEQ ID NO: 16945 - protein, 334 aa, Haemophilus influenzae R2866
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIQPTELHQRVPLFVGSEDMVKKAQEMMEEFKEE

SEQ ID NO: 16946 - protein, 493 aa, Photorhabdus luminescens subsp. laumondii TTO1
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 16947 - protein, 327 aa, Leuconostoc mesenteroides subsp. mesenteroides ATCC 8293
MSTADKLLALLVNTAGDWVSGEAIAQQLGITRTSIWKSVKKLESQGHLIESVRGQGYRYVEGAKISAVGIKKYLKSDVDLKVFDTIDSTNVYAREKLSSGEITKNTVIVSESMSAGIGRLGRKFFSPKNTGMYVTFALPLPVETIVNPGRLTTSTAVAVSKMVKEVFDIDIQFKWVNDLLYNNKKVGGILTEAITDFESQQFSSLAVGIGMNLATPDGGFPDEISQKAGALTDEMAVSGNEVVGSLINHFFDMYQDYQDGHYIPQYRKKVVGVGQSVELKRGQVNLTGIIREIDNDGCLVLDTKRGIERINSGEITKLLLPNNEYQG

SEQ ID NO: 16948 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAGATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 16949 - protein, 484 aa, Bordetella parapertussis
MENLGYPARLELYVAGQWRGVEGRRTQVVVNPSTQQPLGELPLASAEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAALAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVLRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 16950 - protein, 1207 aa, Lycopersicon peruvianum
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKGATFSLQVLDLSYNNISGFNLFPWVSSMGFVELEFFSIKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISNNNFSGKLPVDTLLKLSNIKTMVLSFNKFVGGLPDSFSNLPKLETLDMSSNNLTGIIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKTGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 16951 - protein, 332 aa, Candida glabrata CBS 138
MVRVAINGFGRIGRIVLRIAMKRDGIDVVAINDPFITNDYAAYMFKYDSTHGRYDGEVTHDDKDLIIDGKAIKCYQERDPADLPWGDNDIDIVIEATGVFTAKDLAEKHITAGAKKVVITGPSATAPMFVKGVNDDKYTSDVTVISNASCTTNCLAPLAKVLQDNFGIEEALMSTVHSQTATQKTVDGPSKKDWRGGRTASANIIPSSTGAAKAVTKVLPELEGKLTGMAFRVPTVDVSVVDLTVRFAKDVTYDEIKAAIKKASEGEMKGILAYTEDAVVSTDFLGDTHSSIFDASAGIQLSPRFVKLVSWYDNEYGFSARVVDMVELVSKA

SEQ ID NO: 16952 - protein, 361 aa, Aspergillus oryzae
MSESIRQVIELNPSLVLKAVQQLEFEDRPVPDLLEPYDVSVRIEYTGICGNDVHYWQRGRIGQFILEKPMVLGHESAGVVEKVGSKVKSLAVGDHVALEPGVPCRRCTFCKAGNYNLCSEMAFAATPPFDGTLAKYYVLPEDFCYKLPTNVSLQEGAVVEPLSVAVHLVRQAALQPGQSVVVFGAGPVGLLCCAVARAFGASKVIVVDVQPKRLEFARAYAATAHFLPGVETSPADNAVRLREENELEMGADVVIEASGAEPSVYTGIHILRPGGTYVQGGMGKEEVKFPITAACTKELNIRGSFRYSSGDYKLAIELIAAGKINVKALITQVFKFEDAPRAFEEVKSGKGIKTLIAGPGV

SEQ ID NO: 16953 - protein, 482 aa, Salmonella typhimurium LT2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 16954 - protein, 452 aa, Klebsiella pneumoniae
RELYPKQFLRLYGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 16955 - protein, 334 aa, Xanthomonas oryzae pv. oryzae KACC10331
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVITIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGTLPWPLSFSYGRAMQQAALKLWAKDMTVNFAKAQQVIYERAKENGLAALGKWKG

SEQ ID NO: 16956 - protein, 487 aa, Pseudomonas aeruginosa PAO1
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 16957 - protein, 487 aa, Desulfitobacterium hafniense DCB-2
MRALEPLIFELSREGRTGVSLPSCDVPEIPLEDLIPQEFLRDKEPELPEVSEVDVVRHFTRLSSFNHGVDTGFYPLGSCTMKYNPKVNEKLARLPGFSQIHPYQPEELTQGALGLMVELQEELAEITGMDAFTLQPAAGAHGEMTGILIIKAYHDHRQDVKRRKVIVPDSAHGTNPATGAMAGYDIVQVPSNERGGVDIEALRQVANDEVAALMLTNPNTLGLFDENILEIAEIIHSVGGLIYYDGANANAIMGIARPGDMGFDVVHLNLHKTFSTPHGGGGPGSGPVGVKEFLAPYLPKPVAIRTPEGRYSWDEDRPLSIGRVRAFQANFGVLVKAYAYIRALGGEGLKAASQNAVLNANFLMSILKEHYHLPYDRVCMHEFIITPKNLKNYGIHTLDIAKRLLDYGYHPPTIYFPLIVEEAMMIEPTETESLETLEQFARVMIQIAEEVKQDAEMVKNAPHDTLVTRLDETGAARKPDLRWRKPQ

SEQ ID NO: 16958 - protein, 446 aa, Desulfitobacterium hafniense DCB-2
MNYVPNTVDQQEQILTRIGVGSLEELFADIPESVRRQAQLKIREGLSELELVKYMGRLAAENKTVEEYTSYLGAGAYEHFIPSYVDQLLLRSEFYTAYTPYQPEISQGTLQAIYEFQTLVCELTGMDGANASMYDGASALAEAALMSCDATRRKKVLVPQTIHPEYREVLRTYLLPRGVEILEIPYQEGAVDSEALEKALNTEVAAVLIQSPNFFGMIEKAVEIGQMAHAKGGLLVMAVNPVSLGLLKSPGELGADIVVGEGQPFGNPLNFGGPYLGFLACREKYVRRMPGRIVGATKDKNGKKGYVLTLQAREQHIRREKAASNICSNEALCALAFTIHLSGLGKRGLKEMARLNLQKAHYGAEEIGKLPGMSLAFQGPFFHEFVIKTEVSPRKINEALLSHKIIGGLELSRFYPELDQHLLFCVTETKTKEDIDRLVAGMGEIK

SEQ ID NO: 16959 - protein, 222 aa, Petunia x hybrida
MFRLQLISAFFILLFSLSPVSANFDYFQLVLTWPASFCYPKNKCQRRSNNFTIHGLWPEKKRFRLEFCTGDKYKRFLEEDNIINVLERHWIQMRFDETYANTKQPLWEHEYNRHGICCKNLYDQKAYFLLAMRLKDKLDLLTTLRTHGITPGTKHTFGEIQKAIKTVTSNNDPDLKCVENIKGVMELNEIGICYTPAADRFDRCRHSNTCDETSSTKILFRG

SEQ ID NO: 16960 - protein, 337 aa, Craterostigma plantagineum
MAKVKIGINGFGRIGRLVARVALVRDDVELVAVNDPFITVDYMAYMFKYDTVHGQYKHHELKVKDEKTLLFGDKPVAVFGLRNPEEIPWAETGAEYVVESTGVFTEKEKAAAHLKGGAKKVIISAPSKDAPMFVVGVNEKTYTPDIDVVSNASCTTNCLAPLAKVIHDRFGIVEGLMTTVHSITATQKTVDGPSSKDWRGGRAASFNIIPSSTGAAKAVGKVLPDLNGKLTGMAFRVPTVDVSVVDLTVTLAKEASYDEIKAAIKEESEGKLKGILGYTEEDVVSSDFVGDSRSSIFDAKAGIALSKKFVKIVAWYDNEWGYSSRVVDLIRHMAAAK

SEQ ID NO: 16961 - protein, 232 aa, Alkalilimnicola ehrlichei MLHE-1
MKKLVLLRHGQSIWNQENRFTGWHDVDLTEKGREEAQAAGQLMKRHGLRFDYAYTSVLKRAIRTLWIGLDELDQMWIPVTKAWQLNERHYGALTGLNKAETAEEYGAEQVHIWRRSYDTPPPPLDETSPYHPRHDPRYASLKPEQLPATESLALTLERVLPYWNERIVPTLRDCDNVLIAAHGNSIRALIKHLDGLDDEAIMKVEIATGDPLVYELDDALAVVDKHYLRERD

SEQ ID NO: 16962 - protein, 239 aa, Alkalilimnicola ehrlichei MLHE-1
MAAEKIALVTGGSRGIGVEVARQLARKDYRVVITSRDGLAGKAAADKLRSENLEVFHQPLELTRQESVRRLAGYLQEQFGRLDALVNNAGQFIDPDPDDPRQASVLEAPLSQLQASLDVNLLGTVRVCQAVVPLMRGHAGCIVNVSSGYGQLQGMKAAFPGYRISKTALNALTRLLAAELEADGIRVNSVDPGWTRTRMGGSQAPRSPAEAANGIVWAATLPADGPSGGFFRDGTAIPW

SEQ ID NO: 16963 - protein, 334 aa, Desulfitobacterium hafniense Y51
MTIRIGINGFGRIGRNVFRAAYGRENIEIVAVNNRSTGEILPHLLKYDSVHGIFPAQIQHTEDGFTVDGQLVKVVSHTDPGDIPWGELGVDIVIESSGKFNNGPACQKHLNNGARKVVISAPAKEEDITLVMGVNEEIYDPQKHHIISNASCTTNCLAPVAKVIHENFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 16964 - protein, 386 aa, Guillardia theta
MAYFKAVAYLAALASAAAFNPGSSFVPRLNAPATQPKAAKMTGPTMQAVPCGINGFGRIGRLVARIMIKDPETKLLQVNAGSATPDYMAYQFKYDSIHGRYQGDVVVDGDDLVIDGQRVITTRARDPKDIGWAKTGVEYLCESTGVFLTAEKAQPHIDAGVKKVIFSAPAKDDSLTVVMGVNAEDYKGQTDFISCASCTTNGLAPLVKCINDKWGIEEGLMTTIHAMTATQAVVDSSSRKDWRGGRAASGNIIPSSTGAAKAVAKVIPAVKGKLTGMAFRVPTIDVSVVDLTCRLAKDATYEEICAEVKRRANGDMKGFLGYTDEPLVSTDFETEPISSTFDAEAGISLNPRFVKLVAWYDNEWGYSNRVKDLMVHVAKVDAKVKA

SEQ ID NO: 16965 - protein, 355 aa, Salinibacter ruber DSM 13855
MNALVYDDFDAPLTLRTVSRPTPTPRGVVLQVLACGVCRSDWHGWKGHDPMITPPNVPGHEVVGIVTAVGDRVEEWSGGERVTVPFVGGCGTCAQCRAGQHQVCPHQFQPGFSAPGAFAEYVGIDYADENLVRLPGSIDAVTGASLGCRFATAFRAVVDQGAVRSGEWVAVHGCGGVGLSAVMIAQAAGARVVAVDVADPALALADEVGASRTINADDTENVAAAVREATRGGAHLSLDALGSPDTCRNSVANLRTHGRHVQVGLLMGEHARTAIPFDRVVADELEVRGAHGLQAHRYPALFNMIETGRLHPRQLVRQTISLPEAADRLRQMGDFAGTGIAVIDDFGGGRTQAEV

SEQ ID NO: 16966 - protein, 388 aa, Pyrenomonas salina
MYKTVLVGVLSVAAGANAFQMGSSFVPRMGGQAETARRATMTGPVMAEDPVKCGINGFGRIGRLVARIMIKDPETNLIHVNAGSATPDYMAYQFKYDSIHGRFDGAVVVDGEDLVIDGQRVITTRQRDPKDIGWDKTGVEYLCESTGVFLTSEKAQAHIDGGCKKVIFSAPAKDDSLTVVMGVNPDDYKGQTDFVSCASCTTNGLAPLVKCINDKFGIEEGLMTTIHAMTATQAVVDSSSRKDWRGGRAASGNIIPSSTGAAKAVAKVIPDVKGKLTGMAFRVPTIDVSVVDLTCKLKKETTYEEICNEVKKRAAGDMKGVLGYCDEPLVSTDFESESISSTFDAEAGIMLNPSFVKLVAWYDNEWGYSTRVKDLMVHMAKVDAKVSA

SEQ ID NO: 16967 - protein, 441 aa, Thermotoga maritima
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIGKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 16968 - protein, 427 aa, Salmonella typhimurium LT2
MNTNNALMQRRHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACAAALAVLDIFEQENLLQKANTLGKTLRDGLMEIAETHREIGDVRGLGAMIAIELFENGDPGKPNAALTADIVTRAREKGLILLSCGPYYNILRILVPLTIEASQIRQGLEIIAQCFDEAKQA

SEQ ID NO: 16969 - protein, 466 aa, Salmonella typhimurium LT2
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 16970 - protein, 390 aa, Lactobacillus sakei
MQTNWWQNAVFYQVYPRSFQDSNGDGIGDIQGIIQRLDYLADLGVNAIWLSPVYQSPNVDNGYDISDYQAINPEYGSMVDMEQLIEAAKIRKIKIVMDLVVNHTSDQHPWFLEARKSKDNPYRDFYIWRDPATDGSVPNDLQSNFKGSAWAFDAVTGQYYLHFYAKEQPDLNWQNPKVREAVYQMMTWWLQKGIGGFRMDVIDLIGKEPDRKIKENGPQLHAYLQEMNARVLSQYDVVTVGETWGATPEIGQMYSNPNRHELSMIFQFEQINLDKQSGMTRWDLKPLIPAELHAVFSKWQLALDGVGWNSLFWSNHDLPRIVSRWGDDSQYREKSAQALAIYLHMLKGTPYIYQGEEIGMTNYPITSYHEIEDIESRRVYQQRQQQGYAI

SEQ ID NO: 16971 - protein, 436 aa, Gloeobacter violaceus PCC 7421
MTVPLSELAREKGIRYFLISFTDLFGTQRAKLVPTQAIDAIAASGAGFAGFAAWMDMSPADPDMFAHPDAGSVFQLPWQPEVAWMPADLFTPEGTAIAQTPRLVLKRVLKLALELGYRVRTGVECEYFLLAADEVQIADSRDFQSKPCYDQQALMRRYAVISEICDAMNALGWGAYQNDHEDANGQFEMNWTYADALVTADRHAFFKYMVKTVAEKHSLRATFMPKPFMHLTGNGCHTHLSVWDSEGKVNRFDDPRGELGLSPLAYHFIGGVQHSAEALCAFANPTVNSYKRINAPITASGATWSPNTISYSGNNRTHAIRIPEPGRFELRLADGAANPYLLPAALTAVGLDGIAHQRDAGPRRDNNSYTNPLPPESAKPLPANLLDALRALESDTVLSEAMGADFVASYLKLKHREWQDYCARVTPWELEHTLDC

SEQ ID NO: 16972 - protein, 222 aa, Oenococcus oeni PSU-1
MSKLVLIRHGESTANHDNIFTGWTDVPLTEKGISQAHVAGKQLSHSGIDFDIVYTSMLQRAIVTSYIILNEINQAWLPIVKSWRLNERHYGALRGLNKAETAQKYGDTQVREWRRSYTTVPPLLGHEESSERYLKLGIKEPLGESAEMSWKRVQPFWEDQIAKQLRSEKNVLLVAHGSSIRVLLKFLDRISDDNFMKVEVGNGEPIIYNFDQQLKVISKSNL

SEQ ID NO: 16973 - protein, 408 aa, Zea mays
MPSRIAACFRCAAAPSSGAGAGAAGPSLATSIYETHLGLVALSWSRTSLGLSLRAVLRLSATPPPGSSSSASGAGYLDDDADEEILAFRVSPWLFWRRRGSRRFRAGDRLVDLAWDLSRARFPVSGSPEPSSGFFVAVVVCGEMVLAAGDLTDLAYRRTRARRPSGPRPVLLSRREHVSLRDAGAGRGRSHTTWVNVQGKEREISVDLVARGRGRDKATAGKGKEKDRADVGMSVSVDGERVLHVRRLRWKFRGSERVDLGGGDGVQVSWDLHNWLFPPREPPPTEASTHAHAVFVFRFELASGGEESEADLGKNPSPSKAARRNTGVWGGYLARWGQRDWSETGSNGERRKGRGRRLAKESSSSSASVASSTASWASGSTVMDWASPEEVEMQRGDGFSLLIYAWKS

SEQ ID NO: 16974 - protein, 471 aa, Ralstonia solanacearum
MSQSIADVMKLVKENDVKFVDFRFTDTKGKEQHVSVPVSHFGEDKFESGHAFDGSSIAGWKGIEASDMLLMPDANTAHIDPFYEEPTLVMTCDVIEPSDGKGYDRDPRSIAKRAEAYLKSTGLGDTAYFGPEPEFFIFDGVTWNVDMQGSFVKIHSEEAPWSSGKEFEHGNSGHRPGKKGGYFPVAPIDTFQDIRSEMCLILESLGIPVEVHHHEVAGQGQNEIGTKFSTLVQRADWTQLQKYVIQNVAHTYGKTATFMPKPVVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLCNPYLGFAALLMAGLDGVQNKIHPGEAADKNLYDLPPEEDAKIPTVCSSLDQALEYLDKDREFLTRGGVFTNSMIDAYIELKMEEVTRFRMTTHPVEFEMYYSL

SEQ ID NO: 16975 - protein, 359 aa, Arabidopsis thaliana
  misc_feature (262)..(262): Xaa can be any naturally occurring amino acid
  misc_feature (318)..(318): Xaa can be any naturally occurring amino acid
  unsure (1)..(359): unsure at all Xaa locations
SVRLAQVTMQGGSSGIGYGLKYQSRCISDVKADTDYTSFLTGTLSLKEENEVHLLRLSSGGSELICEGLFSHPNEIWDLASCPFDQRIFSTVFSTGESFGAAIWQIPELYGQLNSPQLERVASLDAHVGKINCVLWWPSGRCDKLISIDEQNIFLWSLDCSKKSAEVLSKDSAGMLHSLSGGAWDPHDVNAVAATGESSVQFWDLRTMKKVNSIEHAHVRGVDYNPKREHILVTAEDEFGIHFWDLRKAKVPVQELPVNTHXTWAVRCNPEYDELILSAGTNSVVNLWYASATSSDDKTSESPVESTQQRVNPLLNSXTNYENSVYGLAWGSREPWVFASLSYDGRVIIESVKPFLPRI

SEQ ID NO: 16976 - protein, 377 aa, Xylella fastidiosa 9a5c
MNSFAAVPVLIEEIRAGRMVVIVDDEDRENEGDLIMAAELVAPKDINFMVTHARGLVCLSLTRERCAQIGLSPMVQRNTTRFQTNFTVSIEAAEGLTTGISAYDRAHTIRTAVRPNAKPSDLHQPGHIFPLIAQPGGVLTRAGHTEAANDLPMLAGLEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGVAASDALRMIAAAERGVMVVLAAPRDSDALLARLRREPEVVSNVKDVGQWRRNGAGGQILADLGLGKLRVLGTPRRQIALAGFGLEVLEYVECRGGAPVAPQGVD

SEQ ID NO: 16977 - protein, 93 aa, Erwinia carotovora subsp. atroseptica SCRI1043
MANTAAALHILVDTEQLANDILAQLEKGADFQKLAQKHSTCPSKRNGGDLGEFRKGDMVPAFDKAVFSCELLKPFGPVKTQFGYHVIKVLYRN

SEQ ID NO: 16978 - protein, 157 aa, Glycine max
  misc_feature (8)..(8): Xaa can be any naturally occurring amino acid
  misc_feature (77)..(77): Xaa can be any naturally occurring amino acid
  misc_feature (138)..(138): Xaa can be any naturally occurring amino acid
  misc_feature (141)..(142): Xaa can be any naturally occurring amino acid
  unsure (1)..(157): unsure at all Xaa locations
IGPNEPSXLSIHENAYGLAKYTVIYQENGLVPIVNPKILINRPHNIHKYTTVTNHILTACYKALNDHHVLLEGTLLXPNIVTPGSQSTKVSPQVVAEHTIKTLQRTIPTAGATIVVLSGDQSKEEACSDLNTIKPIEXKEXXALSVCFRKTLQQSTL

SEQ ID NO: 16979 - protein, 752 aa, Streptococcus pneumoniae R6
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIELDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAAVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGEENIYIFGEDSETVIDLYAKAAYKSSEFYAREAIKPLVDFIVSDAVLAAGNKERLERLYNELINKDWFMTLLDLEDYIKVKEQMLADYEDRDAWLDKVIVNISKAGFFSSDRTIAQYNEDIWHLN

SEQ ID NO: 16980 - protein, 241 aa, Triticum aestivum
  misc_feature (133)..(133): Xaa can be any naturally occurring amino acid
  unsure (1)..(241): unsure at all Xaa locations
NKFVQKSRLVPVRNSRDIVDPRVRVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQXKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 16981 - protein, 459 aa, Burkholderia vietnamiensis G4
MTQQQRSFDNIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGSVEYAFSLLKIAAIIVFIVLGAYLVWSAPPASGIGFANYTGHGGFMPKGPWGTWVAVIVAIFSYMSIEAVAIAAGEARDPQHAVTRAFRSTVFRLVLFYLLTLALMLAIVPWTQAGTDESPFVKVMAATHVPYAAGVINFVLLIAALSAMNSQLYVTTRMMFSLSRARLAPAVFGRVGDNGVPRAALWISTSGVAVAAVLVALSPGTAFTVMMAIAMFGALFTWLMIFVTHLRFRARYSGPALAFRMWAHPFGSLLGAALVGAILLTTAFTHEFRMTMVVGVVFVVLLTLAYALHYRHQHAR

SEQ ID NO: 16982 - protein, 368 aa, marine gamma proteobacterium HTCC2207
MKTRAAVAFGAGKPLDIVEVDLDGPRAGEVLVEVKATGVCHTDAFTLSGDDPEGAFPAILGHEGAGVVVEVGPEVKNLKPGDHVIPLYTAECRECEYCLNPKTNLCQAVRSTQGQGLMPDGTSRFSFEGKPILHYMGCSTFSNYTVLPEISLAKVREDAPFDKICYIGCGVTTGIGAVAFTMKVEAGSTVAVFGLGGIGLNVIQGAKMVGATRIIGIDLNPARAALGKQFGMTDFINPKDVENVVDHIIQMTGGGVDYSFECIGNVDVMRQALECCHKGWGESCIVGVAGAGKQITTRPFQLVTGRSWRGTAFGGARGRTDVPRIVDWYMEGKINIDDLITHKMPLDDINKAFDLMHAGESIRSVVEF

SEQ ID NO: 16983 - protein, 330 aa, marine gamma proteobacterium HTCC2207
MSDAIQVPGVKVSSKSMPAVGLGLWKITQDSAAQAVYEAIKVGYRHLDSAADYGNEQQVGEGIARAIAEGLCSREELWITTKLWNTYHRAEHVEAACRRSMDDLGLDYIDLYLVHFPIALRYVDFNDRYPAEWIFDHSAEDPAMELDQVPLSETWGAMEQLVESGLVRQIGVCNYSAVLLHDLMSYARIKPAMLQIESHPYLTQEALLRTARSYNMAVTAFSPLGSLSYVELNMAGANDTVLTDPSVLAAAQRNGVTAAQVVLRWGIQRGTAVIPKTSNPQRLIENLTLTEFTLNDEEMDAISALNQNHRFNDPAQFCEAAFNTFHSIYD

SEQ ID NO: 16984 - protein, 353 aa, Bacillus subtilis subsp. subtilis str. 168
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 16985 - protein, 339 aa, Bacillus subtilis subsp. subtilis str. 168
MKAVQVRKAYDLVTAEVKKPVLSKDDEVLVKVKRVGICGSDMHIYHGTNPLATLPRVIGHEVTGQVEAVGANVQSLKPGDHVVIEPISYCGSCYACRKGRPNVCAKLSVFGVHEDGGMREYIVLPERQLHAVSKDLPWEEAVMAEPYTIGAQAVWRGQVEKGDTVLIQGAGPIGICVLKMAKLAGAAVMMTDLNNERLAFAKENGADAVVNVQAEHVAERVLEWTGNEGANVVIDAVCLPETFALSIEAVSPAGHVVVLGFDERAAQISQLPITKKEVTITGSRLQTNQFPKVVELLNGGRLMHNGLVTHTFSVDDVHHAFQFIKEHPDQVRKAVITFD

SEQ ID NO: 16986 - protein, 277 aa, Kluyveromyces lactis NRRL Y-1140
MSIVSLLGIKVLNNPAKFTDPYEFEITFECLEPLKHDLEWKLTYVGSSRSLDHDQELDSILVGPIPVGINKFKFVADAPSPDLIPASELVSVTVILLSCSYNGKEFVRVGYYVNNEYDLEELRENPPQKVPIDHVVRNILAEKPRVTRFNIVWDNEGEEEFYPPEQEEPEEEEEEEEDEDEDEEADEDAEEDLAEEDDVDDGEGEETAPEKKKLKRDPKKSTASDVKNDEGESQAESLGPEEDEEDEEEAEEIDLEKESDSENDADLPTPQDTTQHK

SEQ ID NO: 16987 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 16988 - protein, 86 aa, Zea mays
  misc_feature (46)..(46): Xaa can be any naturally occurring amino acid
  unsure (1)..(86): unsure at all Xaa locations
MSAYCGKYKDELIKNAAYIGTPGKGILAADESTGTIGKRLSSINVXNVGENRRALRELLFCCPGALRYINGVILLEETLHHKTKVG

SEQ ID NO: 16989 - protein, 444 aa, Bacillus cereus ATCC 10987
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQANEVISNALGDHLLEHFIEAKEIEWDIFRTQVHQWERDQYMSLY

SEQ ID NO: 16990 - protein, 292 aa, Oenococcus oeni PSU-1
MNDIPAIGSPIRTRTILNEYDLHASKRLGQNFLIDLNVLQEIVQGAAIGPDDTVIEIGPGIGSLTEQLAKAAKQVVAYEIDKKLIPILSETLRPYKNVEIVNRDILKADFSIFAKNQSLKIVANLPYYITTPILFYLLNSSLNFKSVTVMMQKEVAARLQAGVGSKDYGELSLAIQYRVNVEIILPVTRKSFMPSPNVDSAIVQLTPKENFQSFPHEEALFKIIKASFAHRRKSLVNNLLYYFGKNDENRTKIERSISETGFDLNIRGERLTLENYEQLVNNLSENMIFSKE

SEQ ID NO: 16991 - protein, 432 aa, Bacillus cereus ATCC 14579
MNFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 16992 - protein, 175 aa, Triticum aestivum
MAPTVMASSATSVAPFQGLKSTAGLPVSRRSNGASLGSVSNGGRIRCMQLWPIEGIKKCDTLSYLPPLSTEALLKQVDYLIRSKWVPCLEFSKVGFIFREHNASPGYYDGRYWTMWKLPMFGCTDATQVINDVDEVKKEYPDAYVRIIGFDNMRHVQCVRFIAFKPPGCDESGKA

SEQ ID NO: 16993 - protein, 412 aa, Rickettsia prowazekii
MNNIKNLLIRAQIMSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 16994 - protein, 484 aa, Oenococcus oeni PSU-1
MALKQYQMYINGEWVDSDNGEKITVYNPSNEEAISQVPSASLKQVKEAIDDAYAAQKDWKRVPAATRGSYLVRIAALIRKNADYLARTLSEEEGKILSLAMTEVTFSADYIDYMAAQGRTYEGEVIQSDNANENIALLKQPIGVAAGILPWNFPFFLITRKFAPALVTGNTIVIKPSSDTPNIALEFAKLANQVGLPKGVLNFVTGPGSVVGSELSKNEKIGIISLTGSVDSRKRVMADASNHVAKVSLELGGKAPAIVCKDADIDLAVDSIINSRIDNNGELCNNCERVYVQEDIAEEFTKKLVAKMAATTIGDPIEHENIGMGPLINKAAVEKVDAMVQRAVKAGAKVECGGKRPEGKGYFYPATVVTNVKQSDELVQEEIFGPVLPILTFKKLDQAIDMANDSKLGLTSSIFTENMDAAATAANELEDGETYINRFNFEAMQGFHAGWKESGLGGADGKHGLEEYVNTHVVYLQRHPEKAD

SEQ ID NO: 16995 - protein, 480 aa, Pseudomonas fluorescens Pf-5
MSDNNKRDDDMQSQDSGLRRGLTARHIRFMALGSAIGTGLFYGSASAIQMAGPAVLLAYLIGGAAVFMVMRALGEMAVHNPVSGSFGHYASQYLGPLPGFILGWTYAFEMLIVCLADVTAFGIYMGFWFPEVARWIWVLGIVLFIGGLNLCNVKVFGEMEFWLSLLKVGAIVAMILGGLGIMLFGISSAAQDQATGAANLWAHGGFMPNGISGVIASFAVVMFAFGGIEIIGVTAGEAQDPKRVIPKAINAVPLRILLFYVLTLFVLMSIFPWPQIGTQGSPFVQIFDSLGISSAATILNIVVISAAVSAINSDIFGAGRMMYGLARQGQAPKGFAQVSKHGVPWMTVVVMAVTLLIGVVLNYLIPENIFLLIASLATFATVWVWLMILLTHVAMRRSMTAEQVAQLQFKVPFWPWAPAAAIAFMLFIFGVLGYFPKTQGALIVGVVWIALLVVAYMLWVKPMAGQAQAIMSDAPLPTDH

SEQ ID NO: 16996 - protein, 345 aa, Bacillus cereus G9241
MKAVVVNKNSKANIEVIEKELRPLHSGEALVDVEYCGVCHTDLHVANHDFGNTDGRILGHEGIGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSNIKPGQPIVIYGCGGLGNLAIQYAKNVFGAKVIAVDINDDKLALAKEVGADMTINPISQGPADKIVQDEFGGAYAAVVTAVSKVAFNSAVDAVRACGKVVAVGLPVETMDLNIPRLVLDGIEVVGSLVGTRKDLEEAFMFGAEGKVVPVVQTCSLDRVQNVFEEMEQGRIQGRMVIDFKQHNCDCK

SEQ ID NO: 16997 - protein, 303 aa, Wolbachia endosymbiont strain TRS of Brugia malayi
MTPKTFEGFHIYHYEEVSSTNGKALDLIDRGISNETVIIADKQTEGRGRTGKNWISPEGNFYASFIINLLQITSLGSSITHWDSRLAVAAHLDVIPAHDAKIQCWNDRESLSKLTELTFVTALAVGNTLLSFINDSNVQYKWPNDIFVDGKKISGILLEKKSNSNWLVIGIGINIDHAPLLEATCINKLLSSSVVPVTDTKIQMQVPMSHARMILQNIYILKELVTNFNNLRKQWILDGFCAIREMWLKRAFKMNEQISVKFASKLHEGIFIDIDKGGRLVLQQKDGSLIYFDAGELFVNNIL

SEQ ID NO: 16998 - protein, 1108 aa, Oryza sativa (indica cultivar-group)
MELGEEKEERKRGSKSQMEGESTMSESKSSSRGKKKSKTTSEQKVEIHTKETQNLENTKKKQEEGKIKRNKKAPVQGVIQKDKECKSSKEIEGKNIGGIQKEKQSKSSIEIEEKESDIKKHFKALTEMDTEIISQSNLTEINTAMLSSGITIELSEGERSIQSKQIQNMKQSILTEYETTFVNSGITCNEVGRSNALDEPNTDHIGLGAEDATVEKQSMDNSTSITEAFVDYSNKYSYDELSLFGSMNSVANMSFTSLMEQIISSQPTISDMQEDESNEEDAMDNWNLDIFNLLDGEKEPSSMDNHRCTSVQGTRDDDNNPNDNSETNQQELTEEDINIFVENEQEEATKGNNAAIDSKYIPRVGTQFKTITEAHEFFNFYALLARFSIVRAHNYHTTSKKRNGEVTRVTFRCNRQGKPTSQSKSVSAEETVVSERNTNENDATDCKCALVISERNEIWNISMVQLDHNHQLSPRDEVRFLKSHKHMTTEEKMLIRTLKECNIPTRHMIVILSVLRGGLTSLPYTKKDISNVRTTINKETSSNDMMKTLEFFRRKKEKDPHFFYEFDLDESKKVKNLFWTDGRSREWYEKYGDVVSFDTTYFTNRYNLPFAPFVGISGHGNTIVFGCAFLHDETSETFKWLFRTFLKAMSQKEPKTIITDQDGAMRSTIAQVFQNAKHRNCFFHIVKKAFNLSGNLFKAKEGLYDEYEDIINNSVTEEEFEYLWQEMIDSFEVQHINFLKHMWSIRKRFIPVYFKGDFCPFIKSTALSEGTNSRFKNNVGPQYSIINFMIEYERVMDTIQNLEQFDDHISRTNKPSKLWSHYYIEYQVMRMYNRKIFIKFQVELKRTTRFQINEVEKFKPYEVIFGIESKYSSNQKKEIPEKYIIERWTKKEYKGLGGKGNGNIPLAQSSILRFNILSRKSAEIASNGSKSNETFQFAVEEMDKIAKQLELMCSNKDAEQEINDSDPNAEDNLNSHEKGNQQSEENTEEILLDPDIAKSKGRPAQRYKTIREEIQQKELYHCSHCQRTDHTFPTCPLKHVEFDLPRKKRRKVKNTREQDGVEQKKKDVSNKRKDLQQDISQEKHNSGAELEGKKKRNSSSSKRGGTKE

SEQ ID NO: 16999 - protein, 835 aa, Oryza sativa (japonica cultivar-group)
MASSSPLCCYLLLFVVVVVLTGSCRARDTVVPGRPLAANETLVSGGDANFVLGFFTPPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKGKLEDGQEIAVKTLSKTSVQGLDEFKNEVMLIAKLQHRNLVRLLGFSISGQERILVYEYMANKSLDYFLFARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 17000 - protein, 123 aa, Narcissus pseudonarcissus
QPMSVFWLVPQFFLVGAGEAFCYIGQLDFFLRECPKGMKTMSTGMFLSTLSLGFFLSSALVTIVHKVTGESGQGAWLPDDLNRGKLYDFYWLLAVLSAVNLVAFLVSARWYVYKENRMATDDG

SEQ ID NO: 17001 - protein, 375 aa, Puccinia graminis
MEEEVAALVLDNGSGMCKAGFAGDDAPRAVFPSICGGPRHQGVMVGMGQKDSYVGDEAQSKRGILTLKYPIEHGIVTNWDDMEKIWHHTFYNELRVAPEEHPVLLTEAPLNPKVNREKMTQIMFETFNAPAFYVAIQAVLSLYASGRTTGIVLDSGDGVTHTVPIYEGYALPHAILRLDLAGRDLTDYLIKILMERGYSFTTTAEREIRRDIKEKLCYVGLDFEQEMQTASQSSALEKSYELPDGQVITIGNERFRCPEALFQPSLLGLEASGIHETTYNSIMKCDLDIRKDLYGNVVMSGGTTMYSGISDRMQKEITALAPSSMKVKIVAPPERKYSVWIGGSILASLSTFQQMWISKQEYDESGPSIVHRKCF

SEQ ID NO: 17002 - protein, 95 aa, Brassica napus
MMYVRALPTTDVNRNTEWFTYPGVWTTYILILFFSWLLVLSIFNCSPGMAWTIVHLAHFAVSKPNKDLIPFNSITHLLLLLYRQRIICFTGRRER

SEQ ID NO: 17003 - protein, 320 aa, Bacillus subtilis subsp. subtilis str. 168
MRSHSVVCIGELLIDFFCTDVDVDLMEGRQFLKSAGGAPANVSAAIAKLGGDAAFSGKVGKDPFGYFLKRTLDAVHVDTSMLVMDEKAPTTLAFVSLKQNGERDFVFNRGADALFTLEDIDQEKLNEAKILHFGSATALLSDPFCSAYLRLMSIAKDNGQFISFDPNYREDLWRGRVSEFVSVAKKAIAVSDFVKVSDEELEIISGVKDHEKGVAILHEIGANIVAVTLGKSGTLLSNGKDREIIPSIPVTSIDSTGAGDAFVGAALYQLANTDQIQSVDADFVKLREIVAFANKVGALVCTKIGAIDALPSLDEIGVSL

SEQ ID NO: 17004 - protein, 323 aa, Idiomarina baltica OS145
MFKKFNAKSTADEVLSGVDLRGKRFLITGVSSGIGLETARSLAAHGASVVGTVRELQKGELTSAPIREAASQGNGNFELVQLDLASLQSVHACADNLLGNGQLFDAIIANAGVMATPFGRTVEGVEIQFGTNHLGHFALINRIEQLIADNGRLVVLSSQAHRAADVDLSDPNFEQQEYDPFVAYGRSKTANALFAVEFDKRHRHRGIRAASVMPGNSLTDLARHFSQEDLQGLFEFVGNARAEAGLPPSELKDVAQAAATSVWGAAVADKDEIGGRYLEDCTIAAVDDTPNPFVDGVRSYALDAKKAKELWTVSDELLAAACN

SEQ ID NO: 17005 - protein, 999 aa, Candida albicans SC5314
MFTKSTIRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIKSRAENIGVEIVEIPLATKQGVEELSRIADKVCGALVQYPDTNGEITDFTEIGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLGELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 17006 - protein, 426 aa, Nocardioides sp. JS614
MSTEIRLDTVERAIADIAAGKAVVVVDDEDRENEGDIIFAASKATPDLMAFTIRYSSGVICVPMPARMLDRLEIPLMTPHNKDRLRTAYTISVDARDGVTTGISAADRAHTVRVLADSATEPWEITRPGHVFPLRYREGGVLVRRGHTEAAVDLAKLAGLTPAGVLVEVVNDDGTMKRGPELRAFADEHGLAMISIDDLVRYRRRHETLVERVAETQLPTRHGDFTAYGYRITVDGSEHIALVHGDISGPEPVLTRVHSECLTGDVFGSHRCDCGPQLEEALERIVAEGRGVVVYLRGHEGRGIGLVAKLQAYQLQDGGRDTVDANLDLGLPADARHYGTATQVLRDLGVGSVRLMTNNPDKVRNLEDYGVSVAARVPLTPHPNDHNIAYLLTKRDRMGHDLPNLADGVPDTRADGVPDTLAQNGA

SEQ ID NO: 17007 - protein, 166 aa, Zea mays
PRVRPVSVAEHNNHQHRLHSPTPASATKISIPISSSEAALFGKGRYKVWALAAIALLALWSMFAASVTLRLSSVDLATTFGDASDPLIDELDPLEMEQREKLVRRMWDVYTRTDNHVRLPRFWQEAFEAAYEELAGDDMLTTDAAISEIARMSIHRPEVEQSWNKD

SEQ ID NO: 17008 - protein, 1292 aa, Yarrowia lipolytica CLIB122
MLLPLSFYETNTDSMAGFLLETEGCPSPRVGHAALTLGNAFIVFGGDTKVTDTDTPDDNLYLLNTSTLKWTVANPKGSRPAGRYGHSLSTVGSKLFVFGGQLDDYFFDDLVCFDLTKLRSPECRWTTIEPADGVSPPPRTNHTVVTYQDKLYMYGGTDGQLWYSDTWCFDPVTNLWTQLNCSGFIPTPSEGHAATVVNDIMYVFGGRSSKGDDLGVLSALKLSSKRWFTFENMGQAPAPRSGHSMTAYSSHKVLVMGGESHDQDDTHVYVLDTSRIKYPPKASAGDVGDTSVQSISSLSSQNAPQPGIQPGQSGLQSGRQSPAMQSQSYSQTGPHPPAPGAIPLPGMVGAGAMDRSFDRSSASAGSATSPNMDRSIGSNDARADRSIGSIDDEKYDRGYMQPGQVDDTPAGPSPETHGHGVAAGVAGAAAGVAGAAAGVAGANHLSHRTSNLGSNSEEFESADDGRPISSEAEADAEDVYGSPSGKIPAAWPQEVKQEEEEPFQHKDSSFHDASTPRDEREHPEYGQEAGKAAVGPDAGYSDASETVGYSSAAPNSAGATAPTDSTPTGYDDSDYSQHTTPQHSAVASPVNYTSRDVDSSHSITPGVAAASAGVAGVTAGVAGMNIHQKANNVKIEPSEHERGLDSALESNPDTTIDSEGDVQDVIEQLKATNSWYESELTVAKQSGYTPSKNPVGDIEKVRRRSLRYSRDQGASLSERDILVQALVEVKQELQNVKNDVARQSEEASQKLKALNDENQELRAHIESGGDGESGSRALGAGAAGAGVGALAGAGVGAATSGGDPELAAKHAELQKKYNLLVGGGAPSADSTRDLADGASAPSGNVHQLLKQEQNKNASLEYELETLKDELATTQAKWKDVGGTANDHVTALQAAGAALAASQSQHALLQRDLDTHKTARSAADEEVLQLKRQLEDAERRLAQAEEALEKEQQLGAHAREQNEHSTQAMTGGIDKILAMWTGSALIGGAAGYAGGALTNGSRGIDGAEGDDGETPAAPSGLNSHPQFVALQKQVDGANKLHLMHKEAAEQATADLSVAQTQVEELKSTLLKSEQQNHELIQELEELKGHVTEHRRQLEDHEQTRSMSQNQALRLKELEAELAATLATHRTELDNIESTHRNKLGEMEKAKKDSLTYMQNSDLALRKTREELSRSKEQISQLQDELSELQIRGKGGAPRGHDYDDDDDDDDEKFGSHQLELQLRDTRATLVVVEQERDELRLANADLRKKAITNVQDVEKYKRRYQRLKQRGGEDSFGESEFDQTHTSGFESPR

SEQ ID NO: 17009 - protein, 542 aa, Synechococcus sp. RS9917
MNVPNTSEKSFRHSGGVAPVVLTILDGWGYREGSDHNAIRSAQTPVMDALWHAYPHALIEASGAHVGLPDGQMGNSEVGHLTIGAGRIIRQELVRISETVRNGQLGEREALRELAADLRRSGGTLHLLGLCSDGGVHSHVDHLCGLLRWAAAEGLERVAIHAITDGRDTPTDSAPRYIRQVEEAIHSCGVGELASLCGRYWAMDRDHRWERTSKAHALLTDPTLPSSGLSAAEAVAASYAQGTTDEFLEPVRLNDRCLRDGDGLVVFNFRPDRARQLVQALCLEHFDGFERGHHPRLNVVTFTQYEADLPVAVAFPPESLDQLLGQVVAEHGLKQYRTAETEKYPHVTYFMNGGIEQPLDGEDRHLVPSPRVATYDQAPAMAAASLTDSCIAAIEKGVYSLIVINYANPDMVGHTGVMAAATEAIQAVDHCIGRLLDAVGRMGGTMLITADHGNAEVMQGPDGQAWTAHTTNPVPVILVEGERRKVPGLGNAIQLRDNGGLADIAPTLLQLLDLPKPDAMSGASLIEAIDALASRSRLPQPV

SEQ ID NO: 17010 - protein, 867 aa, Candidatus Protochlamydia amoebophila UWE25
MVTSFEFFYFRKGDFMSTVNIDLLAEELIRRVKSYLISTIGRTAEEADANEFYRALCYAIREETMINWQATARTIAKNQSRQIYYLSMEYLPGRLFVNNITNLCSKDVVKLVLQKMNRNLRSIVEQEEDPGLGNGGLGRLASCLLDSLATHHYPAQAYGLRYQYGIFEQQLWNGAQIEAPDCWLLNENPWEFRRDLRRVHVKFCGKPQTTYNIHGDEILSLTEAEEVGALPYDIPIVGYSKNSNFSVVTLRLWSTKDSPRNFLLQKYNAGRLDQAAENTTLTDVLYPSDNNDIGKRIRLKQEFLLVSASLQDIVRHHLAQYNNLRQFADKVRIQINDTHPSLVIAELVRILTKDHDLPWKTAVEITEACTGYTNHTILSEALEQWDKALFYYLLPRQCRIIERINLDFCNAIRSRYPQDEERIRRLSIIENDKVRMANLAIVGSHKVNGVAKLHTEILKNSVFKDFYEFFPDKFVNITNGVTQRRWLLECNPELARFITQRIGDKWITDFLTIKELAKFASDPESQLEFLAIKKKNKFKFIEYINRENRLRDANGIIISPPPLLDVDSIFDVQIKRIHEYKRQLMNALHLIMLYQEITQNPNHQRIKRTVVIGGKAAAGYETAKDIIRLIYCIARKVNQDPIVGPFLKIVYLENYNVTKAEIVIPASDLSEQISTAGTEASGTGNMKMAMNGALTIGTQDGANIEMEEEVTPEWWPFSFGCTAEQIAQLKMTNSYSSKEIYDNNPAIKKAVDALRDRSFAQTEEEHQIFSDLYHKLIEMHYGGAPDRYFMLKDLQSFYDTQLKVEELYKKPKKWAEYAIHNIAGMGKFSTDFSVHNYAALIWGIEPCPIDQELLDRVRYDYAAHNRC

SEQ ID NO: 17011 - protein, 438 aa, Streptomyces avermitilis MA-4680
MACVSYPYEAPVSQTLFERAAAVTPGGVNSPVRAFRAVGGTPRFMVSGNGPYLTDADGRTYVDLVCSWGPMILGHSHPEVIAAVQEAVARGTSFGTPGEGEVALAEEIVARVEPVEQVRLVSSGTEATMSAIRLARGFTRRAKVIKFAGCYHGHVDSLLAAAGSGLATFALPDTPGVTGAQAGDTIVLPYNDLDAVREAFRAHPGEIACVITEASPGNMGVVPPAPGFNQGLKDACAENGALYISDEVMTGFRTSKAGWYGVDGVRPDLMTFGKVMGGGFPAAAFGGRRDVMAHLAPAGPVYQAGTLSGNPVATAAGLAQLRLLDDAAYAKVDAVSAEIRTLVTDALTKEGVAHRLQNASNMFSVFFTDRPVNNYEDAKGQESFRFTAFFHSLLAQGVYLPPSSFESWFVSTAHDEQAVQRIADALPAAARAAAEATA

SEQ ID NO: 17012 - protein, 473 aa, Synechococcus sp. RS9917
MAKTAQDVLRQIKDDGIELIDLKFTDLHGKWQHLTVCADMVDDQAFSEGLAFDGSSIRGWKAINASDMAMVPDPNTAWIDPFYRHKTLSLICSIQDPRTGEPYDRCPRALAQKALAYLAGTGLADTAFFGPEPEFFLFDDVRYSSSEGGCFYSVDTIEAPWNSGRLEEGGNLAYKIQLKEGYFPVAPNDTAQDIRSEMLLMMGQLGIPIEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILRHAPSFLAFTNPTTNSYKRLVPGFEAPVNLVYSEGNRSAAVRIPLTGPNPKAKRLEFRSGDALANPYLAFTAMMMAGIDGIKNQIDPGDGTDVDLFELPADELAQIATVPASLNGALEALNADKHYLMEGGVFSEDFINNWIDIKYEEVQQLRQRPHPHEFVMYYDA

SEQ ID NO: 17013 - protein, 376 aa, Vibrio angustum S14
MTDKFIKSKAAIAWGPNQPLSVEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPEISLAKINKEAPLEEVCLLGCGVTTGMGAVLNTAKVEEGSTVAVFGLGGIGLAAIIGATMAKASRIIAVDINEEKFELARKLGATDCINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 17014 - protein, 179 aa, Kluyveromyces lactis NRRL Y-1140
MSSSSPNSDRASSVGVTEPVASDVEENRPKSKLSEGEADLYLDQYNFTTTAAIVGSVDRKIFVLLRDGRMFFGVLRTFDQYANLILQHTVERIYIEGENKYGECDRGVFMIRGENVVMLGEVDIDKEDAPLESMERVPFEEAESYKEKMDEVKYKENTAKGKRLAQLGLTTDFNKGDLY

SEQ ID NO: 17015 - protein, 654 aa, Thermotoga maritima
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASIADKKKITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 17016 - protein, 123 aa, Crocosphaera watsonii WH 8501
MSKQKDSHPSEFTRTPPWGKVTMLEEGHRYRINRIELNPGQHISTQMHYHRSEHWIVVSGTAKVVFNGEEHLLKQKESTYVPMNTRHRVENPGVIPLVLIEVQNGEYLGDDDIIRFAEEEGKK

SEQ ID NO: 17017 - protein, 123 aa, Brassica napus
MEGNSGGGAATGGGGGGSDVELVSKTLQVEHKLFYFDLKENPRGRYLKISEKTSATRSTIIVPSSGIPWFLDLFNYYVNSEEHELFSKELQLDSKVFYFDIGDNRRGRFLKVSEASVSRNRST

SEQ ID NO: 17018 - protein, 294 aa, Escherichia coli CFT073
MEGLTVEFSVLSNNLKMPMMGFGVFQVTDKDVCKQSVLNAIRTGYRLIDTAAVYGNEDAVGEAVREAISEGLCTREELFITSKLWVQDMLNQDIAAAGIEASLKKSGLECFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 17019 - protein, 338 aa, Ralstonia solanacearum
MYSAHDVRVENVPDATIVEPTDAIVRVTQACICGSDLWPYRAMEPSETGQSMGHEAIGVVEAIGSGVNKIKVGDVVIMPFAYSDGRCEFCHEGLQTACVHGGFFGYGGFNGAQAEALRIPQADGTLYALPGGVDSALMASLLTLSDVMGTGHHAARVARVRPGTSAAVIGDGAVGLCGVIAAKRLGAERIILMGRHPDRIALAQAFGATDIVSERGEEAIERVRALTGGHGVHSVLECVGTDQSMQTAANIARPGGAVGRVGVPHYNAIPADTTFFKNVIVGGGPAPVRAYIDDLLPDVLDGKIQPGRVFDRVIGLDEVPDGYRAMDERQAIKVMINL

SEQ ID NO: 17020 - protein, 404 aa, Oenococcus oeni PSU-1
MPEVKKNLDKKTNSFVQGAKPSQIISLNKEFKKIDNIVLLTVGEPDFNTPEHIKKAAIADIQANDSHYGPSSGTPELLQSVADFLKNHYHLNYDPATEIVNTLGVTEGICDTMKTILNPGDELIVPEPTFPVYAAAASAFGGKIVPVSTEESGFILTAEKLKQVLLAHPQAKAIVLTTPGNPTGVAYNEKQIQALVNVLKNHDIFVISDEIYSELTYDRPHSSFAAALPGQTILFNGVSKSHAMTGYRLGIIAGPQSIISQIAVIHQLITTALPDVVMAAATEAFSAGENDAATMRVEYKKRRDYLIDAFTKLDISFAYPDGAFYFFFKIPDYLEQDGFKLARQIAEEAKVGLTPGVAFGQAGYLRLSYAASLDQIKIAVNRLSEFFSKQKQAQAKIYEKSTTK

SEQ ID NO: 17021 - protein, 147 aa, Zea mays
MVLTSNISVQKTLYEVLSVSEDATYDEIRAAYSVQKAWEVLRHPTSRADYDKQLQSSRQSIEIIASEIQVGDMIVESAAGALELLYPCRCGDYFSITSGELSGMGIVVTRDGEEVEELQASDSASASVVLGCGSCSLKIRLVIDGSS

SEQ ID NO: 17022 - protein, 239 aa, Idiomarina baltica OS145
MSKVFLVTGGNKGIGKEIVKQLGLHGHTVYLGARNVEEGRNIAEAFEASGLDVRFVYIDLTDVNSQKEAADHIKSKSGLLDGLINNAGMINDFDLASSVSLESLRETFETNYFGTVMVTQNMLSLLRAGERKVIVNVSTGLGSMAMHGDPSWPFHGTNPLAYNSSKAALNMFTVLLAKELRAEGFRVNSVSPGWIATDLGGEQAPGTPEEGAAIAVECALEGNDSQTGLFRTTGGTIPW

SEQ ID NO: 17023 - protein, 391 aa, Nostoc punctiforme PCC 73102
MAMKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAQYARVPFADTGLFKIPDGLTDEQVVFLTDIFPTGYMAADNCNIQPGDIVAVWGCGPVAQFTIKSAYLLGAERVIAIDRIPERLQMAKDQGKAEILNYEEVDVGEALKEMTGGRGPDACIDAVGLEAHGTGLEGVYDEVKQAVRLETDRPHVLRQVMIDCRKGGHVSIPGVYVGVVDKIPMGAAMNKALVFKMGQTHVHKYLNTLLDHIQNGRIDPSFVITHRLPLDEAPRGYEIFRDKKENCIKVVLKP

SEQ ID NO: 17024 - protein, 279 aa, Bacillus anthracis str. 'Ames Ancestor'
MSIQNISFLGAGSIAEAIIGGLLHANVVKGEQITVSNRSNETRLQELHQKYGVKGTHNKKELLTDTNILFLAMKPKDIAEALIPFKEYIHHNVLIISLLAGVSTHSIKNLLQKDVPIIRAMPNTSAAILKSATAISPSKHATAEHIQTAIALFKTIGLVSVVEEEDMHAVTALSGSGPAYIYYVVEAMEAAAKKIGLKEDVAKSLILQTMIGAAEMLKASEKHPSILRKEITSPGGTTEAGIEVLQEHKFQQALISCITQAAQRSHNLGKTLEQLTKEK

SEQ ID NO: 17025 - protein, 263 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAE

SEQ ID NO: 17026 - protein, 469 aa, Bacillus subtilis subsp. subtilis str. 168
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 17027 - protein, 473 aa, Moorella thermoacetica ATCC 39073
MDSAITIIGLNHEGAGIGHLQDGRVIFVPGALPGEQVLVEVVSVKRNYARGRLVEVVEASPDRVLPPCPEAASCGGCDLQHLDYRAQLHWKRRLVIDALQRLGHLRDIPVLPVLGMANPWGYRNKVRLHVRRGRLGFYRPGSHELAPFSCCPLLPPGLLKAARAIVRLLPELPPGLQHVTLRQGLATGELLVVLEALPGWQGDRELAEKLAGRFPELVGVVSLAGGGRSRSGPKDFAGEPALECSGWVKTGGKEARRARYQEGFVPRRLGGRPFTLYGRDYLEERLGDLRFYISATTFFQVNSAQAEVLYNKAATFAGLQGGEEVLDAYCGSGAIALWLSRQAGRVEGVEVVPEAIVDARRNSILNNLANVHFRTGAAEAVLPRLAGKGYRPEVIILDPPRAGCDRRVLAAVATMEPRRVVYISCNPSTLARDLAHLREAGFKPGPVQPVDMFPHTHHVECCCFLVKERNNSR

SEQ ID NO: 17028 - protein, 387 aa, Zea mays
MSLPIALVVGIAGGATLLAVAAVLLALWCAARMRARRNRNSDTGSSDPSTLVEWGKGGRSSLAPDLEHQVARQFSLEDLVQATKNFSDTNIIGAGSFGLVYMGLLLDGTVVAIKRRVGAATQVFADEVRLLSEIRHRNIVTLIGYCQEGGLQMLVYEYLPNGSVCGHLYASYGPPDNRKGSATRLEFKQRLSIAIGAAKGLNHLHSLDPPLIHKDFKTNNVLVDENFIAKVADAGLVRLIRGSDDAGPSRGFSNSVYQDPEVQSMTQFSESSDVYSFGVFLLELITGREAASLIPTESREYLAHWMEAHFSSNELIDPRLAGNFTAEGMKELVGLAFQCLNPSSRRRPRMRLVATELDRILETEMSMTTFMGDGTTIVTLGSQLFSS

SEQ ID NO: 17029 - protein, 415 aa, Ashbya gossypii ATCC 10895
MQFYQMYAYRLNESRKRVLANCQRKWDDGFRIQGKPVVQKAKVLDIQAGEPCWCVGTIYCEMKYKPNVLEEVVNDTYGTKAPVKSYTDPEGTDEIMLEDESGRVLLVGDIITSTPFVTGTVVGVLGMEAEAGTFQVVDICYPQAIPQAPLVRAPGKSVALISGICAASNDPKLSLKLRLLQDLLSGDIGDTGSIASVARLIICGDSVGTCESNSIGGALDELGSFMANTLTSLPITILPGANDPSERSLPQQPLHKALFKQALKPYFAEVNSEVFESVTNPYWFDLEGIQVLVSSGQNVDDMCKYVIPYLGTEQLRDTIEHRLDLIEASLKWQNIAPTAPDTLWCYPYKDNDPFIMNEWPHVYIIGNQHAYGYRKVLLENEVEVVLITLPKFSSSGQFVILDLDTLNAEVITIDA

SEQ ID NO: 17030 - protein, 274 aa, Heliobacillus mobilis
MNVSLLENRRIGFIGGGAMAEALLSGLVRLVPPQAITVSDPNPSRLAYLQSEMAVQTTSDNSVVCEQSDIVVLAVKPQVLPAVLTPLKTAICSKHLVISIAAGITLAQLESWLSPEVPLIRVMPNTPALIGKGASALAGGRAVSEQDVQTAKALLEAVGIAEVLPETYLNAVTGFSGSGPAYVYLFIEALIDAGVKEGLTRDLARKLAIQTVIGSAQLLIETGNHPAIERDKVTSPGGTTIAGVQALEDGGFRSAVFAAVHAGTKRARELSGSQ

SEQ ID NO: 17031 - protein, 252 aa, Escherichia coli
QNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQYCQMANYLAENA

SEQ ID NO: 17032 - protein, 453 aa, Kluyveromyces lactis
MKWIYTFIAAVSATVTFHPENVEYSLSAKELDPASLGIDTVNQWSGYLDYQDKKHSFYWFFESRNDPANDPVILYLNGGPGCSSMDNLFFETGPASIGPDLKPIHNPYSWNNNASIIFLDQPVNVGFSYSEERVKTTNDAARDVYNFLDLFFTKFPNLTANAFHIAGESYAGHYIPRIAHEIVSVHKDDTKFNLSSIVIGNGLTDPLVQNQYFKPMACGEGGYPAILNPSKCRTMSVSNLACKGLTSLCSKTKLTPGRAYLLLHFCWKSLIQPAFDSAVNPCDIRGPCEDPESGLCWKTLGYIRSYLNQEFVQDALGTKVSSYNGCNTSVGSDFFLTGDNSRPFQQYVTELLDLNIPVLIYAGDTDYICNWLGNMAWTDALTWKDHISYETLPLNPWYSLNGSVQFGEVKNHGPFTFLRVFEAGHTVPYYQPLATMEMINRWISGDLSLGYSN

SEQ ID NO: 17033 - protein, 528 aa, Synechococcus sp. RS9917
MTKVLVSDPIDQAGIDILGQVAQVDQRTGLSPDELKAIIGDYDALMIRSGTQVTADVIAAGDRLRIIGRAGVGVDNVDVPAATQRGVLVVNSPEGNTIAAAEHALALLLSLSRHVPQAHASMRQGAWDRKKYVGNELYKKTLGVVGLGKIGSHVARVAKAMGMDVIAFDPFISADRAQQMQVRLTQLNELFRTADYITLHIPRTPDTENLVNAELLRSMKPTARLVNCARGGIVDEAAIAEAINTGVIAGAGLDVFASEPLAVESPLRAVERGLVLTPHLGASTEEAQENVAIDVAEQIRDVLLGLPARSAVNIPGLSAEIMERLKPHLQLAETLGLLVSQLSGGQVQELEVRLQGEFAEHPSQPLVVAALKGLLSSALGERINYVNAALEAKGRGIHVLEIKDDASRDFAGGSLQLTTRGGQGGHSVTGAVFADGDLRVTSIDEFPVNVPPSRHMLFTRHRDMPGIIGHLGSLLGEHNVNIASMQVGRRIVRGDAVMVLSIDDPIPPSLLATIHAINGIQEAHPVTL

SEQ ID NO: 17034 - protein, 465 aa, Haemophilus influenzae R2866
MGPSTDRDNNLEKIIAAGANVVRMNFSHGTPDDHIGRAERVRSIAKKLGKTVAILGDLQGPKIRVSTFKDGKIFLNIGDKFILDAELPKGEGTQESVGLDYKTLPQDVVPGDILLLDDGRVQLKVLSIDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 17035 - protein, 367 aa, Vibrio angustum S14
MALSSAKEIIDDIRQGKMVILMDDEDRENEGDLIIASEKITPEAINFMATYGRGLICLTLSKARCQKLNLPLMVQENTEQFGTPFTVSIEAAEGVTTGISAADRSRTVQAAVAANATAADIVMPGHIFPLMAQEGGVLTRAGHTEAGCDVARLAGLEPSSVIVEILNEDGTMARRPQLEVFAEKHGLKLGTIADLIEYRNNHETTIERVAECRLPTEFGEFDMITYRDKIDNEVHYALRKGGIKAGEETLVRVHLQDTFKDILQSGATQWTLPAAMKRISEESGVLVILSKQESTDAIIHKVKNIAAEEAGQPKVKVTQKDPSRQVGVGSQILSDLGVSKMRLLSSSTQRYHSLSGFGLEVVEYICD

SEQ ID NO: 17036 - protein, 157 aa, Zea mays
MQASRARLFKEYKEVQREKSADPDIQLICDDSNIFKWTALIKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGYQSMARMYTRLAAMPKKG

SEQ ID NO: 17037 - protein, 319 aa, Oenococcus oeni PSU-1
MSSYPEKWFSGNQLASQLELSRTAVWKGIRLLEEQGYSLESRHGLGYRLMIDNQLNAALISQELRLDHQPRIVVYNKVSSTNTIAKQMLFEDLKKPTVILANQQTAGRGRFDRKFYSPAASGIYMSIALPLSIDEKVNPGLLTTATAVAAGRAIKKVFHRQVKYKWVNDLILNNRKCGGILTEAITDLESGRIASLVIGIGLNLTLDTKKMPTELLGKAGAISKGDNSKRNLLIAEFINFFFDIYRNYRSGDFLEEYRRHSIVLGKKIAIVVNRKKIIGKVEKINSQGAILLKSDNNQLLTISSGEIIKLNLLEGKYHE

SEQ ID NO: 17038 - protein, 173 aa, Zea mays
MFLRRILTGFGGLAALRAARAVKETTGIVGLEVAPNAREVLIGLYTRTLKEIEAVPKDEGYRKAVESFTNHRLQICQEEDDWMCIEDRIGCGQVEELIEEAEDELKLIAKMIEWDPWGVPDDYECEVIEDDTPIPKHVPQHRPVALPEEFFKTLDAVKSDPALQGDAPPQVKA

SEQ ID NO: 17039 - protein, 86 aa, Oryza sativa (indica cultivar-group)
MAGAAKVSWMVAMSVGAVEALKDQGGLCRWNYALRSIHKAAKANAAGVSQGKKLPASAAAVAERRRAEKAEEGLRTVMYISCWSTN

SEQ ID NO: 17040 - protein, 139 aa, Oryza sativa
  misc_feature (109)..(109): Xaa can be any naturally occurring amino acid
  unsure (1)..(139): unsure at all Xaa locations
AELFIHESEHRTAVAAGVLICRGHSPAYSKRVFYLIAMNLINVENAFAQKHYCDLSSKPFFRGLVEHIVFGPGGAMDWEGKHGVSTDRKLVGATNHLAVERGTIRGDFXAVYIRQDGIHGSDSIENAMKEIALCVPEGI

SEQ ID NO: 17041 - protein, 556 aa, Oryza sativa (indica cultivar-group)
MRRRPFLDQRRPSSFKRRWQQRPWWFRLAVILLLALACLFLLLALRGSPDPDPVVLPSTDSSRSAATTSPLLHQRSYLDGVTDAFNMTDEMLSAHSFSRQLMDQISLAKTYLVVAKEANNLQFAAELSSQIRRAQSILAHAAAHGGTVTEQDAEKAIRDMSVLFFQAQQFRYDSAVTIMKLKGQIQSLEEKSKAEAEKSTKYGQIAAEELPKGLYCLGVRLTMEWFKTTELQRKFTERSPAVQSNLRDNSLYHYCVFSDNILAVSVVVNSTTLNSMHPEKIVFHLVTDEVNYAPMRAWFALNDYRGATVEIQKVEDFTWLNSSYVPVLKQLQDAATQNYYFSGSGNRGTPVKFRNPKYLSMLNHLRFYIPEIYPELRKVVFLDDDIVVQKDLSELFTINLNGNVMGAVETCMETFHRFHKYLNHSHPLIRAHFDPDACGWAFGMNVLDLVMWRNKNVTGIYHYWQERNADHTLWKLGSLPPGLLAFYGLVEPLDPKWHVLGLGYTTVDPATIKEGAVLHYNGNMKPWLKIGMEKYKGFWDNYVDYSHPLLQRCFTH

SEQ ID NO: 17042 - protein, 275 aa, Robiginitalea biformata HTCC2501
MSDLKNSAIEAHYYRERLSEDILKRLGELGVDLKHVRRSDIAAVDEFHVRGAEVSRELAERAGLHGAKLLDVGCGLGGPCRMLADEFDCQVVGVDLSGEFIRTARKLSDLVGLSEKTEFLQCDATSLPFADASFDAVWTQHVQMNIERKDAFYGEISRVLKPGGKFIYYDIFKLGPEPITYPVPWADNPDISFLQPASHMSEILLELGMKSQEKTDQTKKGIEFFERVLQKIAASGPPKLGLNVLMGSETKVKITNLVNGLKEKKIQLQSGCFIR

SEQ ID NO: 17043 - protein, 139 aa, Brassica napus
TRLSRLKEEENSLLEKASAGRREMEHIEDMIRDHQKRQNNINSNIYDLKKHQTNKVTAFGGDRVIYLLQAIERHHRRFKKPPIGPIGSHVTLINGNKWASAVEQALGNMLNAFIVTDHKDSLTLRSCANEANYKNLRNI

SEQ ID NO: 17044 - protein, 466 aa, Moorella thermoacetica ATCC 39073
MASSILRKKDIATAMEMAAMDQYRLRRELKAMDLFFLVIGITIGGGIFVLPGVMAAEHAGPGVTISFLIGAVVAIFTGLCYVEFASMVPVAGSAYTYSYIALGEIFAWIIGWDVLLEFTLVCSAVAVGWSGYIVELLKDMGLSLPPAFTTDIAHGGIVNLPAVFILLVVAYIIYGGISLTGKVNDAIGIIKLLTVVFFIIVALPFVKPVNWQPFLPFGWQGVMTAAALGFFAYGGFDAVTTAAEETRNPNRDIPLGLILGLVVVASLYVLVSLVLTGVIPYTKLDTPAPVAFALSYLGKRWGGSLVAAGAICGLFTVMMGAMLGGSRILFALSRDGLLPPVFSRVHATRRTPYVATLIVLTVAVLTGGFLSLGELVELVNIGMLTAYLLTSISILVMRLRYPEIERPFRVPAVWLVAPVATLGVVALTFSLPGATLVRFAIWFIVGMLIYFGYGIRHSKLANRENN

SEQ ID NO: 17045 - protein, 474 aa, Gibberella zeae PH-1
MIEIHAIDGRERTTAASPNMTKPQGWDQNAATSPLASFQSPPSLSAALPNRGAPKNLKPFNTKDIKILLLENVNVTGQEILKAQGYQVEALKTSLPEDQLIEKIRDVQVIGIRSKTKLTEKVLREATNLLVIGCFCIGTNQVDLEFAAKNGIAVFNSPFANSRSVAELVIAEIITLARQLGDRSNEMHRGTWNKVSSKCWEIRGKTLGIVGYGHIGSQLSVLAEAMGMNVIYYDVVTLMALGTASQVPTLEKLLGEADFVTLHVPDLPETRNMISTAEFEQMKTGSYLINASRGSVVDIAALIKASRSGKVAGAALDVFPSEPAANGDYFTNDLNVWGEDLRSLKNLILTPHIGGSTEEAQRAIGIEVSEALVRYINQGITLGSVNIPEVQLRSLTSDEPDTARVIFIHRNVPGVLRKVNEILGDHNVDKQISDSRGDNAYLMADISNIKYEQIKDIYDSLEGLSARVMTRILY

SEQ ID NO: 17046 - protein, 93 aa, Arabidopsis thaliana
  misc_feature (6)..(6): Xaa can be any naturally occurring amino acid
  misc_feature (21)..(21): Xaa can be any naturally occurring amino acid
  unsure (1)..(93): unsure at all Xaa locations
MPSLQXSLPPRTSTNNVVRMXEESLRRAKFIGKQQQKNELVVSMVRQQLKKHMNETDPEKIQKLKDDAASGTTSINMLDLSKRSSEGKVSQKY

SEQ ID NO: 17047 - protein, 267 aa, Rhodopseudomonas palustris CGA009
MTLTLTILGSGSSAGVPRPALGWGAADPSNPKNRRLRCSLLAERITPEGGITRVLIDTSPDLREQLISADVDHLDAVFLTHEHADQTHGIDDLRSVVMAMKRRIPVYLNQSTGEHVLYRFAYCFKQAPGSSYPAILESREIEAGDSKTIAGAGGDLTLTAFLLQHGDIPALGYRIAGAAYTPDVHDIPEQSFPALEGLDLWIIDGLRYKHHASHFNIETALKWINRFKPKRAVITNMHADIDYETLRKELPDGVVPGFDGMRLEIAG

SEQ ID NO: 17048 - protein, 219 aa, Gloeobacter violaceus PCC 7421
MALLVMVRHGQSIWNLENRFTGWTDVPLTEKGRAEARACGELIYCVPFAVAFTSKLTRAQDTLRLILEAADQPDVPVIEDQALNERHYGELQGLNKAETAAKYGEETVRQWRRSLEGRPPGGESLKDTALRSLRYFYEKIVPELEAGKNVLVSAHGNTIRAILMELDHLSPEQVEKVEIEYCVPVAFEHQADGTFSQVLMPRCDIIRPPQPPARSIARL

SEQ ID NO: 17049 - protein, 396 aa, Thiomicrospira crunogena XCL-2
MTDFIPSIADHAKTIQPFRVMKILGEAKALERQGKDIIHMEIGEPDFESLECVHDAVKTALDQGKTHYTPTLGLPELRHKLSEFYADFYRANVKSDNIMLTPGASSALQLALTALLNPGDKVLMSDPTYPCNRQFVQLLHGELVLLPVDADSDYQLTLAHLKRHWQDGIKVVMVASPSNPSGTVIEQDELIKMAEFAATKNAYFLVDEIYQGLVYDRPAESILSHDHPPDNVIVINSFSKFFNMTGWRLGWMVAPSHLMSVLERLGQNLFLSAPTPSQYGALRVLEKEALMQLEGRRKIFERRRNTLFHAMQDAGIPPKVLPQGAFYLYWDVSDYTDDAEQFCSRLLAETGVAITPGTDFGTHKAHQHVRLAYTTSEDQLKQAVLKIRAFIDTLSL

SEQ ID NO: 17050 - protein, 905 aa, Kluyveromyces lactis NRRL Y-1140
MAPFKFGKKQKNRKDASASPNTTPNSNSTIGNTSFQQELRSPGSSSTPTKQNYPKPAADSGLLAAQQRVMVSPVEQRSTSTQSTLQQQVFTPWNRIRLKQSPFPRYRHVASSYATDSGELFVIGGLHDQSVYGDTWIIKSLDNATSFKSITVPIADATPPPRVGHASTLCGNAFVIFGGDTHKVNDAGLMDDDIYLFNINSHKWTIPTPQGPRPLGRYGHKISIIAANQMKTKLYVFGGQFDDTYFNDLAEFDLSSFRRSDSHWEFIKPATFMPPPLANHTMISFDHKLWVFGGDTPQGLTNEVFMFDPAANDWCVVQTTGNIPPPLQEHAAIIYRDLMCVFGGKDAQDNYSNAVYFLNFRSLKWFKLPTFNNMIPRARSGHSLTLLSNNKLLIMGGDKFDYAVGNSTDVRTSDVDMGAGTIIYTLDLTNLNEFCPDIFKIDDVDHLDKFSTPLSKSNGRFDELKNKQASILSPDVPETVNTTPAVRKRSESGVLGPTAPKPKSPVPQQDANTDPPRVLSLQSQLSSETQSDTDPDVGSVEVVQYRTSPTKGDVKKYAVGTNLRSSSDYENYSPSIMHNTGAEPSPKPNSLSDTTHFDKSIDVITDADKSPVTLSEPARIVSEKNENNILKELLEELKQLKEDTVTSATSANSRIMELELENTELKQLNQLSHLNDMIKHQTEVIAKLQSEVDNKEKYVDLESKYIVLSEKYESLTKELDSKKQFINENIKKCSESLDTLLDGMRQKQKAHETVVTRHKETMTGLDRKLSEVILQNKELTTSRDQLFTEYSKLKDEHASKHEELTKMEREYRSVIDSVHNSGNAMEKLQNEIIKLRQENSRLKSDLENTINQEADDSSGSLNDAHYQLKINDLRAELFIIKQERDSLKDDVMTLKKKLLHSEATL

SEQ ID NO: 17051 - protein, 385 aa, Thermoplasma acidophilum
MKQIQLSRNVVDDISFGAIVKIRDQLLEMQRAGKKVYRLESGDPSFPIPEHVRLAIEDALKKNRTHYTDSTGIPELRKAIAEKLVKKNGIRSATPENVLVSNGGMNALYITFRSLIAPGEKVIIPDPMWTEIAEIIKLADGIPIRIPVERYVEEMRKYENDDRVRAVFINSPHNPTGYVFGEKQISDIIDFAESKGIFIVSDEAYEDVIFDGLKHLSPGSLYDDTISLFSMSKSYAMSGLRIGYAHTSNEILYDRMKKLLRCTINGVNSATQYGAVAALTGPQDYIGEMRKEYQKRRDIIYEAVSESRYLEPIKPHGTFYLWNRIKEYPPGVSDSWGMTSYLLEKTGVGSSPGPVFGPAGEGYIRFAFSAATDHIQEAADVLRNF

SEQ ID NO: 17052 - protein, 650 aa, Aspergillus nidulans FGSC A4
MVLAKSKNSVGLGQSLMNDRFGKGKASNMKKSSHNAGIARKDMNGETYITNSAKEASWVKMRSITEQAALDEFLTTAELAGTDFTAEKMNNVQIIHTDQKNPYLLSAAEEKSALRKHKKNKGRLTVPRRPAWDASTTRNELDAMERESFMDWRRGLAELQENNDLLMTPFERNLEVWRQLWRVIERSDIVVQIVDARNPLLFRSEDLETYVKEIDPKKRNLLLVNKADMLTDKQREMWADYFERNQIEFRFFSAQMAKEANEARENEGEDEDTKSLTEGTENLNLQESKEKEADGGVDLPSGTKAPSPKRTNILDVDELEELFLSNAPDATKDDEDEQDGDSKPRKTVIGLVGYPNVGKSSTINALLGAKKVSVSSTPGKTKHFQTLYLSPEIMLCDCPGLVFPNFASTKAELVVNGVLPIDQQREFTGPAGLVAKRIPKHFLEDVYGVTIHTRPIEEGGTGEPTAHDLLRAYARARGFATTGQGQPDESRAARYILKDYVNGKLLFCHPPPANEAEGEEQIDPAEFNKDLYDWAHLPPRRQAMLAATQASASSSSKNPVQGRKSQSVDKGFFGPGSSSSGGRLTMPFNAKYTEQGQQIRKPLTGRKERVMIALERGVDVSEVRGPSKKHFKVKHKNQKKGKKTAADDDY

SEQ ID NO: 17053 - protein, 338 aa, Sclerotinia sclerotiorum
MAPTKVGINGFGRIGRIVFRNAIEHDDIDIVAVNDPFIETEYAAYMLKYDSTHGQFKGDIKVLSDGLEVNGKKVKFYTERDPANIPWAESEAYYVVESTGVFTTTEKAKAHLKGGAKKVVISAPSADAPMYVMGVNNETYNGEADVISNASCTTNCLAPLAKVINDEFTIIESLMTTIHSYTATQKTVDGPSAKDWRGGRTAAQNIIPSSTGAAKAVGKVIPELNGKLTGMSMRVPTATVSVVDLTVRIEKAASYDEIKEVIKKAANGPLKGILAYTEDDVVSTDMNGDNHSSIFDAKAGISLNKNFVKLVSWYDNEWGYSRRVLDLLHYISKVDNKQ

SEQ ID NO: 17054 - protein, 1428 aa, Aspergillus nidulans FGSC A4
MLAPRWLTTAIFVLTYIQKSGGDSQKQPVCLARDWREAVVPLKWPTCVETRWDRWPNGELTTTPTPASHNNLKSTSGSSSVSVSITVEPGPASSLADHELDTESPLDNVNFLSFEDWKKQNLARAGQSAENIGGNRRAGTAEKDRRRPLGINNALDSLGDDVEIELDFGGFGADASEAAKTATDWVTHVPSRGSGGAQVVPDGGRDTAEASGQGVPHAGGERSKDAGTTCKERFNYASFDCAATVLKTNPEAKGSSSVLIENKDSYMLNECRAQNKFLILELCDDILVDTVVLANYEFFSSIFHTFRVSVADRYPAKPEQWKELGIYAARNTREIQAFAVENPLIWARYLRIEFLTHYGNEFYCPLSLIRVHGTTMLEEYKHDGEVNRAEEELAGGVAEPALETETVTEDATKTEVPPPEAPSFHVVNSEIRPSKICPKFVTSVELALLGSVNPQTCGINDTSEESPATEGNKPVLSKTSSSPVIPSAGNAAKAASPEAGDYKASGSSGVNPPNTADTAASGAASSETDSHNATSDQDTRSTAASRDEQGVESIRTTTTQPPSANPTTQESFFKSVNKRLQMLETNSSLSLQYIEEQSRILRDAFNKVEKRQLSKTSTFLENLNVTVVNELKQLREQYDQAWRSVALEFEHQRIQYHQEIHSLSAQLGVLADEIVFQKRVAVIQSIVVLLCFGLVLFTRGAVGSYIDFPSVQNMVSRSYSLRPSSPILGFGSPPGSPGSTRPTSSYRTTPGHRRQVSQDSQDGSVSPTMYAPPTPTSDDSRLGPDERGTTSPSPEGARSLAEVAPPLLRSNSSPPDLNGENEGGCEKNHEDLDSDPECSGFETGGDDTLAESPVTVMMQQFQCPTTKETSITSLKMNSNPLTARSPNTHLAVSNEQDLKTASSTTDLMDYHRQKLQGKIENQDKQQASYVSPSDDIMSPCSKKLSDLKGKRFKNVEQDGKGDEFPLSLNPSSATGPRRPWIWYFPAPLPRLAASTPNNQKSNQQDQVEEFVEKECIPAEALFSAQLGTGEQRWKTNPAVMEELKTKAKKIGLWNMFLPKNHFSQGAGFSNLEYGLMAEYLGKSKVASEATNNAAPDTGNMEVLAKYGNDQQKAQWLTPLLEGKIRSAFLMTEPDIASSDATNIQLDIRREGNEYVLNGSKWWSSGAGDPRCQIYLVMGKTDPRNPDTYKQQSVLLVPASTPGITIHRMLSVYGYDDAPHGHGHISFKNVRVPLSAMVLGEGRGFEIIQGRLGPGRIHHAMRTIGAAERAIDWLIARINDDRKKPFGQPLSSHGVILEWLAKSRIEIDAARLIVLNAAIKIDQGNAKFALKEIAQAKVLVPQTALTVIDRAVQVYGAAGVSQDTPLASLWAMVRTLRIADGPDEVHLQQLGKRENKSRREEVTKRVAWQKEQSDRILTANGFSKLKSLL

SEQ ID NO: 17055 - protein, 510 aa, Glycine max
  misc_feature (181)..(181): Xaa can be any naturally occurring amino acid
  unsure (1)..(510): unsure at all Xaa locations
NITEGSIWPMLAQESLKALGGLGLLSLGAKYILRRVFEVVADTRSSEAFVALCLLTVAGTSLVTQNLGFSDTLGAFLAGAILAETNFRTQIEADIRPFRGLLLGLFFLTTGTSIDMQLLLREWPNVLSLLGGLIVIKTLIITAIGPRVGLTLKESVRIGLLLSQGGEFGFVVFSLANRLGXVLPLELNKLLIIVVVLSMALTPFLNEAGRRAASFIEENFDPENKQNVSETVNFNISEPVVILGFGQMGQVLANFLSNPLASGGDSDEVGWPYVAFDLDPSVVKAARKIGFPVLYGDGSRPDVLHSAGVSIPKAFMIMYTGKKKTIEAVQRLRLNFPAIPIYARARDLKHLLDLKKAGATDAILENAETSLHLGSKLLKGLGVMSDDVAFLSQLIRDSMELQAQEGIGQSEDRGLDIMKPLQVKVAVSREAHVLAATTSPEAELSEMNQNDQASSVRNQREVDPEEQDYELNEAVNLEGNGVLVIKQSSEESSMIVDQSNPSSHTATEEP

SEQ ID NO: 17056 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQAAMMEPFGLAVHASLEGSGVSGLNVLVSGCGPIGLMNIAAAKALGASKVIAPDIHPLRLTAAAKMGADECINATEESVYKTVRSLLGERGVDVAIDYSGQAAALKELIQSITHGGELRLMGVPSHDILLNLEEWLFKGLIVRGLHGRRLYERWERSTSLLVTGRVDLSSLVSHRLPLSAAEDAFEMALNGQSLKILFEPNGSCI

SEQ ID NO: 17057 - protein, 941 aa, Mycobacterium avium subsp. paratuberculosis K-10
MPDHTTFAARHIGPDPQAVAAMLDVIGVGSLDELAAKAVPAGIRDRLSADGIAPGLDRLPPPASETEALAELRGLAEANTVAVSMIGQGYYDTLTPPVLLRNILENPAWYTAYTPYQPEISQGRLEALLNFQTMVADLTGLEIANASMLDEGTAAAEAMTLMRRASRGKSNRLAVDADVFAQTAAIVATRARPLGIEIVTADLRDGLPDGDFFGVIAQLPGASGAITDWAALVAQAHERGALVALGADLLALTLITPPGEIGADVAFGTTQRFGVPMGFGGPHAGYLAVHANHARQLPGRLVGVSLDADGSPAYRLALQTREQHIRRDKATSNICTAQVLLAVMAAMYASYHGAEGLTAIARRVHGHAEAIAAALGTAVVHDRYFDTVLARVPGRADEVIAAAKARGINLWRVDDDHVSVACDEATTDEHVAAVLEAFGVAPAEPVASEIATRTAEFLTHPAFTQYRTETAMMRYLRTLADKDIALDRSMIPLGSCTMKLNAAAEMEPITWPEFARQHPFAPASDTPGLRRLIGDLENWLVAITGYDAVSLQPNAGSQGEYAGLLAIHDYHASRGEPHRDICLIPSSAHGTNAASAALAGMRVVVVGCHDNGDVDLDDLRAKVTEHRDRLSTLMITYPSTHGVYEHDIAEICAAVHDAGGQVYVDGANLNALVGLARPGKFGGDVSHLNLHKTFCIPHGGGGPGVGPVAVRSHLAPFLPGHPHAPELPQGHPVSSAPYGSASILPISWAYIRMMGADGLRAASLTAITSANYIARRLDEYFPVLYTGENGMVAHECILDLRPITKATGVTVDDVAKRLADYGFHAPTMSFPVAGTLMVEPTESETLTEVDAFCDAMIAIRGEIDRVGAGEWPVEDNPLRGAPHTAECLVTTDWDHPYSREQAAYPLGKDFRPKVWPPVRRIDGAYGDRNLVCSCPPVEAFA

SEQ ID NO: 17058 - protein, 183 aa, Prunus mume
GFAFFVCFIMSTGDGSYDYFQFVQQWPPTTCRVRGKCSNPRPIQIFTIHGLWPSNYSNPTTPSNCIGSQFKESMVSPRLRSKLKRSWPNVEGSNDTRFWEGEWNKHGTCSQQTLNQYQYFERSHEMWHFHNITNILKNASIVPHPTQTWTYSDIVSTIKAVTQTTPLLRCKQHKKTQLLHEVV

SEQ ID NO: 17059 - protein, 323 aa, Haloarcula marismortui ATCC 43049
MSYKVVVSDTKVMHGETRAAVLDAVDATVETIAAKEPEAVARAVDGADALIVDAGTQVTAEVIEAADSLKVVGRAGIGMDNIAVRAAVAAGVTVVNVPDYSVEEVSTHTFALMLACLRRIPTFDRSVKRGEWKWAVGQPIRRLAGSTVGLVAFGKLASRFAAKLRGFDIDVIAYDPYAPEYRMGDLGVESVTLETLLGDSDIVSLHAPLTDETRGMIDADALDRMHDDALLVNTARGGLVDETALYDALISGDLGGAGLDVRKPEPPGDSPLHDLDSVVCSPHVAWYSEESRVELTQTVAEDVIRVLRGEQPENPIDPETGWF

SEQ ID NO: 17060 - protein, 335 aa, Haemophilus somnus 2336
MKTLGQFIVEKQAEYPNAKGELSGILSSLRLVAKIIHRDINKAGLTNNIIGNSGVENVQGETQMKLDLFAHNTMKQALITREEVAGFASEEEENFVAFDTERGRNAKYVILTDPLDGSSNIDVNVAVGTIFSIYRRVSPIGTPVTLEDFLQPGHKQVAAGYIVYGSSTMLVYTTGNGVNGFTYDPSLGVFCLSHENIQIPPNGKIYSINEGQYLKFPMGVKKYIKYCQEKDKSTDRPYTSRYIGSLVSDFHRNMLKGGIYIYPSATTYPKGKLRLLYEGNPMAFLAEQAGGIASDGKDRILDIQPKELHERVPLFVGSREMVRKAEEFMREFSEE

SEQ ID NO: 17061 - protein, 180 aa, Prunus mume
GFAFFFCYVMSSGSYDYFQFVQQWPPTNCRVRTKCSKPRPLQMFTIHGLWPSNYSNPTMPSNCNGSQFDARKVSPQLRNKLKRSWPDVESGNDTKFWEGEWNKHGTCSEQTLNQFQYFERSQDMWRSYNITEILKNASIVPSATQTWTYSDIVAPIKTATKRTPLLRCKYDKKTQLLHEV

SEQ ID NO: 17062 - protein, 232 aa, Oenococcus oeni PSU-1
MEKNLQNELKKEAAIRAAEFVENDTVVGLGTGSTVKFLVDELGRKVREENLSFTGVTTSKRTASQAESLGIKIVSLDSIPRIDLTIDGADQVDNNFNGIKGGGAALLWEKIVATNSKKNIWIVDQSKLVDRIGSFPLPVEVIPFGALHVLNKFEELNLNPALRLTENGKKVMTDSQNYIIDLHLNQIIDPAKLSNQLINTVGVVEHGLFLNVVDKVVVGKKGQPLILENPDK

SEQ ID NO: 17063 - protein, 248 aa, Borrelia burgdorferi
MYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 17064 - protein, 181 aa, Prunus mume
GFAFFFCYVMSSGSYDYFQFVQQWPPTNCRARRRPCSKPRPLQNFTIHGLWPSNYSNPTMPSNCKGSQFEARKVYPQLQSNLKIAWPDVESGNDTRFWEGEWNKHGRCSEQTLNLMQYFERSYGMWKSYNITEILKNASIVPHPTQTWTYADIVSPIKTATKRTPLLRCRQDKNTQLLHEV

SEQ ID NO: 17065 - protein, 393 aa, Photobacterium profundum SS9
MRDMQVNLDTIIFELCAIVISTAILGTVFLYARQPIILAYIAAGMLIGPHGLEWIHNAENVSQIGHLGVILLLFLLGLNLQPRKLIRLFKESAMVTLGTCSFFFLCTLGFGLAIQLALHDALVAAAALMFSSTVIGLKLLPTTTLHHKRMGEIMTSILLVQDILAITVILFLNVDSNDGMILAFGMLLLKFSLMCICAYLGVRYVVLPLFSRFDVIQEYSFVTTLAWCLLWAEAGHQIGLSYESGAFIAGLSIAVSRVSQAISIHLKPLREFFLILFFFSIGARMNLTTANIYTLWGCLFGGILILVKAWGFRFALLVAKENPSMNKELGARLSQASEFSLLLAYSAMTAELVSQEGMMFIQAATLSTFVISTYWVVKYYPTPISMVKNLRQD

SEQ ID NO: 17066 - protein, 294 aa, Lycopersicon esculentum
MTYMFKYDSVHEQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYSSRVIDLVCHMAKA

SEQ ID NO: 17067 - protein, 526 aa, Xanthomonas campestris
MSSSCRFRPLSFLLAAALGASAAFAPSVHAADAAPATPRSEGSGVWYEIFVRAWYDTDGDGIGDLNGVTAKLDYLQSLGVSGIWLMPINPSPSYHGYDITDYEGINPQYGTMADFEKLVSEAHKRGIEVILDLVINHTSDQHPWFKAALDPKDAHRSWYTWAGPGTNLKAVSAVGGPAWHANGKQHYLGDFTGAMPDLNYDEPAVRREMIAVGKFWLDKGADGFRLDAARHIYDDLESDNGQPAVIARNAQWWNEFRQGLRQVRPDVYLVGEVSAKQPGELAPYLPALGSVFDFPLAEQLIASAGQEKAGKLPALLTETYAAFRAAAGDDYADAPFLSNHDQERVLSQLGGDLRHMRTAAAMLLTLPGRPYLYYGEEIGMLGRKPDENLREPMRWQRQAGAPGDSRWKPYSVKQGGEVSVQAEQDRPDSLLSFYRTLIHWRVEVPALRDGALRVVDTGAPALVAYERVTADSRALVVHNLSGKPASMKLGADRAKAFAAIRLHSAPGATLTEGRLTVPAYATVVLQ

SEQ ID NO: 17068 - protein, 388 aa, Glycine max
MAMASAKLNTLSSQWIAHNSFSPRRGSSSRRVSLPIRASSYQHELVQTAKSIASPGRGILAIDESNATCGKRLASIGLDNTEVNRQAYRQLLLTTPGLGEYISGAILFEETLYQSTTDGNKFVDCLRDQNIVPGIKVDKGLVPLPGSNNESWCQGLDGLASRSAEYYKQGARFAKWRTVVSIPCGPSALAVKEAAWGLARYAAISQDNGLVPIVEPEILLDGDHPIERTLEVAEKVWSEVFFYLAENNVLFEGILLKPSMVTPGAEHKEKASPETIAKYTLTMLRRRVPPAVPGIMFLSGGQSEVEATLNLNAMNQSPNPWHVSFSYARALQNTVLKTWQGHPENVEAAQKSLLVRAKANSLAQLGRYSAEGESEEAKKGMFVKGYTY

SEQ ID NO: 17069 - protein, 433 aa, Arabidopsis thaliana
MRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 17070 - protein, 520 aa, Magnetospirillum magnetotacticum MS-1
MSNASPRRPRPVVLCILDGWGWREDSADNAITQADTPNWDRFLASYPHSLLQSSGLQVGLPDGQMGNSEVGHMNLGAGRVVMQDLPRIDTAVADGSLAANPELTKAIAAVKARGGAMHLMGLLSPGGVHSHQDHLAALARTIADAGVTVQVHAFLDGRDTPPSSAKGFMERFLAAVKGHDVHLATVSGRYYAMDRDKRWDRVSLAWNAMVEAKGVAGADPLAAIAASYADSKTDEFMLPAVIGSYAGMKDGDGLLMGNFRADRAREILDCLVNPAFDGFARARQVSFAARLGLTEYSKDLNAFLGTLFGPETLDNILGEVLSRAGLKQLRIAETEKYAHVTFFFNGGREMVFPGEERILVPSPKVATYDLQPEMSAAEVTDKLIAAIEGGTFDVIVVNYANGDMVGHTGFMKAAIAAAQTVDACLGRLETAVKTAGGTMLVTADHGNAEQMKDPVTGEPHTAHTTGPVPAVLVAPPAGIDGIGDGRLADVAPTLLALLGLPQPAEMGGQSLLRQSLRAAG

SEQ ID NO: 17071 - protein, 832 aa, Chlamydophila abortus S26/3
MEIQKSLLAYPLIRRLMNFDKNLVNVETMKQAILNRLYFGVVRSPESASARDIFTAVAQTVMEWLAKGWLKTQNSYYEQDVKRVYYISMEFLLGRSLKSHLLNLGMLDLVRDALEELHYDFDTLIQMEADAGLGNGGLGRLAACYLDSMATLGIPAYGYGIRYDYGIFDQKIVNGYQVEAPDEWLRYGNPWEICRGEYLYPVRFYGRVIHYTDARGKEVADLVDTQEVLAMAYDVPIPGYGIETVNTLRLWQAQSPHGFEFNYFNHGNYIRAIEDIALVENISRVLYPNDSISEGQELRLKQEYFLVSATIQDILRRYTKTHISLDDLPNKAAVQLNDTHPALGIAEMMHILVDREELPWDTAWDMTTRIFNYTNHTILPEALERWSIDLFSRLLPRHLEIIYEINSRWLEKVSQRFPGNDDKRRALSIIEEGCDKHVNMASLAVVGSSKVNGVSAFHSHLIKTTLFKDFVEFFPDKFINVTNGITPRRWLALCNPRLDALLEETIGSAHITDLSQIHKVLPFADDASFREQWHKIKLNNKQDFALKLKKEIGENIDPSSMFDFHVKRIHEYKRQLMNILRVIYLYNDLKENVSSSIVPTTVIFAGKAAPGYAFAKLIIKLINSVADCVNNDPKVNQVLKVLFLPNYRVTMSEMIMPASDISEQISTAGMEASGTGNMKFALNGALTIGTMDGANIEMSEYIGRDNMFIFGLLEEEIAKIRREYYPQAICNNNPKIAHVLKLLDQGFFNTSDKDLFKPIVHRLLHEGDPFFVLADLESYIKVHESAATLFQHTEEWVKKSIYNVGGMGFFSSDRAIADYARDIWNVPTHHKS

SEQ ID NO: 17072 - protein, 182 aa, Brassica napus
  misc_feature (112)..(112): Xaa can be any naturally occurring amino acid
  unsure (1)..(182): unsure at all Xaa locations
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGXSTPGYYDGRYWTMWKLPLFGCTDSAQVLKEVQECKTEYPNAFIRIIGFDNNRQVQCISFIAYKPPSFTGA

SEQ ID NO: 17073 - protein, 315 aa, Zea mays
  misc_feature (28)..(28): Xaa can be any naturally occurring amino acid
  misc_feature (149)..(149): Xaa can be any naturally occurring amino acid
  unsure (1)..(315): unsure at all Xaa locations
MRWFYHKGSSGFSSASTAEDVTAGVDAXGLVAVITGASSGIGLETARVLALRGVHVVMAVRNVSAGLDAREAIVAKIPVARIDVLELDLSSVASVRRFASNFDSLNLPLNILINNAGVMTRSCTRSYDGLELHFATNHIGHFLLTNLLXLENMKKTCRDSGIEGRIVNLTSSAHSIIYREGICFDKIHDPSSLNDFVAYGQSKLANILHCNELSRILKEDGMNISANAVHPGVIMTNLFRNRNIVSALLNSIGRIICRTVEQGAATTCYVAMHPQVRGISGKYFTNCDVANPSSQASDAELAKKLWQFSLQIVSS

SEQ ID NO: 17074 - protein, 265 aa, Glycine max
MAIPYPHFIATEKAAMDAGLLHPSSPSSVILTQDDLKKIAAYKAVEYVESGMVLGLGTGSTAKHAVDRIGELLRQGKLKDIVGIPTSTKTHDQALSLGIPLSDLDSHPTVDLAIDGADEVDPFLNLVKGRGGSLLREKMVEGACKKFIVIVDESKLVNYLGGSGLAMPVEVIQFCWRFTAARLQKLFQEAGCVAKLRTFAEKDEPYVTDNGNFIVDLYFERSIGDLKAASDAILQLAGVVEHGMFLDMATTVIVAGELGLTVKNK

SEQ ID NO: 17075 - protein, 713 aa, Aspergillus nidulans FGSC A4
MATSTPAPQSSLPQSAVLMPPCSKSRSRGSAESRPSIHNVQGHVPACLVNASVTYCGNDQIYAFGGFDQYTDEVYNHVLRLNLKTLRWDLVDNYGDIPGVRMGHTANLYQDNKLIVFGGENEHGEYLSDVIIFDVPTSTWTQPEVRGQVPRGRARHAAVIHEDKLFILGGSESSGILDDMFYLDLKTWTWSRPWKFTARFDHLAWVWGGRLWTFGGLDPDMEKTTDIWWLDLQAIPASGTPDHQGTMDTPARIGSAAHSLDNNIYSNMGQQLPGRSGSYAANSASVQVRNASRRKSIAPGSISCLQFKSGPNVPSLFSGTHFQAFASGVLLDLITPSETTPIRDCNLSSLELDSARWQKLVDGQEIFRPGYRWHYLTVDTSGTKAWLLGCSLDPGNTPGSGDENHMSQVLSIDLERYGLLGNEMSALSPDPRKAAVLGRAQVGPLSGLGADLSTAFDRPPESGSGADFTITANSDDHIYTDSNAEDGFSERSTSTFLPENAATSPPIHVHKLILQLRWPHFKRLYSAQMVEYHTNRMHIPEPYSVVRAFLYYLYTDSIAGHPEYCADIIDVAGMLVMANLYDLPRLRLLCVSRLGRELDVENAAIIWDRAGRTNEEWLMRRAAQFCLNHWGRVVRTDGFRSLSRESIIDLCEVVDMEGRIVAGPELELVGTLGADDGLGSGRELKRSSQLTLNGVTLDGDEADADEMDGVEDI

SEQ ID NO: 17076 - protein, 489 aa, Salmonella typhimurium LT2
MGSKTKTTEAPALRRELKARHLTMIAIGGSIGTGLFVASGATISQAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 17077 - protein, 569 aa, Salmonella typhimurium LT2
MSEEKLGQQYLAALHQAFPGVVLDEAWQTKDQLTITVKVNYLPEVVEFLYYQQGGWLSVLFGNDERQLCGHYAVYYVLSMEQGTKCWITVRVEVDANKLEFPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHSHLLNLGLACHFTGFDSGFMQFFRVRETSMKMAEILTGARKTYGLNLIGGIRRDLLKEDMIQTRQLAQQMRRDVQELVDMLLSTPNMEQRTVGIGRLDPEIARDFSNVGPMVRASGHARDTRADHPFVGYGLLPMEVHSEQGCDVISRLKVRINEVYTSLNMIDFGLDNLPGGPLMVEGFTYIPHRFALGFAEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 17078 - protein, 734 aa, Oryza sativa
MEEWHRFGRTGVYRTFMFSSPTILAVTPEACKQVLMDDEGFVTGWPKATVTLIGPKSFVNMSYDDHRRIRKLTAAPINGFDALTTYLSFIDQTVVASLRRWSSPESGQVEFLTELRRMTFKIIVQIFMSGADDATMEALERSYTDLNYGMRAMAINLPGFAYYRALRARRKLVSVLQGVLDGRRAAAAKGFKRSGAMDMMDRLIEAEDERGRRLADDEIVDVLIMYLNAGHESSGHITMWATVFLQENPDIFARAKAEQEEIMRSIPATQNGLTLRDFKKMHFLSQVVDETLRCVNISFVSFRQATRDIFVNGYLIPKGWKVQLWYRSVHMDDQVYPDPKMFNPSRWEGPPPKAGTFLPFGLGARLCPGNDLAKLEISVFLHHFLLGYKLKRANPKCRSRSEMDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSALMWHNQMLMWYNRVLMRLKLYKVGASVPCMRPSHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDG

SEQ ID NO: 17079 - protein, 364 aa, Oenococcus oeni PSU-1
MATSAVSVGFSSYLAGLLQTDHISGFNSILAGPMEGGIINLPAVVLLLVILGIQIIGLSTTRWVENVFVAIKLAILAIFIIVGLFFIKSNNYVPFYPKEFQTGAFGLSGIWMATSGIFFAFIGFDTLAAHTAEVKNPKKQVARGIIYTVIVAAVLYTLFAIVLTGMVNYTKLNVSDPASFAFTFVGQKGLASVIGIGSMIGMFTGVLALVFASSRLIYSFGRDGLLPNFIGKISGSQHVPFNALLIAGVVEIILAGFVPLSYLASLINAGTLAAFTFVNFGIIPLRHRTDLPNENGFRVPGYPIIPIIGGLTSFFFITQLETKTLVMFGVWTLVGLLIYFTYGVRHSMVKESKFDQSIIKENNA

SEQ ID NO: 17080 - protein, 515 aa, Glycine max
MAKPRRSKMMSLKLPFLLTLFLALSQAQPHSDDPPPPPSSNVCVIGAGIGGSSVAHFLRKYSPSSTPSTKIRVFERNGRVGGRIATVTVAGETFEAGASILHPKNLHTVDYVKILKLKVKEPTASEDSLSLGIWDGNKFVFKTVSPLSSTVPLIDKLLKLPFVNTLVSFVNSALMFVRYGFSLFKMQNFVEIAVDKFVKYYEDPGSRPIFETVDEMLQWAGLYNLTTRTLRDELVDAGLSTSLINELVTVITRINYGQSVSMSGLGGVVSLAGSGGGLWSIEGGNWQMAAGLINQSDVALHLHEEIKSVADLGDYYELNSTKGNSYRCEVAVVATPLDELDIQFIPPISIPERKLQHTFTTFVRGLLNPAYFGLKAVTKIPDLVGTIEDPELPFSCIAVLKKHNEKESTYKLFSRQPMADTLLDSIFSVRKETIRINWAAYPHYHAPEVFAPFILDGRHLYYVNAFENAASTMETSAVAAENIARLILSRYFGQVIVHSSNLSASSQGEGTHLDL

SEQ ID NO: 17081 - protein, 486 aa, Microscilla sp. PRE1
MIMSTVKNYKLYIDGEWIDATTGESQEILSPTDETVVGTVQMGVEADAQIALEAAERAQKQWKKVPARKRADLLRTFAAEIKANKNQLAELLVREQGKLLAVAKMEVEVTASFIEYACDGARSIEGDIIPSDNPAEHIMIHKIPRGVVVAITAWNFPLALAGRKLGPALVAGNSVVLKPTQETPIATLELGNIANKVGLPKGLINILTGQGSVLGNALVANPITKMVSMTGSTPAGQQIFRTAAENLIHVQLELGGKAPCIVFDDADLEQAVEGAFHSRFDNCGQVCTSNERLYVHESIYNEFMERFMEKVKGLKLGNPMDAATTIGPKVNAKEVAHMEHLVTKSVEEGATVAIGGKKPQGKAFEKGHWFEPTILTDVKQNMTIVHEESFGPILPVIKFSEFNEVIGYANDCEYGLAAMVFTNDMNKIMRLNDELEFGEIYINRGHGEQHQGFHNGYKLSGTGGEDSKYGFEQYMEKKTFYIKYKA

SEQ ID NO: 17082 - protein, 304 aa, Chlamydomonas reinhardtii
MDIAQVDEIIERLLDVRNGRPGKQVQLAENEIRLLCLTAKEIFMSQPNLLELEAPIKICGDIHGQYSDLLRLFEYGGFPPEANYLFLGDYVDRGKQSLETICLLLSFKIKYPENFFLLRGNHECASINRIYGFYDECKRRYNIRLWRTFTDCFNCLPVAALIDEKILCMHGGLSPELKSLEQIKRITRPTDVPDSGLLCDLLWADPDKDIQGWGENDRGVSYTFGPDCVTEFLQKHDLDLVCRAHQVVEEGYEFFAKRQLVTIFSAPNYCGEFENAGAMMSVDETLMCSFQILKPAETKAKGRR

SEQ ID NO: 17083 - protein, 397 aa, Wolbachia endosymbiont strain TRS of Brugia malayi
MSDLAKRMLLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYGELEGIAQVLLEYPHVNIITDDIYEHIIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATSQEQLEIGCNSIIKACKMLS

SEQ ID NO: 17084 - protein, 462 aa, Zea mays
  misc_feature (30)..(30): Xaa can be any naturally occurring amino acid
  misc_feature (286)..(286): Xaa can be any naturally occurring amino acid
  unsure (1)..(462): unsure at all Xaa locations
MDPCPFVRVLVGNLALKMPASAPPAAAARXGSGVHPATPPCYYCRIRLNKMPYQTASAPLLPATEEGSAPAPAPASCAAAFHASKADLDRAAARPAAALLLAARRRRTARLKVAVYAGRGGGVSASCGGGGATSGRLLGKVVLPLDLRAAMAKPVVFHSGWFDIGKRGAGKPAAANAARAQLNLTVLGEPDPRFVFEFDGEPECSPQVLQVKGSMKQPMFTCKFSCRSNSDLRSRSVQSDSGAVGPRNWLAKLWSERERERAGKERKGWSVTVHDLSGSPVALASXMVTPFVASPGTDRVGRSNPGGWLILRRRVDGTWTPWGRLECWRDRGGSAGDAQLGYRFELVPDHNSNVTGTGVCVAESGVPAARGGRFAIDLTTAGSPGRGSGELSRHALWPPGGFVMSAAVQGEGRRGRPSVEIGVAHVGCAEDAAAFVALAAAVDLSMDACRLFSCKLRRELSA

SEQ ID NO: 17085 - protein, 485 aa, Moorella thermoacetica ATCC 39073
MKTEPLLFELGAPGRQGYTLPECDVPGKVEDYLPEATRRRSDAALPELSEVEVVRHFTHLSTMNYGVDTGFYPLGSCTMKYNPKINEATANLPGFTGLHPLVPVEAAQGALELMYNLQEYLAEITGMDAITLQPAAGAHGEYTGLAVIAAYHQSRGDRERRQVLVPDSAHGTNPASAAMAGLEVVQIPSDEGGLVDLEALKAAVGPRTAALMLTNPNTLGLFESNIEAMAAIVHAAGGLLYYDGANLNAIMGLTRPGDMGFDVVHLNLHKTFSTPHGGGGPGSGPVGVKEHLAAFLPVPVVARREDGQYYLDYDRPQSIGQVRSFYGNFGVMVKAYTYIRSLGAPGLKRVSQQAVLNANYMLARLRPYFKVPFDRLCKHEFVIAPSQEVTDAGVHTLDIAKRLLDYGFHAPTIYFPLIVREAMMIEPTETEPRENLDAFCDALIAIAKEAVENPEALHQAPHNTPVRRLDEVGAARNPVLRWRGR

SEQ ID NO: 17086 - protein, 349 aa, Bacillus cereus
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKISCFT

SEQ ID NO: 17087 - protein, 444 aa, Moorella thermoacetica ATCC 39073
MTYIPTTAAEQQQMLAACGAHRMEELFSDVPASVRLGRELNLPRPMAEAEVWRHLEELAGKNKKLVSFLGAGAYEHYIPSVVGHLLARSEFYTAYTPYQPEISQGTLQAIFEFQSLICELTGLDVATASHYDGATAMAEAALVACNATRRQKILVSRSVNPQYRTVLSTYAKGQGVELAEVPLQDGRTDLEALEKLAGKDVAGVILQNPNFFGQIEAMAEATDLAHKARALGIAVVDPVSLGLLAAPGEYGADLAVGEGQSLGNPLNFGGPYLGFIAAREKLVRRLPGRIVGQTKDVDGKRAYVLTLQAREQHIRREKATSNICSNEALCALAATIYLAAMGREGLKEVASQCLLKAHYAQKKLAALPGVTPVFNGPFFHEFVLQTKLSPATVARRLAENGFAAGFDLGRFYPELKNALLFTVTEVRTREEIDALVAAMRGILA

SEQ ID NO: 17088 - protein, 297 aa, Triticum aestivum
  misc_feature (195)..(195): Xaa can be any naturally occurring amino acid
  misc_feature (226)..(226): Xaa can be any naturally occurring amino acid
  misc_feature (280)..(280): Xaa can be any naturally occurring amino acid
  misc_feature (287)..(287): Xaa can be any naturally occurring amino acid
  misc_feature (292)..(292): Xaa can be any naturally occurring amino acid
  unsure (1)..(297): unsure at all Xaa locations
MDGGGGVGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFSKELRLDTKVFYFDIGENKRGRYLKVSEASVNRNRSTIIVPAGSSGEEGWEAFRNVLLEINDEASRLYVLPNHPSQQPLEPSRAPFLAFSDEXLGAGIYRLGHGQPNSAFWNPEVDMLMGPSYXRNFSGGGLSKVIRADQKRVFFDLGSNNRGHYLRISEVAGADRSSDILPLSGLSXHEMVGHXVDIMXDRLEG

SEQ ID NO: 17089 - protein, 419 aa, Aspergillus nidulans FGSC A4
MSNQLVGISQGTVFERVIQEVCDASQVDFEESGVDQQTLSDLRKSWQKKLSSLGVAHFPWDPAPPQAPAQTQNQQVLPPTATVPSNAPRPPQASVHQQQHLPPQQSHTQHPQLQNPQHVSHPQSMPPNGPPLQAQTPVGPNGGHPMGHSPQIKTEPGVNGHPALPPMSHMMAVPPNAQSARERATNLIQQRYGAAAASSVSQMQAQSQSPMGLPRPSSMQHMQQMQQMQQMQQMPNGQNPQIKQETGYHPVSHPSVSNAQTDGTASDALSEWKAEVTRRREAAQDGEGDRALRNHLKQQMLRLEGGGLMVPLDERESQPKAPRFASADSSGSKAQFDGPGGDDTKEEDDEDAINSDLDDPDDLVAQDDEDDDAVGQVMLCTYDKVQRVKNKWKCTLKDGILTTGGKEYVFHKGQGEFEW

SEQ ID NO: 17090 - protein, 506 aa, Vibrio sp. Ex25
MTALHISHAEELKASHDMMAIMKDVRLVRGLAYVNGKWVSGDQFHPVDNPADGTVIGYITKLSQQQLYQAIDEADQAFRQWRKMQAEERAEILMRWHDLILESKQDLARLMVMEQGKTLGDALGEIDYGASFVRWFAEEARRSYGETIPSHIPNAQLSTVREPIGVAALITPWNFPNAMVTRKAAAALAIGCPVLIKPASETPFSALALAELADRAGFPPGVFNVITGDAVMVSQTLCHSDKVKALSFTGSTRVGKLLLRDAAQTVKKCSMELGGNAPFIVLPDMDVEQAAKAAVDAKFQTAGQDCLAANRIFVPDDKYEAFLEAFAKEMNHIVLGNGLDEKTTMGPLINRAAVDKAHDLVRDALDKGARLVAGYHQPVPGENFFAPTLLADVTPDMAVYREENFCPVAGVLPYQDLDTVIEMSNDTEYGLAAYVYGHDIHQIWRCMRGLEFGMVSVNSVKMTGHPIPFGGVKQSGLGREGSRHGFEEYSEIKYCCLGALPTVSGS

SEQ ID NO: 17091 - protein, 352 aa, Aspergillus nidulans FGSC A4
MAAPQGYPLLCLENPLLDIQAVGDDSLLEKYGLKANDAILAEEKHMGLYEELLQHRDAKLIAGGAAQNTARGAQYILPDNSTLYIGCVGKDKYADILQDACKKAGVHTEYRVDDAQPTGKCGVIITGHNRSMCTHLAAANEYKVDHLKQPHIWSLVEKAQYYYVGGYHLTVCVPAIQALGEEAAAKNKVFMLSLSAPFIPQFFKDQLDSVLPYTDYTFCNETEAVAYAESHEWGTTDIVEIAKKLAQLPKKNTNRSRIAVVTQGTLPTITATVTTSGEVEVKEFPVHEISKDAINDTNGAGDAFAGGFVAGVVQGKSLEESVDLGQWLAKLSIQELGPSYPFPKQTYTSGRS

SEQ ID NO: 17092 - protein, 277 aa, Chlamydomonas incerta
MRRQAVTCLRGLWRAGTASQEVANQAGASSFALQGLLAQQERGLRTSVDAKDAKIAPLSAMPWSLQAARSATAEALAPAKVNNFTLNFGPQHPAAHGVLRLVLEMQGEIIMRADPHIGLLHRGTEKLLEYKTYLQGLPYFDRLDYVSMMCMEHSYVLAIEQLLNLSVPLRGQYIRVLFSEITRVLNHLLAITCHSMDVGALTPFLWAFEEREKLFEFYERVSGARMHAGYFRVGGVSQDLPIGLLRDVYDWARQFGLRLDEMEELLTGNRIWKERTV

SEQ ID NO: 17093 - protein, 357 aa, Bacillus subtilis
MTSYLSDYVQQIKPSGIRKFFDLAATMEGVISLGVGEPDFVTAWNVREASILSLEQGYTSYTANAGLYSLREEISRYLSNRFDLSYSPDNELIVTVGASQALDIAIRAIVNPGEEVIIPEPCFVAYDALVSLAGGIPVHVHTTADKGFKATAADFEAAVTEKTKAILICSPSNPTGSVYSKEELNEIAEFAKKHDVIVLADEIYAELTYDEEFTSIAALPGMKERTVVISGFSKAFAMTGWRLGFAAAPSLLRDAMLKIHQYAMMCAPAMAQFAALEGLKNGMEDVEKMKKSYRRRRNLFVESLNEIGLSCHHPGGRFLCFSIYQKHGNEFKNSLPEELLTQEKVAVVSWKCVWSER

SEQ ID NO: 17094 - protein, 295 aa, Anabaena
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 17095 - protein, 581 aa, Burkholderia vietnamiensis G4
MELYGSARSFTGSGCWPHRRNIFLFFYLRLTSSCKNFPEASALNITECRRFYCRFTSCYKRALTLIEESVIMNAPAVAAVAADTPPSSAATDAALRVAVQPVILAGGSGTRLWPMSREHYPKQLIGLLGDHSLLQSTALRLDGLAASHPVNDDVLIVCGEDHRFTTAEQLRVTGKRASIMLEPLGRDTAPALTLAALRIVADGSDAVMTVMPADHAVADRARFHAAVAAGVHCAAQGKIATMGIVPARAETGYGYIRVGAPLGDAATGGLDVRRLDRFVEKPHLELARQYVESGEYWWNSGIFIVRASVWLDAIRRLEPEIHAACEQAVANGKQDGDFFRVDRDAFAASPSNSIDYAVMEPLASQPQLCESVVVPLDAGWSDVGSWDAIWQILPKDDAGNVGRGHVLFENADSTFAHAESRLVACVGTQNLVVVETPDAVLVADKSRVQDVKKIVGRIKAERGAEATDHRKVHRPWGHYDSVDMGERFQVKRIVVKPGARLSLQMHHHRAEHWIVVRGTARITRGDETFLLSENESTYIPLGVSHRLENPGKMPLELIEVQSGAYLGEDDIVRFDDTYGRQ

SEQ ID NO: 17096 - protein, 249 aa, Escherichia coli
AVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 17097 - protein, 868 aa, Oryza sativa (japonica cultivar-group)
MMVTWPWRALPLAAVLFLFLSPAASVDTVTMEAPLAGNRTIVSAGGTFTLGFFTPDVAPAGRRYLGIWYSNILARTVVWVANRQSPVVGGSPTLKINGNGSLAIVDGQGRVVWASPVMSASVLSAGSAKAQLLDNGNFVLRFASAGVAWQSFDYPTDTLLPGMKLGIDFRTGLDRYMNSWRAADDPSPGEYSFRIDPSGSPEFFLYRWSTRTYGSGPWNGYQFSGVPNLRTNTLLSYQYVSTADEAYYRYEVDDSTTILTRFVMNSSGQIQRLMWIDTTRSWSVFSSYPMDECEAYRACGAYGVCNVEQSPMCGCAEGFEPRYPKAWALRDGSGGCIRRTALNCTGGDGFAVTRNMKLPESANATVDMALGLEECRLSCLSNCACRAYASANVTSADAKGCFMWTADLLDMRQFDNGGQDLFVRLAASDLPTNSVSDNSQTAKLVEIIVPSVVALLLLLAGLVICVIKAKKNRKAIPSALNNGQVTPFGQRNHTASALNNWEITPFWQRNHVAASNDAQDNNSMRPAGQGNHQDLDLPSFVIETILYATNNFSADNKLGQGGFGPVYMGRLDNGQDIAVKRLSRRSTQGLREFKNEVKLIAKLQHRNLVRLLGCCIDGSERMLIYEYMHNRSLNTFLFNEEKQSILNWSKRFNIINGIARGILYLHQDSALRIIHRDLKASNILLDRDMNPKISDFGVARIFGTDQTSAYTKKVVGTYGYMSPEYAMDGVFSMKSDVFSFGVLVLEIVSGKKNRGFYHNELDLNLLRYAWRLWKEGRSLEFLDQSIAGTSSNVTEVLRCIQIGLLCVQEQPRHRPTMSAVTMMLSSESPALLEPCEPAFCTGRSLSDDTEASRSNSARSWTVTVVEGR

SEQ ID NO: 17098 - protein, 341 aa, Yersinia pseudotuberculosis IP 32953
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVITDVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 17099 - protein, 248 aa, Ralstonia solanacearum
MHKLVLIRHGESTWNLENRFTGWVDVDLTDTGIAQARQGGRLLREAGFTFDLAYTSVLKRAIRTLWHVQDEMDLMWIPTRTEWRLNERHYGGLSGLNKAETAAQYGDQQVLVWRRSYDTPPPALEAGDERDAYGNPRYAGLPREQVPLTECLKDTVARVLPLWETSIAPDIKSGKRVVIAAHGNSIRALVKYLDNISDDDIVGLNIPNGTPLVYELDANLKPIRHYYLGDQEAIAASLAAVAGQGKAK

SEQ ID NO: 17100 - protein, 433 aa, Ralstonia solanacearum
MSSPSRSVSLFERAQKTIPGGVNSPVRAFRSVGGTPRFIAKAAGPYLWDADGTRLIDYVGSWGPMIVGHAHPEVVRAVQQVAADSFSFGAPTEAEVVMAETLCELVPSIEQVRLVSSGTEATMSALRLARGFTGRDLIVKFEGCYHGHADSLLVKAGSGLLTFADTTQNAPSSAGVPEDVVKHTMVLPYNDADALREAFARHGKEIAAVIVEPVAGNMNLVRATAAFLQAMRALCTEHGAVLIFDEVMTGFRVALGCAQALYGITPDLTCLGKVIGGGMPAAAFGGRRDIMGFLAPLGSVYQAGTLSGNPLAVAAGVTTLRLIAADGFHDRLAAQTRKLVDGLAGIARDAGVPFAADSVGGMFGLYFREGVPTSFAEVTQSDVGRFNAFFHAMLAEGVYLAPSAFEAGFVSSMHDDAVLEATFEAARRAFKAV

SEQ ID NO: 17101 - protein, 276 aa, Burkholderia vietnamiensis G4
MSNSRQHQGHFARKRFGQNFLVDHGVIDSIVATIGPVRGQRMVEIGPGLGALTEPLIARVATPESPLHAVELDRDLIGRLQQRFGALLELHAGDALAFDFGSLAAPGHAPSLRIVGNLPYNISSPLLFHLMTFAPVVIDQHFMLQNEVVERMVAEPGTKAFSRLSVMLQYRYVMDKMLDVPPESFQPPPKVDSAIVRMIPYAPHELPDVDPVLLGELVTAAFSQRRKMLRNTLGAYRDTIDFDALGFDLARRAEDVSVAEYVGVAQALARTRNVAQ

SEQ ID NO: 17102 - protein, 206 aa, Brucella melitensis
MSRTLVLVRHGQSEWNLKNLFTGWRDPGLTEQGHAEAKAAGQRLKAAGLKFDIAYTSALSRAQVTCQHILDELGQPGLETIRDQALNERDYGDLSGLNKDDARAKWGEEQVHIWRRSYDVPPPGGESLKDTGARVWPYYLHTIQPHVLREETVLVAAHGNSLRALIMALEGLTPEQILKQELNTGVPIIYRLNADSTVASKEILSA

SEQ ID NO: 17103 - protein, 1042 aa, Arabidopsis thaliana
MSNRSLHLKKISWLSSRILSDNVHGRFRRSITTPATCLAPSLDGDMNIGSKTLVEQRFSRGFASVRRVSRASSSSSSSPSSPHVDLLSFIKASLDKLEGPSHHWLNRDFGNKQLFKDKGTYVVLAGHLLDGTSDLSGFFEKLKLLQQRSPGVCFMGIHFSDQARIADDRTALAELILKEYLTFPVLLSEKEFPKTSGEVRYIVFKDFKNPLIYEEKDLDIASVVKALDSLLTQDTEKSKSVRLFTNTWSKQAEAIKESHFPSFFQDLLLYFPGFEDGDFESAKMLRPTGTLYDEAEDCLYIVDSEVIKKTGGLWSWIMEKMGLGKDDDTTVDADTKSEEFDARSLLFPWHILKRDDESLLVINKSFSKLWIINFASGEIEEVVEGFSKIIEICGQSITEKLSVLEHMPSNWLQQQTAAIASFKEQPSASLLSSFTKLGDDIVMTDIACQRVLKLNRDSGACSSIQFSNKLMEFRKHISVILRNSGYCQFITPVPISCIMKMIPPCTELVEPIQESCIWRQTRGAISEFSSAGSAVEPSEKIGVSQQWYDELDSLAKEIANPEAAEEEEEEDVNPSEVDREEDGRIHIDCPVKTSPGSSELIVYAALYLRLARNEETESATQEELARKIAKILKPVRNITTMKEDLFVNLLSKSKRELRDIVFIKPMHVRIRLDSKDHPKADNSRDVILTDSSVEKKVPRDSDNSYRRNGEVTGRDNNKTHPENPKTVNEQNKNNDEDKEVTNNIAAQTFSFRELATATKNFRQECLIGEGGFGRVYKGKLEKTGMIVAVKQLDRNGLQGNKEFIVEVLMLSLLHHKHLVNLIGYCADGDQRLLVYEYMSRGSLEDHLLDLTPDQIPLDWDTRIRIALGAAMGLEYLHDKANPPVIYRDLKAANILLDGEFNAKLSDFGLAKLGPVGDKQHVSSRVMGTYGYCAPEYQRTGQLTTKSDVYSFGVVLLELITGRRVIDTTRPKDEQNLVTWAQPVFKEPSRFPELADPSLEGVFPEKALNQAVAVAAMCLQEEATVRPLMSDVVTALGFLGTRS

SEQ ID NO: 17104 - protein, 427 aa, Robiginitalea biformata HTCC2501
MRYKRSSELFRQASRVLPGGVNSPVRAFKSVGGTPVFVREAAGSRFTDEDGNEYIDFIASWGPLLFGHAFPPVVEAVTRRAQKGTSFGMPTALETEVAELAVSMVPGIEKIRFVNSGTEACMSVIRLARGYTGREKIIKFAGCYHGHADAFLIEAGSGAVTFGSPNSPGVTQGTARDTLLARYNDLESVKGLFEANPGEVAAVILEPVAGNMGCIPPEPGFLEGIRQLCTDSGALLIFDEVMTGFRLAAGGAQEALGISADLVAFGKVIGGGLPVGAFGGPAEIMSHLAPEGPVYQAGTLSGNPLAMGAGLAMLRAIEADPEVFSRLESKTAYLHEGLEHVLQEAGHPYRINRFGSMISVHFSDREVRDFESAATGNNDRFRNYFHGMLNRGVYLPPSAFESYFLNDALTAEDLDLAIDAAAGALKD

SEQ ID NO: 17105 - protein, 206 aa, Malus x domestica
HGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDL

SEQ ID NO: 17106 - protein, 279 aa, Desulfotalea psychrophila
MRKTVVDIIAMKAAGQKISMLTAYDASMSALLDQAGIDILLVGDSLGMTVLGYDSTVPVTMADMVHHMAAVRRGAPDAFVVGDMPFGSYQTGARDAVLNAMRLLKEGGCDVVKLEGGEVVCPVVKAIVDAGIPVMGHLGLTPQTAAVLGGYKVQGRDMEAARKLFADAKRLEEAGVCGLVLECIPAGLAEVVTASIAVPTVGIGAGKGCDGQVLVINDMLGLFEKFTPKFVKHYAQLAPLVRQGVENYIGEVRAGAFPEAEHTFTSSCDYKVLLSGDDQ

SEQ ID NO: 17107 - protein, 480 aa, Thermoplasma volcanium GSS1
MEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 17108 - protein, 567 aa, Solanum demissum
MESSVRGVDEAAIMKSSTRRKNGGWITFPFIIVSATMAGLSLASGGWTSNLIVYLIDEFNMKSIKTAKVYNVINGCTTLFPIVGGILADSYLGSFSVIWFSSLISALGILLLLFTSAIDVLRPPPCDDGSSLCTSPSTHQYAVLYVALALASLGVAGTRFIIAPMGANQFDKPKHQAIFFNWYIFAFYMSFAISTTVIVYVEDNVSWSWGYGISMAFNILGLAMFLIGKRFYCDVKEQGGSPFVNLARVIVVAIQKWRVPLSEQTQHYYHDPSDTTTTLTITQIPTKSFKFLNCAAFITEGDTKPDGSISNPWRLCTVQQVEDLKSLIKLFPLWASGFLISTQLVIQASLLILQALKMDRHMGPHFEIPAGSMLVFILLFTCIAIFIIDRFLYPFLAKYTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAHYLGNTLIDLVQRLSGWLPDNINKGRTDNVFWLCCILGSANFMYYVVCASLYKYKNVDNKSNIAPSK

SEQ ID NO: 17109 - protein, 409 aa, Helicobacter pylori J99
MAQNFTKLNPQFENIIFEHDDNQMILNFGPQHPSSHGQLRLILELEGEKIIKATPEIGYLHRGCEKLGENMTYNEYMPTTDRLDYTSSTSNNYAYAYAVETLLNLEIPRRAQVIRTILLELNRMISHIFFISVHALDVGAMSVFLYAFKTREYGLDLMEDYCGARLTHNAIRIGGVPLDLPPNWLEGLKKFLGEMRECKKLIQGLLDKNRIWRMRLENVGVVTPKMAQSWGMSGIMLRGTGIAYDIRKEEPYELYKELDFDVPVGNYGDSYDRYCLYMLEIDESIRIIEQLIPMYAKTDTPIMAQNPHYISAPKEDIMTQNYALMQHFVLVAQGMRPPVGEVYAPTESPKGELGFFIHSEGEPYPHRLKIRAPSFYHIGALSDILVGQYLADAVTVIGSTNAVFGEVDR

SEQ ID NO: 17110 - protein, 392 aa, Moorella thermoacetica ATCC 39073
MFEKIFADKMANLGTETAFMVLAKAKALEAQGKEIIHLEIGEPDFATPRNIIDAGIRALNEGYTHYTPAPGLPEVRATIAEYATRQKGVHYDPEEVVIVPGGKPIMFFTILALVNPGDEVIYPNPGFPIYESVINFVGGKAVPLPIREENDFRLDVDELAGLITPKTKLLIINSPANPTGGVLTAEDIGRIADLVRGKNIVVLADEIYDRIVYDGARPVSIAAQPGMKDWTIILDGFSKTYAMTGWRIGYGLMHRELADRIAQLMVNSNSCTAAFTQKAAQEALTGPQDAAEAMVAEFKKRRDIIVDGLNSIPGITCKRPLGSFYVFPNIKGLGLSSQELEAFLMEKAGVAALSGTAFGKYGEGYLRLSYANSVENIEKALEKIAAAVKELR

SEQ ID NO: 17111 - protein, 443 aa, Streptomyces avermitilis MA-4680
MSTSHASAASARETTEGTVYTVTGGDWDEVVQSAAKSDDERIVVNMGPQHPSTHGVLRLILEIDGETVTEARCGIGYLHTGIEKNLEYRTWTQGTTFVTRMDYLTPFFNETAYCLAVEKLLGIENEIPDRASIIRVLLMELNRMSSHLVCIATGGMELGATTIMIYGFRDRELILDIYELITGLRMNHAYIRPGGLAQDLPPGAVDQIREFVKKMKKNLPEYDKLATGNPIFKARMQDVGYLDLAGCMALGATGPILRSAGLPHDLRKSQPYCGYETYDFDVPTADTCDSYGRFLIRLEEMRQSLRIVEQCLDRLAPGPVMVADKKIAWPAQLALGPDGLGNSLDHIKKIMGTSMEALIHHFKLVTEGFRVPPGQTYSAVESPKGELGVHAVSDGGTRPYRVHFRDPSFTNLQAMAAMCEGGQVADVIVAVASIDPVMGGVDR

SEQ ID NO: 17112 - protein, 459 aa, Bacillus subtilis subsp. subtilis str. 168
MKMKPPVEKNEYYDVTFEDLTHEGAGVAKVQGFPIFVPNALPEEKAQIKVTRVKKGFAFGRLIELKEESPHRTDAPCPIYKQCGGCQLQHMTYEGQLLFKQKQVKDVLERIGKLDLSKVTVHPTLGMEDPWNYRNKAQVPVGEREGGLVAGFYQQRSHDIIDMSACLIQQSKNDEAVQAVKDICANYGVKAYNEERHKGWLRHIMVRYGVVTGEMMIVFITRTSDFPHKAKIIEDITAQFPHVKSIVQNINPNKTNVIFGNETNVIWGEEYIYDLIGDVKFAISARSFYQVNPEQTKVLYDKALEYAELQGEETVIDAYCGIGTISLFLAKQAKKVYGVEIVPEAIEDAKRNAELNGNTNAEFAVGEAETVIPKWYEEGITADTLVVDPPRKGCDEALLRTIVEMKPKRVVYVSCNPGTLARDLRVLEDGGYVTREVQPVDMFPHTNHVECCVLIKLKE

SEQ ID NO: 17113 - protein, 135 aa, Oceanospirillum sp. MED92
MALERTFSIIKPDAVAKNVIGKIASRFESNGLKIVEMQMKHLTQEDAEGFYAEHKERPFFGDLVAFMTSGPVIVQVLEGENAIALNRELMGATNPQEAAEGTIRRDFAQSIDANAVHGSDSPASAEREIAYFFGK

SEQ ID NO: 17114 - protein, 355 aa, Zea mays
  misc_feature (283)..(283): Xaa can be any naturally occurring amino acid
  unsure (1)..(355): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEPTLNLNAMNXLSTKKPWALSFSFGRALQASTLKAWAGKVENVEKARAAFLARCKANSEATLGTYKGDAAADTESLHVKDYKY

SEQ ID NO: 17115 - protein, 243 aa, Clostridium acetobutylicum
MRKLVLLRHGQSEWNKENRFTGWTDVDLSVDGVSEAAQAGRILKKNNYTFDAAYTSVLKRAIRTLQIVLYEMDLLWIPVYKSWKLNERHYGALQGLNKDETRDKYGEDQVHLWRRSVEVRPPALEKSDKRYPGNEKKYASLKEEELPVTENLEDTEKRVLQDWRELIAPNIKGGKNIIISAHGNTLRALVKYLDNIPSDGIANLNIPTGTPLVYELDENLEPITRYYLGMDGKIEDDKFPKKV

SEQ ID NO: 17116 - protein, 3980 aa, Bacillus subtilis
MYTSQFQTLVDVIRERSNISDRGIRFIESDKNETVVSYRQLFAEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYKPDADELAFIQFSSGSTGDPKGVMLTHHNLIHNTCAIGNALAVHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAPFNLKRSAILNVYGLAEASVGAAFSKLGEEFVPVYLHRDHLNLGERAVKVSKEDQNCASFVEVGQPIDYCQLRISDETNERVEDGIIGHIHIKGDNVTQGYYNNPESTEKALTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLDGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKAAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLMSGDCEMALAGGIRTSLLPICIGLDMESSDGYTKTFSKDSDGTGTGEGAAAVLLKPLQDAVRDGDHIYGVIKGSALNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEVSEFTSGDEPLRGGVSSFGFSGTNAHVVLEEYISQSEYAPEDEHEPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLNRAAELFVQGAVIDWRALYSGETVQKTPLPLYPFERSRCWAEADQLRLNEGEKRGEAALNINQSKAHIESFLKTVISNASGIRGEELDLNAHFIGLGMDSIMLSQVKKAIADEFGVDIPMDRFFDTLTNLQSVIDYLADTVPSSFASAPPQENVPAQEKQVISEAQLESDRRDGHQEHTLEKIIASQNQLIQDALQAQLNSFNLLRNSGHHSDEKEYAKAQEKSIPSVKQGPPTVNAEQKAAQEAKPYVPFQPQNLNDQGHYTARQKQYLEDFIKKYAGKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHYNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNHCFEQAQVPIRMVRFGSLFRFVSSLDNDLFFYHLNYKGVYVWEGRNCFLSVAHTADDIENIIQAVKDTVEDLRRGGFIPEGPDSPDGGGRKKSGTRELSPEQKQLVMASHYGNEASAALNQSIMLKVKGELQYTSLKQAVRHIVDRHEALRTVIHPDDEVQQVQERMNIEIPVIDFTGLPHEHREPEIQKWLTEDAKRPFHFHEQKPLFRIHVLTSAHNEHLIVLTFHHIIADGWSIAVFVQELESNYAAIVQGKSISPKEADVSFRQYLDWQQAQIDSGQYEEGVRYWRRHFSEPIQQPILPSADSVRYPNGYEGDRCTVRLGRPLSEALRSLSIQMKNSVFVTMLGAFHLFLHRLTKQSGLVIGIPAAGQSHMKQHDLIGNCVNMIPVKNTSSSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFSDEEQQDLQALYGEHQKRVSSIASNTANFTEAYEAPVNETERQLARIWEELFGLERVGRSDRFLALGGNSLQATLMLSKVQKTFHQKVSIGQFFNHQTVKELARFIQNETKVVHLPMKTAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLMHHIISDGYSVNILTNELLALYHQKPLPDIEFEYKDFAEWQNQRLNDDAMKRQATYWLEQFQDEIPILDLPTDGSKAAERSSEGQRVTCSLQPDVIRSLQDLAQKAETTLYTVLLAAYNVLLHKYTGQEDIVVGTPASGRNHPDIERIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLAEQPEMTLSSVPMLSETERHQLLTECNGTKTPYPHKETVYRWFEMQAEQSPDHEAVIFGNERYTYRQLNERANRLARTLRTKGVQADQFIAIISPHRIELIVGILAVLKAGGAYVPIDPEYPEDRIQYMLRDSRAEVVLTQRSLLDQLPYDGDIVLLDEENSYHEDHSNLESDSDAHDLAYMIYTSGSTGNPKGVLIEHQGLANYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKSVSEQFKGRLDIFNEYGPTEAVVGCMIYHFDAERDKREFVPIGTPAANTDIYVADASRNLVPFGVIGEIYISGPGVARGYWNRPDLTAEKFVENPYVPGAKMYKSGDLAKRLKDGNLLYIGRVDEQVKIRGHRIELGEIEAAMHNAEAVQKAAVTVKEEEDGLKQLCAYYVSDKPIAAAQLREQLSSGLPDYMVPTYFVHLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGTIDPERLNAAFRKLIARHEALRTSFDLYEGEPAQRIHQNVDFTIERIQASEEEAEDRVLDFIKAFDLAKPPLMRAGLIEIEPARHVLVVDMHHIISDGVSVNILMKDLSRIYEGNEPDPLSIQYKDFAVWQQSDIQKRIIKSQEAYWLDQFHGDIPVLDMPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNPDHAELTFDSLQIKPYPFHHPVAKFDLTLSIQADRDNYHGLFEYTKKLFKKSRIEILSNDYLHILSAILEQPSILIEHIGLSGSNEEEENALDSIQLNF

SEQ ID NO: 17117 - protein, 58 aa, Zea mays
  misc_feature (28)..(28): Xaa can be any naturally occurring amino acid
  unsure (1)..(58): unsure at all Xaa locations
WRASLSRSLKEIRVLFCQSSPASAAARXNYGDIKARNPSLPFLVRECSGVQPQLWARY

SEQ ID NO: 17118 - protein, 183 aa, Oryza sativa
MSSMESSCLPATTESIAKAQEAKDASESISILYRVLQDPSSSAEALRTKELAITNLTNYLTKENRAEELRNLLTQLRPFFSLIPKAKTAKIVRGIIDAVAKIIGTSELQISLCKEMVEWTHAEKRTFLRQRVEARLAALLLENQEYTDALTLLTDLIKEVRRLDDKLLLVDIDLLESKLHFSL

SEQ ID NO: 17119 - protein, 285 aa, Aspergillus oryzae
MPSTPSLPSMGMLALGAMQLAAGAVFEFPSCPKDIPFSCQNSTAVADSCCFNSPGGALLQTQFWDTNPPSGPSDSWTIHGLWPDNCDGSYGQFCDKSREYSNITAILQEQGRTELLSYMKKYWPNYEGDDEEFWEHEWNKHGTCINTIEPSCYKDYSPQKEVGDYLQKTVDLFKGLDSYKALAKAGIVPDSSKTYKRSEIESALAAIHDGKKPYISCEDGALNEIWYFYNIKGNAITGEYQPIDTLTSPGCSTSGIKYLPKKSENSTASAWKFRSDKASQSVRFN

SEQ ID NO: 17120 - protein, 817 aa, Vibrio parahaemolyticus RIMD 2210633
MKPTQQKQFDKKSFQDSVKKHLSVTYAHTVENADSRAWYLAMGRALAEFTTFDLLATETDPRIQQAKSVNYLSLEFLIGRLTGNNLISMGLYEQVTEAMAELGHNLTDLLEEERDPSLGNGGLGRLAACFMDSCAAQEFPTVGYGLHYEYGLFKQSFKDGRQQEAPDAWRGVEGYPWEVARPELAQEIGFYGHVEVVNVDGKEVRKWVPGMSVKAMPWDLPIVGYESDTVYPLRLWECQAIAPFSLASFNNGDYFEAQHALIDAGNITKVLYPNDNHEKGKTLRLMQQYFHSAASVRDILRRHEAAGYSLADLPKQETIQLNDTHPTIAIPELMRILMDEKGLTWEAAWEISSKTFAYTNHTLLPEALETWPESLIQHLLPRHMEIIYEINHRFLQDVRAMWPGDVAKQQKLSIIEEGFHRMVRMANLCVIGSYAVNGVAALHSELVKKDLFPEFHEMYPTRLHNVTNGITPRRWLKFCNPGLSQLITEKVGAEWPAKLEQLEGIAKYATDATFQKEFMAVKKENKERLANWVKEHMGIELDTNAIFDVQIKRLHEYKRQHLDLLHVLSLYHRILNEPGFECTPRVVFFAAKAAPGYHLAKEIIFAINKIADKVNNDPRIGNKLKVVFIPDYRVSMAEIIIPAADVSQQISLAGKEASGTGNMKMALNGALTIGTMDGANVEIREEVGDENIYIFGLDVEGVKALKAQGYNPFDYYNADHLLKASMDLLLGEEFTPGQPGLLRATYDSLLDGGDPYLCLADFASYVKAHEEMGKQYKDQAGWAKKAILNTALVGKFTSDRSIRDYVNNIWKLEAVHR

SEQ ID NO: 17121 - protein, 543 aa, Solanum demissum
MESSVRDVDESAIMKSSTRRKNGGWITFPFIIDEFNMKSIKAAKVYNVINGCTTLFPIVGGILADSYLGSFSVIWFSSLISALGILLLLLTSAIDVLRPPPCDDGSSLCTSPSTHQYAVLYVALALASLGVAGTRFTIAPMGANQFDKPKHQAIFFDWYIFAFYTSFAISTTAIVYVEDNVSWSWGYGISMAFNILGLAMFLIGKRFYRDVKEQGGSPFVNLARVIVIAIQKWRVPLSEQTQHYYHDPSDTTTTLTKTQIPTKSFKFLNCAAFITEGDTKPDGSISNPWRLCTVQQVEDLKSLIKLFPLWASGFLISTQLVIQTSLLILQALKMDRHMGPHFEIPAGSMSVFILLFTCIAIFIIDRFLYPFLAKHTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAYYLGNTLIDLVQRLSGWLPDNINKGRTDNVFWLCCILGSANFMYYVVCASLYKYKNVDNKSNIAPSK

SEQ ID NO: 17122 - protein, 150 aa, Pseudomonas aeruginosa
MALQRTFSIIKPDAVSKNVIGEILTRFEKAGLRVVASKMVQLSEREAGGFYAEHKERPFFKDLVSFMTSGPVVVQVMEGEDAILRNRELMGATDPKKADAGTIRADFAVSIDENAVHGSDSEASAAREIAYFFSSTEVCEALPDSANERG

SEQ ID NO: 17123 - protein, 375 aa, Solanum demissum
MAGLSLAAGGWTSNLIVFLINEFNMKSIAAAKVFNVVNGLTTIFPIVGGIIADSYLGCFSVIWISSLISALGILLLLLTVVIDALRPLACGDGSSLCTSPSTNQYVFLYVSLALASIGVGGTRFTVAPMGAYQFDKPKHQTMFFDWYIFIFYLCWALSTAFIVYVEDNISWAWGFGISMACNILGLAIFLAAISIIDRILNPFLAKYTTFSLTPLQRVGIGHALTISCMAVSALVESRRLRVARSHHLQGQKDAIVPMSVFWLLPQLALNGIGEGFHFPGHIAFYYQEFPTSLKNTSTAMVSLFIGIAFYLGNVLIDVVQRETGWLPDNINDGRMDNVFWLCCTLGSVNFIYFLLVASFYKYKNMESKPNNVPSK

SEQ ID NO: 17124 - protein, 393 aa, Methylococcus capsulatus str. Bath
MSIRLSDRVQSIKPSPTLAVTARAAAMRAAGKDIVGLGAGEPDFDTPDHIKQAAIQAIEKGFTKYTAVDGTPGLKQAIQAKFKRENGLDYALDQILVSCGGKQSFYNLAQALLNPGDEVVIPAPYWVSYPDMVLLAGAVPVIVEAGQQQAFKITPAQLEAALTARTRLFVINSPSNPTGMAYTAEELAGLGEVLRRFPEVVIATDDMYEHILWEGGFSNVLNVCPDLYERTVVLNGVSKAYSMTGWRIGYAAGPERLIEAMTNIQSQSTSNPTSISQVAAEAALNGEQGFIAGMVEAFKQRHDFVVGRLNAIPGVDCLKTHGTFYVLPNVEAAMARLHLADDVALSEYLIEQGGVAVVPGSAFGAPGHVRLSIATSMANLEKAMERLATTLSK

SEQ ID NO: 17125 - protein, 328 aa, Ashbya gossypii ATCC 10895
MMDKLDLDQLPYYDPRVERKVALVTGGNSGIGWYTVLHLYMHGFIVYVGGRNSSRVHKAIKEIKQEAENRLETARQDPHDELERCLGELRYLPIDLTDLRSVEKAAKKFRAQESTLDVLINNAGVMALPYELTHDGFEVQMQTNYVSHFLLTMRLLPYVKRSGGRVVTLSSIGHKIQFTYCPLDCHFDYRPNIFFTWLRYAMAKTAAIQFTKMLAIKHPDVMCIAVHPGLVMNTNLFSYWTRLPIVGIIFWIFFQIVGFCFGVSNEEGSIGTLKSALSPALTLERDNGKYFTTGGVESRPSSVANNLDNAASTWIWTVHQLRDRGYEI

SEQ ID NO: 17126 - protein, 999 aa, Candida albicans SC5314
MFTKSTIRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIKSRAENIGVEIVEIPLATKQGVEELSRIADKVCGALVQYPDTNGEITDFTEIGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLRELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 17127 - protein, 376 aa, Symbiodinium sp. CS-156
MGDEEVAALVVDNGSGMCKAGFAGDDAPRAVFPSIVGRPKMPGIMVGMDQKDSYVGDEAQSKRGVLTLKYPIEHGIVTNWDDMEKIWHHTFYNELRVAPEEHPVLLTEAPLNPKANRERMTQIMFETFNVPAMYVAIQAVLSLYASGRTTGIVMDSGDGVSHTVPIYEGYALPHAILRLDLAGRDLTEYMMKILTERGYSFTTTAEREIVRDVKEKLCYIALDFDSEMKAASESSDKEKTYELPDGNIITVGSERFRCPEVLFQPSFVGKEASGIHDTTFQSIMKCDVDIRKDLYANVVLSGGTTMFQGIGERMTKELTALAPSTMKIKVVAPPERKYSVWIGGSILSSLSTFQQMWISKGEYDESGPTIVHRKCF

SEQ ID NO: 17128 - protein, 274 aa, Methylococcus capsulatus str. Bath
MKHKTLGFIGAGNMASSLVGGLVADGYPARTIWVSDVDEAKLDALSLKFGVNVSGDNRQVARLAEILILAVKPQILREVAEGLADIVAETRPLVLSVAAGVAESSLDRWLGGDQALVRCMPNTPALVKSSATALHANGKTTSAQRSEAESILRAVGVTVWVEREEALDAVTAISGSGPAYFFLLMEAMENAAASLGLDPETARLLVQQTALGAARIAIESEEGPAQLRQRVTSPKGTTERAIGVFEERGLHEIVRDAVAAAHARAVELARELGA

SEQ ID NO: 17129 - protein, 374 aa, Chlorobium tepidum TLS
MKQIADKHVYAVVMAGGIGSKLWPLSRKKSPKQFLHFFDGGTMIRKTVERIAGAVRRENILIITGKQHRRLVNDSLPDFDVDNIIIEPTIKDTATCIALATTFIRKRDPDAVTIVLPADHLVLDEEHFLKTVSKGVRLARKQRGLITVGIHPDRPETRYGYIQVEPSVMIGEENDDPDDDDIALFRVKTFAEKPDLATAEHFLQSQDFWWNSGVFIWHVDDISREYSRSLPDLYEDMQNVHAFIGTERQESVIEDVYSWVHPVSIAYGIMEKAEKVYMLAGNFGWTDLGCWDEVIKIGLGLEGRDMDGSESIMIDSKNVFVRKPHGKAVVSIGVDDIIVVDTPDALLICKAGESQKVVKAVEMMRREPGLEGFL

SEQ ID NO: 17130 - protein, 331 aa, Methylococcus capsulatus str. Bath
MSAASGFSAAARRLLSLLADGGFHSGETIAASAGCSRTGVWKRIEELRALGVEVHAVPGMGYRLAHPLELLDGEVIAGALTGTAAEAIGLIEVHEQLDSTNDHLMRRAAEGAPAGTVCLAERQSAGRGRIGRTWVSPLSGNVYLSLLWRFGRAGFSGLSLAVGVAVVRALRAQGIGDAALKWPNDILWSRRKLGGILIEVRGEANDQYAVVIGIGLNVNLPDSHAVAIDQDWIDLARIPGGAAVSRNRLIAGMLNELAPLLTDYETTGLAPYLEEWRGYHGFEGAQASVQQGDWVWTGRIVGVSAEGLLLLACEDGPVREFASGDVRVRPL

SEQ ID NO: 17131 - protein, 493 aa, Thermoplasma acidophilum
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 17132 - protein, 248 aa, Candida glabrata CBS 138
MARTFFVGGNFKLNGTKKSIKEIVDRLNTASLPENVEVVICPPATYLDYTVSLVSKKQVTVGGQNTYTKASGAYTGENSVDQLKDVGAKWVILGHSERRTYFHEDDKIVAEKTKFALDQGLGVILCIGETLEEKKAGVTLKVVERQLDAVIAEVKDWTNVVIAYEPVWAIGTGLAATAEDAQDIHHSIRSYLAEKLGKDTAEKTRILYGGSANGANAGTFKDKADVDGFLVGGASLKPEFVDIINSRN

SEQ ID NO: 17133 - protein, 472 aa, Arabidopsis thaliana
MAATLTGSGIALGFSSSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHAKSFLVKAGSGVATLGLPDSPGVPKAATSDTLTAPYNDIAAVEKLFEANKGEIAAIILEPVVGNSGFITPKPEFIEGIRRITKDNGALLILDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 17134 - protein, 92 aa, Arabidopsis thaliana
  misc_feature (2)..(2): Xaa can be any naturally occurring amino acid
  misc_feature (5)..(5): Xaa can be any naturally occurring amino acid
  misc_feature (7)..(7): Xaa can be any naturally occurring amino acid
  misc_feature (52)..(52): Xaa can be any naturally occurring amino acid
  misc_feature (62)..(62): Xaa can be any naturally occurring amino acid
  misc_feature (74)..(74): Xaa can be any naturally occurring amino acid
  misc_feature (81)..(82): Xaa can be any naturally occurring amino acid
  misc_feature (91)..(91): Xaa can be any naturally occurring amino acid
  unsure (1)..(92): unsure at all Xaa locations
SXATXVXSPAQATMVAPLNGLKSSAAFPATRKANNDITSITSNGGRVNCMQXWPPIGKKKFXTLSYLPDLYRFXNWLRKFXXLIRNKWDPXF

SEQ ID NO: 17135 - protein, 433 aa, Streptococcus pyogenes M49 591
MNEKVFRDPVHNYIHIDNPLIYDLINTKEFQRLRRIKQVPTTAFTFHGAEHSRFSHCLGVYEIARRVTAIFEEKYADIWNKDESLVTMTAALLHDIGHGAYSHTFEALFHTDHEAFTQEIITNPETEINAILVRHAPDFPDKVASVINHTYPNKQVVQLISSQIDCDRMDYLLRDSYFSAANYGQFDLMRILRVIRPVEDGIVFEHSGMHAVEDYIVSRFQMYMQVYFHPASRAVELILQNLLKRAQHLYPEQQAYFQKTAPGLIPFFEKKANLADYIALDDGVMNTYFQVWMASEDHILSDLASRFINRKILKSVTFDQDSQGELERLRQLVESVGFDPDYYTGIHINFDLPYDIYRPELENPRTQIEMMQKDGSLAELSQLSPIVKALTGTTYGDRRFYFPKEMLELDDLFAPSKETFMSYISNGHFHFSQ

SEQ ID NO: 17136 - protein, 240 aa, Oenococcus oeni PSU-1
MRKPIIIANWKMNFLRDQANLYVKKLIKKLGNKENIEVGIASQDLFLTDLIKLTENTPISIVAQNAYWENFGPFTGETSPKALANVGVDYVMLGHFERRELFNETNSTVNLKVRTALNNGMDVIVDVEELEQVAPVLEGVSEEQMQQIIIGFEPTFAIGTGMSASTKGAEDVAEQIRKTVRKLYGSDVADSTRILYGGSVNRDNLKSLIKQKDIDGVLVGKAALDFQSFWELVEIIENSL

SEQ ID NO: 17137 - protein, 469 aa, Vibrio angustum S14
MSVENVLALIQENEVKFIDLRFTDTKGKEQHISIPSHQIDADFFEEGKMFDGSSVAGWKGINESDMVMMPDASSAVLDPFTEDATLNIRCDILEPATMQGYDRDPRSIAKRAEEFMRSTGIADTVLIGPEPEFFLFDDVKFNTDMSGSFFKIDDVEAAWNTGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFSGDKYGGLSEMALYYIGGIIKHARAINAFANPATNSYKRLVPGFEAPVMLAYSARNRSASIRIPVVPSPKARRIEVRFGDPAANPYLAFAAMLMAGLDGIQNKIHPGEAMDKDLYDLPAEEAAEIPTVAESLQGALQALSDDREFLTSGGVFSDDFIDSYIALKSQDVEKVNMTTHPLEFELYYSV

SEQ ID NO: 17138 - protein, 441 aa, Frankia sp. CcI3
MAVRGSRGPVPGDGGPPLVGYTLRYLHDPAQHWRQRYDRYGPVSWERTFGLRVVSLLGPDATGLALRNHEQAFANGPGQQRIAGPFFRRGLSMLDFDEHRHHRRILAGAFAPDRLRGYLAGMNPSIERGVAGWRPGARFQVYPAVKQLTLELATRIFMGERLGPEADRFNAALFACIRAPGAVVRVPAPGLRWSRGLAGRRYLEEFLRLRVPAKRAGSGTDMFSRLCHAEAEDGSRLSDDDVVNHMILMMVAAHDTSTITMTSMSYYLARHPEWQQRCREESLALGTPAVDHADLDRLPSLALVMKEALRLVTPVPILLRATVKDIDVLGVTVPAGTVAALALAFTHQMPEYWPSPERFDPERFADHRREDKVHPYAWQPFGGGPHTCIGLHFAGQQVKAILHQMLLRYRWSLAPGYRISLDRFPLPVPRDGLPVQLEKIT

SEQ ID NO: 17139 - protein, 477 aa, Corynebacterium glutamicum
MAFETPEEIVKFIKFIKVEFVDVRFTDLPGTEQHFSIPAASFDADTIEEGLAFDGSSIRGFTRIDESDMNLLPDLGTATLDPFRKAKTLNVKFFFHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDYPHRSDVFTEDLIEAYIQYKYDNEISPVRLRPTPQEFELYFDC

SEQ ID NO: 17140 - protein, 202 aa, Ustilago maydis 521
MWRRRWSVTELVLFTLLLISTIYHLHSRTLRSHPSPPLNSTCPSSTALFKMATEQTYIMIKPDGVQRGIVGEIIKRFENRGYKIAALKMVHASEEHLEKHYKDLKGKKFFPGLIKYMASGPVVCIVFEGKDAVKTGRVLLGATNPLDSAPGTIRGDFAIDVGRNVCHGSDSVESAKAEIALWFGEQNPTIQYTRAVDSWIYE

SEQ ID NO: 17141 - protein, 348 aa, Magnaporthe grisea 70-15
MLKGTIIVTGANGGLGSAIANKLLLEAQYAEYHMIFTVRNVEKANVLQEVINSHRGKGLSSSNDVVPLDLTSLASGRKLADDINARVAAGSIPPIRALVLNAGWQEWTTESFTKDGFEMAFQSNYLTHWLLTVKLLQSMDKNKGRIVVLGSWSHDPDHPGNNYQGFYKGEQWRQLHPNTEAVAKGTFSKPESLPAGGHGFRRYGAAKLCQIMMVYELQARLDADPALSKIAVLGVDPGAMPTPLTRRANPFFVLVGRAIFPILIFLSGLFSKNPEFRSSKKSAKDVMAAALSEDEPYGHSPKAVYYNGDEISTSSAESRDKRKGLELWRSSVEYTGLTEGETCLRNWR

SEQ ID NO: 17142 - protein, 311 aa, Magnaporthe grisea 70-15
MASQKFDPDSDIPSLSGKVILVTGGNIGLGQESILQLAKHDPKRIYLAARSEEKARKAMEAIEQKIGAAKSSVITFLPLDLGSFDSVRKAADTVKSQTDELHILLNNAGIMMTPAAKTKDGYEEQFGVNHMGHALLTRLLLPLLEKTAKSGADVRIVNLSSSGEMLAATDCFKDMSRYKTTMEDVQTVKRYGAAKLANVYHAQMLAQKYPSIKAVSLHPGVVKTNLMSRMKESWPILGPIVSSIISNVFCTSVADGVRNQLWAAVSNDVVSGEFYHPVGLLGKGSPATKKVKEAENLWEWTEKELDAYLNK

SEQ ID NO: 17143 - protein, 277 aa, Brassica napus
  misc_feature (215)..(215): Xaa can be any naturally occurring amino acid
  misc_feature (275)..(275): Xaa can be any naturally occurring amino acid
  unsure (1)..(277): unsure at all Xaa locations
KVVRAVGLRKKDMMGGADPYVKIKLSEDKIPSKKTTVKHKNLNPEWNEEHKFSVRDPQTQVLEFSVYDWGQLGKHDKMGMNVLPLKEMVPNEHKTFTLELRKTMEGAEEGVQPDKDRGKLEVELLYKPFTEEEMPKGFEESQSVQKAPEGTPAGGGVLAVIVHSAEDVEGKHHTNPYVRIYFKGEERKTKHVKKNRDPRWEEEFTFMLEEPPVRXKLHVEVLSTSSRIGLLHPKETLGYVDIPVVDVVNNKRMNQKFHLIDSKNGKIQIEPEWRXTS

SEQ ID NO: 17144 - protein, 458 aa, Arabidopsis thaliana
  misc_feature (372)..(372): Xaa can be any naturally occurring amino acid
  unsure (1)..(458): unsure at all Xaa locations
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSAHYQNGGSIPQQDGASDAIPEANFECAALRITYVGDRKIPRDLIGSSSKIPQVDGPMPDPYDEMLSTPNIYSYQGPNEEFNEARTPAPNEIQTSTPVAVPNDIIEDDEELLNEDDDDDELDDLESGEDMNTQHLVLAQFDKVTRTKSRWKCSLKDGIMHINDKDILFNKATGXSSTSDLDTSNASRKVRVLQMSDTDLRVRDMIIYGNMYSGWLVVQKEQIFPAEEGLSTLTCFMSSIFSFTQWKLTFQKKKKKKKGGR

SEQ ID NO: 17145 - protein, 502 aa, Gibberella zeae PH-1
MVALEEVEGSLLQKPCDAAHEVPSRSASAYKPLNSFALDKQRSYKQQYGDMYFLRLTKIKPAVDQVAATAWDGTTVGDEEAQRVDRVLDVRQGELCYVTGTVYMEMPLKPNILEDVSKDRWISAPILTPKYFSDDDQIMLEDESGRIRLVGDILKTVQLVTGCIVGVMGTENSNGEFEIIDIKFPDLPPQPERWSLSKPVSDKSKTKDEDEEMTDVSDKKKGNKKIAIVSGLSFSGTDASYALELDLLLEYLLGEALGSSGQIDVSHISRLIIAGNSISTTDRQPAAADETLPEKKGQKKYGYDASTYNPLPSQLFDAFVAELLPSIPVTMLPGAQDPANASYPQQPVHPAMFPAARAYTRDPAAPVDQPGWFDTVTNPWEAELEGWRVLGTGGQNVDDVFKYVGSDDRLGMMEAMCRWRCCAPTAPDTLWSYPFQDDDPFVMQTCPHLYFVGNQPQFSTKVIHGPKGQSVRLVTVPSFSATKELVLIDTETLEVERIKISI

SEQ ID NO: 17146 - protein, 249 aa, Thiomicrospira crunogena XCL-2
MTFQSTPFHFIEFDEIDSTSGFLKTQLQTGKLHGYNLCTALKQTGGYGQRGREWIHSGPSLAFSLSVPFALPIHLYSFLSSSIALLLRDCLAKNSSESFRVKWPNDVFVSGGKVAGSLLEVTRDRTTKQTYLVIGVGVNLSEIVDEQGNFTAGWVVDLNREQFLIDFSSAIYTLFLDAEDSLKFKLEEWSKYDFFSPNQSVIVYHSEHSKVGLYKGLTHSAEVQVEIEGRIESYQSGAVSIRPLTSEQT

SEQ ID NO: 17147 - protein, 320 aa, Xanthomonas arboricola pv. pruni
VQQHITFPANIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGAKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLTKGGVNLFSGDGYGGLSQMALWYIGGIFKHARAINAFSNSGTNSYKRLVPGFEAPVMLAYSARNRSASCRIP

SEQ ID NO: 17148 - protein, 1037 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNAPTTVKKPPNSVLLKKFSKGKILELEIHAKIPEKRLYEGLHKLLEGWKQYGLKNLVFNITNMIITGKLVNDSILFLRSTLFEIMVLPNGDGRSLIKFNKKTGSTKTLTKLATEIQIILQKEGVLDK

SEQ ID NO: 17149 - protein, 334 aa, Magnaporthe grisea 70-15
MAVLTGSSLDSAAFRSYLDSLVPSTARAELTGSVLPALVHAIGDVSALLRRAHTVAHVGTTNAFGDQQLNVDLAADDVIRAACKSCPSVVTASSEEVPIEEALRSGEVDAAGSSERYTVAYDPLDGSSIIAPNWTVGAILGVWDGATALGQSPRRSMVAAILGVFGPRTTAIVALRVPGIGEPACFELGIDGESLTMVQPNIRLASPPLNTRYFAPANLRAAAECDKYSALVSHFISQKYTLRYSGGLVPDVVHALVKGHGVYISPTTPQSAGKLRRLYELSPIALVVECAGGKAVDSSSGVGVLDVTISDCDERGGVICGNNIEVDLASKYLQ

SEQ ID NO: 17150 - protein, 637 aa, Oryza sativa (japonica cultivar-group)
MTELESDVVVEVGEMSFYLHKFPLLSRSGVLQRMISEYQAPQEDGGGGGGMCTLQLDDIPGGAKAFELAARFCYDVKIELNAHNVVCLRCAAEYLRMTDDYAEGNLITQAESFLADVLANWKDSIKALETCEGVLPTAEDLHIVSRCITALASKACASDAAACSTGHAAASASAVAVAAKNASYDALWNGIGSGGTPRGGGGAAGAAAGCSGMDWWYEDVSFLSLPMFKRLIQAMEGKGMRPESIAGAIMFYAGRFLPGLKRNTSFSNASFGGDCGAGSRSITPRAANVSAPSEGDQRYFLEEIVALLPAKKGVASTRFLLGMLRTAMLLHASPLCRENLERRIGAQLEDACLDDLLVPNLGYTVETLYDIDCVQRILDYFMSSTDGLGTGYTSPAVVEEGSQLGALHAGSPSSLSPITMVAKLMDGYLAEVAPDTNLKLPKFQALAAVVPDYARPVDDGIYRAMDIYLKSHPWLSESEREQLCRLMNCQKLSLEACTHAAQNERLPLRVVVQVLFFEQLRLRTSIAGWFFVSGNAAAGGDGAPQPHPGGSAIVPKGAAAAGQSDADAEADEGKGKELPAEAITDVKARVSELEKECMSMKQEIRRLGKPRRSWSLLTRKCRFGTKVQQAQPTMSSK

SEQ ID NO: 17151 - protein, 448 aa, Oryza sativa
MDNSVSDRSFLIDSDEEDDAAAAVEDGKRRGHGGDESDDGQSIDMYSSVQSPNLSFLGTPTLSRLSNSFLTASFRGKPPEIISGLIKPLLPTTAAAAAADDEGDGRQQQHEDGRKSSQYLLPPRRPSSLQKIPEDQKPLVVGHHEVGPYRQCTYTQGVLNGVNVLCGVGVLSTPYAVKQGGWLGLIILALLAVLAWYTGILLKRCLDSKEGLETYPDIGHAAFGTTGRIVISVILYMELFNIGNIFIGPNVSLQACCIEYLILESDNLSKLFPNAHLTIGTFTINAHILFAILTTLIVMPTTWLRDLSCLSFISAGGVIASIVIVACLFWVGLVDHIEAKDEGTALNLPGIPIAVGLYGYCYSGHGMFPNIYSSMKKRSQFPAVIFTCIALSTVLFAGAAIMGYIMFGESTESQFTLNLPSNLVASKIAVWTTSSLAFSVTSGDKSNN

SEQ ID NO: 17152 - protein, 472 aa, Klebsiella oxytoca
MTTLSHDSTTMPRTQRDTRRMNQFVSIAAAVAGLLFGLDIGVIAGALPFITDHFVLSSRLQEWVVSSMMLGAAIGALFNGWLSFRLGRKYSLMVGAVLFVAGSVGSAFATSVEMLLVARIVLGVAVGIASYTAPLYLSEMASENVRGKMISMYQLMVTLGIVMAFLSDTAFSYSGNWRAMLGVLALPAVVLIILVIFLPNSPRWLAEKGRHVEAEEVLRMLRDTSEKARDELNEIRESLKLKQGGWALFKVNRNVRRAVFLGMLLQAMQQFTGMNIIMYYAPRIFKMAGFTTTEQQMVATLVVGLTFMFATFIAVFTVDKAGRKPALKIGFSVMAIGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGVTFWLIPETKNVTLEHIERRLMSGEKLRNIGN

SEQ ID NO: 17153 - protein, 676 aa, Solanum tuberosum
MAIQKWLLFLFLHLHVLNIVAQLPDLRFGICGKSGNYTENSTYKNDLNTLLTSLSSKIDKYGFYNASIGQNSDRASVIVLCRGDVELDDCRGCVDNVVQKIAQLCPNQKEVFGGYDGCMLQYSNQSIIDTPSLSVQLFLWNTANASKPEEFNQELGKLLENLRDRAAQGGPLQKYATGTTIGPDIQPIYALVQCTPDLSRQSCFDCLTDAYGTLPQCPCLGKTGGRIIGIRCNFRYEISRFFVDVPLEAPPPAGNDNKTVPTGTENKTPPTGKDDKTTRTIIIIVVSTVTIVILMICIAVILIRRRKRKLVNGIQGTSVDDTSIAESFQYDFSAIRAATDDFSDANKLGEGGFGPVYKGKLQNGQEVAVKRLSADSGQGDLESKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWLSWRNGTTIDFVDPMLKESTGLIRDIMRNIHIALLCVQESVADRPTMAAVVLMLSSFSLSLPMPSGPAFYMHSNITAETSLIKEYNTRMTDSSELAKSKSIGSSRNEASISELYPR

SEQ ID NO: 17154 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPGEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 17155 - protein, 483 aa, Pseudomonas fluorescens PfO-1
MIPVILSGGSGSRLWPLSRKQFPKQFLALTGEHTLFQQTLERLVFEGMDTPIVVCNKDHRFIVNEQLASRNLECQRILMEPFGRNTAPAVALTAMMLVNEGRDELMLVLPADHVLEDQKALQRALALATVAAENGEMVLFGVPATKPETGYGYIKSTGDSLLPEGVSRVSHFVEKPDVKRATEYVESGGYYWNSGMFLFRASRFLEELKKHDPDIYDTCLLTLERSQQDADTVTLDEATFACCPDNSIDYSVMEKTQRACVVPLTAGWSDVGCWSSLWEVNEKDANGNVSKGDVVIQDSKNCMIHGNGKLVSVIGLENIVVVETKDAMMIAHKDKVQGVKQMVNTLNAQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPIERGVSVKTIAQ

SEQ ID NO: 17156 - protein, 651 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGSNATKPEEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 17157 - protein, 273 aa, Methanothermobacter thermautotrophicus str. Delta H
MSGLYTETREVLRKYGVRLRRSLGQNYLIDEVKRQRILEYADLREDDRVLEIGPGIGTLTLPMAELAGHVTAIESDPLIAAILMDRLQVDNVDVIVGDALRVDFPEFNKVVSNLPYQISSPITFRLLEHDFELAVLMYQKEFARRMVAEPGTREYSRLSVMVHFLAEVEIVDYLKPGCFFPRPRVESAVVTLKPTGFRAPAFLEDVCRALFQHRKKKTSKSLRESFHEIRTDLSFNEVLRGLPPEILEKRVFQLRPEDILEIAEHIEDLSGSS

SEQ ID NO: 17158 - protein, 244 aa, Archaeoglobus fulgidus
MKLRKSLGQHMLVDRRVISRIVGYAELSEDDVVLEVGCGTGNLTSALLRKCSVVGIEKDPLMVKRLRERFSDFIGKGRFRLIQGDALKVDFPYFTKFVANIPYKISSPLTFKLLKTDFRLAVVMYQREFAERLCGEDNRLGVISKTYCKAEILEIVKPSSFNPPPKVESAIVRIVPEPEVFVENRELFEKFVTFAFSMRRKRMGKIVQEFRKRYGVELAVNKNLAEKRPEELGARKFAEIVVGE

SEQ ID NO: 17159 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPEEFNQELGRLLENLRDRAVDDGPLQKYASGNATGPDFQAIYALVQCTPDLSRQSCFSCLSDAYGNMPRRPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERVKSKSIGSSRNEASITELYPR

SEQ ID NO: 17160 - protein, 305 aa, Escherichia coli CFT073
MLGNPLLCRAFAFRHSSVYASASDYQNNEFHGRSEAMEKKIGFIGCGNMGKAILGGLIASGQVLPGQIWVYTPSPDKVAALHDQFGINAAESAQEVAQIADIIFAAVKPGIMIKVLSEITSSLNKDSLVVSIAAGITLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 17161 - protein, 268 aa, Pyrococcus horikoshii
MRDRLFFLLSKYGIRPRDSIGQHFLIIEDVIEKAIETANVNENDVILEVGPGLGFLTDELAKRAKKVYTIEIDQKIIEILKKEYSWNNVKIIQGDAVRVEWPKFNKVVSNIPYKISSPFTFKLLKTDFERAVVMYQLEFALRMVAKPGSRNYSRLSLMAQALGNVEIVMKIGKGAFYPRPKVDSALVLIEPRKDKIVLNENLVKALFQHRRKTVPRALKDSIHMLGVSKDEIRGIINNVPHSNKRVFQLYPEEVKDIEEYLKKHGIIS

SEQ ID NO: 17162 - protein, 241 aa, Triticum aestivum
  misc_feature (196)..(196): Xaa can be any naturally occurring amino acid
  unsure (1)..(241): unsure at all Xaa locations
MSGGHGDARMASGKMAKLKELLDRSENRICADCSAPDPKWASANIGVFICVKCSGVHRSLGTHISKVLSVTLDKWTDDEIDSMVEVGGNSQANAIYEAFLPEGYRKPHPDSAQEDRQKFIKSKYELQEFLEPSLRIVSNHPSDAGKQASNSHSASSKSEIGMVEFIGILNVKVIGGTKLAIRDVSSSDPYVVLTLXGQQKGQTSVIKGNLNPAWNEELKLSGPRKYGPLELQVLDPDRFQH

SEQ ID NO: 17163 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDKGLVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGCKTWLDCLTGEEVHGKQGQLKLTLRPYQGMILWNGR

SEQ ID NO: 17164 - protein, 469 aa, Rhodococcus sp. RHA1
MSNSTAHPYMANSVPALQQEMLDAIGVPTIAELFQQIPTDHRTTRKFDLPPTLGEAELRRHLVNTLAKNRTCEQNLNFLGAGLWQHHVPAACDEVVRRNEWLTSVFGEPSSDHGRNQAWFEFCSQLGELLKLDLVGLPVRSWGSAAGHALRMAARITQRAEVAVVRAIDPERLSVIRNYCEPTEMESHIAVRLIDYDPASGLIDLDDLRAAVGEHTAAVYFETPSYLGVIEHQGAEIAAIARAVGAETIVGVDPISLGVLSSPVDFGADIVVGTTQPLGIHMHTGGGVGGFIASRDEDRYAHQYPTLFISIAETIKPGEYGFGLGLFEQSSYGLRDKGNDWTGHSVYMWAIAATTYMALMGPQGFEDVGGLILQRAHYAAQLLSEIDGVRVAFPSGFFKEFVINFDNTGKTVEEINDALLNIGIFGGKDLTRDFPELGASALYCVTEIHTKADIDRLVGALREVTANEH

SEQ ID NO: 17165 - protein, 386 aa, Glycine max
MPLENRVLDPKKSQNIAILLRALNVTIDEVCDALREGNCDTLGTELLESLLKMAPTKDEESKLKEFQDESPFKLGPAEKFLKVVLDIPFAFKRVDAMLYIANFDSELEYLKKSFETLEVACEELKKSRMFLKILEAVLRTGNRMNVGTNRGDAHAFKLDTLLKLVDIKGTDGKTTLLHFVVWEIVRTEGSHISGSNNNHAADNDHQYTLQDEVDFKKLGLQVVSGLSGELTNVKKTAAMDSDMLSSDVAKLARGIEKIVQVVKLNEESPLKETNQKFSDAMKCFLERGEQEISTIQGQEKNALSSVKEITEYFHGNSAKEEAHPFRIFMVVRDFLSILDGVCKEIGKVNERTLVGSRQSVMPANPIMQTFFPEIIGKQPSDSSESD

SEQ ID NO: 17166 - protein, 273 aa, symbiont bacterium of Paederus fuscipes
MQTAIADVEKVATLYDSAEGQVGPILFGGHMHWGYWDEVTGEGNFANAAERLAQIMIAKAPIKAGQKFIDMGCGFGESALKLAKAKGCFVDGITISKEQQLSAITRAEAEQLQERVRFIHGSALNIPCEDQSYDGGWFFESIFHMGHRKALHEAARVLKPGSTLLLTDLPLLPESTEAFKEFVWEHIHSRFVSREDYPELLAEAEFELIEIDDITDNVMPWLEPKLKEAIELHRPQVEAIIPNDTEKAIDDWLYLFEYMSENLGYMIVMAKKL

SEQ ID NO: 17167 - protein, 136 aa, Brassica napus
PNHVVRCKTQFGWHLLQVLSEREPVKDIQVEELHSKMQDPVFMEEAQLIDVREPDEIASASLPGFKVFPLRQFGTWAPDITSKLNPEKDTFVLCKVGGRSMQVANWLQSQGFKSVYNVAGGIQAYSLKVDPSIPTY

SEQ ID NO: 17168 - protein, 100 aa, Brassica napus
MKGATLVALAATIGNFLQGWDNATIAGAMVYINKDMNLATSVQGLVVAMSLIGATVITTCSGPISDWLGRRPMLILASVMYFLSGLIMLWSSNVYVLCLA

SEQ ID NO: 17169 - protein, 521 aa, Thiomicrospira crunogena XCL-2
MTKAVQIKNRPTGLIILDGWGHREATQHNAIAQAHTPNWDNLLKDYHHTLINTSGLAVGLPEGQMGNSEVGHMNLGAGRVVYQELTRIQKDIDDGRFFENNALVKAIDAASNRDHKVHILGLLSDGGVHSHISHIKASIKMAHDRGAKVYVHIFTDGRDTAPQSALQYIEELETFMKELGGGRIASVTGRYFALDRDNRWERVKKAYDAIACGSAEFEAKDAKEAVELAYARGENDEFIQATVIPRNNGKPARVKDGDSVIFMNFRSDRARQLTEAFIMDDFADFHRCKTPVLSAFVTLTEYKKNFEKFGALVAYRPTSLRNTFGEYVSKKGLKQLRIAETEKYAHVTFFFNGGVEEPNDNEVRILINSPQVATYDLQPEMSLPELKEKLIDAIKSGEYDTFICNIANPDMVGHTGDFNACVQAAEAVDEALGEILATIKAVDGEAIVTADHGNMEMLFNEETGKPLTSHTTFPVPFVYFGKKGYPLKDGGALCDVIPTLLDMMGIEKPEEMTGTSLIDKA

SEQ ID NO: 17170 - protein, 436 aa, Photobacterium sp. SKA34
MSKTSKSADLFAKAQQKIPGGVNSPVRAFAGVGGTPLFIERADGAYIFDADGNAYIDFVGSWGPMILGHNHAAIRDAVIDAAQQGLSFGAPTAMEITMADLVSKLVPSMEMVRMVSSGTEATMSAIRLARGFTGRDKILKFEGCYHGHADCLLVKAGSGALTLGQPSSPGVPADFAKHTLTATYNNLDSVREAFSAHPEEIACIIVEPVAGNMNCIPPVPGFLEGLRDICDEFGALLILDEVMTGFRVSEGGAQGYYNIKPDLTTLGKIIGGGMPVGAFGGRREVMEFVAPTGPVYQAGTLSGNPVAMAAGHACLSVLTENGNEKRLANTTKRLADGFKTLADKHGVPLAVNQVGAMFGFFFTDQETVTCYENVTKCDVERFKRFFNLMLEKGVYLAPSAYEACFTSLAHTDQVIDATLEAADFAFATLAHENSPE

SEQ ID NO: 17171 - protein, 449 aa, Sulfitobacter sp. EE-36
MDRPLPARVALVNQPLGLLRSLAMARRNVLSIIPEIAVKQPMVSGKMGKRWHMVMDPTAIREMLLDRVDDYPKSLVTKNLLRPAIGDSLFIAEGAHWRWQRRAVAPAFSHRNMLNLSPIMTAAAQRSADRIAAAGPRAINMLDEMVTSTFDVISDVTFSGGGGFDRDAVHRAIDDYIAEAGKLSLFDILGLPDWLPRPGRAMSGRALKDMKRIADGAIDARAERGPSDTPDLLDLLLDGTDPKTKRQMNTAELRDNLLTFIVAGHETTALTLSWALYLMGFDQAVQQKARAEAQTVLQGRAATGADVENLPYIRQIIDETLRLYPPAGVISRTAQRNDTLCGREVRPGDTVMVPIYALGRHQQLWDQPDVFDPDRFKDRKAIDRYAYLPFGDGPRICIGASFAQQEAVIILATLLSRFRFTPVAGKSPEPVMILTLRPEGGVWLTATPA

SEQ ID NO: 17172 - protein, 206 aa, Triticum aestivum
  misc_feature (19)..(19): Xaa can be any naturally occurring amino acid
  unsure (1)..(206): unsure at all Xaa locations
PGRPRVRDLSGSPVALASXVTPFVASPGTDRVSRSNPGAWLILRPAGDGAWEPWGRLECWRERGGAGSSDSLGYRFDLLVPGVDHAVPIADSTIAASKGGKFALDLTAAQPLSRGSTPGCSPRGSGDFSQWPLGNYRGFVMSASVEGEGRCSKPTVEVGVAHVGCAEDAAAFVALAAAVDLSMDACRLFSHKLRKELSHLRSDVLR

SEQ ID NO: 17173 - protein, 143 aa, Clostridium perfringens ATCC 13124
MRLEKSLVLIKPDAVERNLIGKILEVYEGAGLKIKAMEMKQINKEFAEKHYEEHRDKQFFNSLIKYITRSPLVALILEGEDAINKIRSLNGATNPEKAEFGTIRRRFALSGTENSVHASDSIESAEKEIKLWFPKVFYEEICG

SEQ ID NO: 17174 - protein, 444 aa, Agrobacterium tumefaciens str. C58
MLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 17175 - protein, 502 aa, Oryza sativa (japonica cultivar-group)
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 17176 - protein, 109 aa, Oryza sativa (japonica cultivar-group)
MSAEQPEQAAPAAQEATVQIVYLDRPADADPEEFHIRTLAPVLGSEEKAKEAVLYHYKHAASGFSAKLTPQQVEELKKQPGVLQVVPSQTYQLHGPGAGTGTMNTFSLV

SEQ ID NO: 17177 - protein, 542 aa, Physcomitrella patens
MEAGGRPMGPATAEYYLPNYKLGKTLGIGSFGKVKVAEHSPTGHKVAIKILNRRKVKMMDMEEKVRREIKILRLFMHPHIIRLYEVIETPADIFVVMEYVKSGELFDYIVEKGRLGEHEARRFFQQIVSGVEYCHRNMVVHRDLKPENLLLDSKSNVKIADFGLSNVMRDGHFLKTSCGSPNYAAPEVISGKLYAGPEVDVWSCGVILYALLCGSLPFDDENIPNLFKKIKGGIYTLPSHLSPGARDLIPRMLLVDPMKRVTIPEIRQHPWFLNHLPRYLAVPPPDTTQQAKRIDEEILERVVALNFDRDLLIDSLLNRVQNKATVAYYLMLDNRRRLSNGYLCSEFNEGKEHLMSPMDAFNGTPRSGYPRTLTHMSSMDRRSASPSGLQHRVVAERKWVLGLQLRSHPKEIMNDVLKTLRDLGINWKKTGAYNLKCRWVAPGQNSNDTTAENHSLPDSPMAGSMPRASSCRWSSEQHGVSGSVAAGNRDNESGVESNVLKFELQLFKLREEKYLLDLQRVVGPTYLFLDLCAAFLAELRVL

SEQ ID NO: 17178 - protein, 432 aa, Bacillus licheniformis ATCC 14580
MAYPNGKLSEEKVFKDPVHRYVHVRDKLIWDLIGTREFQRLRRIKQLGTTYLTFHGAEHSRFNHSLGVYEIVRRMVDDVFKGREEWDDSERDLCLCAALLHDLGHGPFSHSFEKVFRLDHEDFTRAIILGDTEVNRVLNKVSPTFAKDVAEVIAKTYQNKQVVSLISSQIDADRMDYLQRDAYYTGVSYGHFDMERILRVMRPREDQIVIKQSGMHAVEDYIMSRYQMYWQVYFHPVTRSAEVILTKILHRAKQLHEEGYVFTHAPVHFYSIFEGNVTLEDYLSLDESIILYYFQAWEKEEDEILSDLCRRFINRRLFQYAEFNPNEEMATYFELTNLFKESGIDPEYYLVVDSSSDLPYDFYRPGEEEERLPIQLLTHNGQIKELSRQSDIVDAISGKRRTDHKLYFPLDLIEGLPDGRHAKRMKELLGLK

SEQ ID NO: 17179 - protein, 256 aa, Zea mays
MEALHEEMPFDLSFHPSVPLVATSLITGELHMFRYADGLPLERLFVAKPHKESCRAVRFVDSGTAILTGSADMSIVASDVETGKVIARLDNAHDDAINRLVCLTETTVASGDDDGYIKVWDTRQRSCCNTFHRHEDYISDMTYVAGSNQILATSGDGTLSVNNLRGNRVKSQSEFSEDELLSLVVMKNGQKVVCGTPSGTLLLYSWGHFKDCSDRFLGHAQSVDNLLKLDEETLISAAADGVIRLVGILPNQIYSR

SEQ ID NO: 17180 - protein, 550 aa, Arabidopsis thaliana
MNHVPSDQSFYIESEDEDDRKDYVEEDGGSHSDSSDDVYDENQAHIKPSSYTTAWPQSYRQSIDLYSSVPSPGIGFLGNNSMTRFGSSFLSSGLIRRHTPESLPTVTKPLLEEQADEQALPKHRLSSQGLLSPIPSRRGSMRKDEKSSMVSHEIPMSRNSSYGQAVLNGLNVLCGVGILSTPYAAKEGGWLGLMILFVYGLLSFYTGILLRYCLDSESDLETYPDIGQAAFGTTGRIFVSIVLYLELYACCVEYIILESDNLSSLYPNAALSIGGFQLDARHLFALLTTLAVLPTVWLRDLSVLSYISAGGVIASVLVVLCLFWIGLVDEVGIHSKGTTLNLSTLPVAIGLYGYCYSGHAVFPNIYTSMAKPSQYPAVLLTCFGICTLMYAGVAVMGYTMFGESTQSQFTLNLPQDLIATKIAVWTTVVNPFTKYALTISPVAMSLEELIPSRHIRSHWYAIGIRTLLVFSTLLVGLAIPFFGLVMSLIGSLLTMLVTLILPPACFLSIVRRKVTPTQMMLCVLIIIVGAISSVIGSYSALSKIVEKLTN

SEQ ID NO: 17181 - protein, 514 aa, Triticum aestivum
  misc_feature (478)..(478): Xaa can be any naturally occurring amino acid
  unsure (1)..(514): unsure at all Xaa locations
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDVFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILXAALKSAVKKQLCKAGDAVVVLHRIGMASVIKICTVK

SEQ ID NO: 17182 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 17183 - protein, 441 aa, Gibberella zeae PH-1
MKSVVFKGVKQVALEDRPKPMIQDPTDIIVKVKYTAFELHVFRGHQPSGTGFIMGHEFTGVIDQVGSAVKSLEVGDAIVSPFTVSCGECFFCKRGYSSRCDKSLLFGTVLLDGAQAEYVRIPYAQSTVMKAPKEVEDLKLCLMADIFPTGCYAASNGLDSLDKERVQESIVVLIGCGPVGICALIAALEYKPKAILAVDGIESRLSLAKDLGAEPWNYLTQKQDLEKRVKDLSDGRGADVIIEVVGHSSALDMGFKLLRPWGIISSVGVHNGEIPWTGNEAYGKNLTIKMGRCPVRSIFENSLKLLAKKQHLLEFMTATVMPLSNAPEGYELFDSMKVQKVIFDAEKIRSAFLMIKPDVASSDATDIRFEMKRNGDSYILNGILSSGSDDLRCDVYIVVGKIDASNPNTHRRQFVFLVPVRFPGVAVHHILNVFSAGRTLS

SEQ ID NO: 17184 - protein, 271 aa, Staphylococcus aureus subsp. aureus MRSA252
MKLVFYGAGNMAQAIFTGIINSSNLDANDIYLTNKSNEQALKAFAEKLGVNYSYDDATLLKDADYVFLGTKPHDFDALATRIKPHITKDNCFISIMAGIPIDYIKQQLECQNPVARIMPNTNAQVGHSVTGISFSNNFDPKSKDEINDLVKAFGSVIEVSEDHLHQVTAITGSGPAFLYHVFEQYVKAGTKLGLEKEQVEESIRNLIIGTSKMIERSDLSMAQLRKNITSKGGTTQAGLDTLSQYDLVSIFEDCLNAAVDRSIELSNIEDQ

SEQ ID NO: 17185 - protein, 181 aa, Brassica napus
  misc_feature (9)..(9): Xaa can be any naturally occurring amino acid
  misc_feature (12)..(12): Xaa can be any naturally occurring amino acid
  misc_feature (23)..(23): Xaa can be any naturally occurring amino acid
  misc_feature (37)..(37): Xaa can be any naturally occurring amino acid
  misc_feature (54)..(54): Xaa can be any naturally occurring amino acid
  unsure (1)..(181): unsure at all Xaa locations
MAYSMLSSXAVXTSPAQATMVAXFTGLKSSSAFPVTXKANNDITSIVSNGGRVXCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 17186 - protein, 549 aa, Staphylococcus aureus subsp. aureus MRSA252
MNKQWWKEAVAYQVYPRSFNDSNHDGIGDLPGMIDKLDYLKDLGIDVIWLSPMFKSPNDDNGYDISDYQEIMDEFGTMEDFDRLLKGVHDRGMKLILDLVVNHTSDEHPWFIESKSSKDNPKRDWYIWQDPKPDGSEPNNWESIFNGSTWEYDANTEQYYFHLFSKKQPDLNWGNPEVRDAVFEMMNWWFDKGIDGFRVDAITHIKKTFEAGDLPVPEGKTYAPAFDVDMNQPGIQTWLQEMKDRSLSKYDIMTVGEANGVSPDDADDWVGEENGKFNMIFQFEHLGLWNSGDSHFDVNSYKSVLNRWQKQLENKGWNALFIENHDQPRRVSTWGDDDKYWYESATSHAAVYFLQQGTPFIYQGQEIGMTNYPFESIETFNDVAVKNDYQIVKAQGGDVDALLAKYKDENRDNSRTPMQWDDTLNGGFTNGEPWFPVNPNYKTINVAQQLEDEDSVLQFYKDLIQLRKSNDVYVYGQFDLVDAENSQVFAYTRTLNEKQVLIVGNLTNHEAELTVPFDISHGEVKLFNYDAKVNLKQLLPYEACVIELN

SEQ ID NO: 17187 - protein, 272 aa, Gibberella zeae PH-1
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAAGQAEAPKEDAPAAATAEDAPAAPAAAEEPKAE

SEQ ID NO: 17188 - protein, 141 aa, Chlamydia muridarum Nigg
MEQTLSIIKPDSVGKAHIGEIVSIFEKAGLRIAAMKMVHLSVKEAEGFYAVHKERPFFQELVDFMISGPVVVMVLQGENAVARNRELMGATNPKEAAEGSIRALFGESIGVNAVHGSDSLENAAIEVSYFFAKTEIVNALA

SEQ ID NO: 17189 - protein, 400 aa, Silicibacter sp. TM1040
MSVLSATLSRVKPSPTIAVTNKARELKAAGRDVIGLGAGEPDFDTPQSIKDAAVRAIAEGKTKYTAVDGIPELKQTICEKFKRDNGLDYRPEQVTVNSGGKQTLYNALMATLNPGDEVIIPAPYWVSYPDMVLLAGGTPVPVEASLESSFKLTPDQLEAAITDKTKWFIFNSPSNPTGAGYSRAELKALTDVLMRHPHVWVMTDDMYEHLAYDDFEFCTPAQVEPGLYDRTLTCNGVSKAYAMTGWRIGYAAGPETLIAAMRKVQSQSTSNPCSVSQYAALEALTGPQDFLASNNEIFVRRRNLVVSMLSEIDGLTCPVPEGAFYVYPSIAGLIGKTTPKGVTINSDEDFATALLEEADVAVVFGAAFGLSPNFRVSYATSDDALKEACTRIQRFCASLS

SEQ ID NO: 17190 - protein, 188 aa, Oryza sativa
MRALDEKETKMVFEKLFKFTGPNLKHLLERPAVEGPDPQAGRYCLRLHKNRVYYASEALVRRATAVARPRLAGVGTPIGKFTHGGAFHLTVHALDLLAAHARRRVWLKPDTERSFLFGNSVPKSSLARITENTKANDGVVVMSMADVPLGFGIAARSAQDCRKADTNAVVVLHQSDAGEYLRREEELM

SEQ ID NO: 17191 - protein, 235 aa, Coccidioides immitis RS
MPSAITDEGLKFNTIEETIEAFRNGEFIVVLDSQNRENEGDLIIAADAVTPAKMAFMIRYTSGYICAPILPELAASLDLPQMVTDSTDPNRTAYTISIDSNDPSVSTGISARDRSLTCRNLASPDVKPTDFRRPGHILPLRARPGGVRERNGHTEATIDFCRLAGKREVGVICELVEDGDEVAPNVAERTDCSMMRRDGCLRFGKRWGLKVCTIEDLVDYLEKTEGSLPTLNGKH

SEQ ID NO: 17192 - protein, 175 aa, Glycine max
  misc_feature (121)..(121): Xaa can be any naturally occurring amino acid
  unsure (1)..(175): unsure at all Xaa locations
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIXSANKEIALWFPEGPADWQSPHPPGSEKENWEVSPQPGRPKKSGPFWCLKGSKKN

SEQ ID NO: 17193 - protein, 248 aa, Triticum aestivum
MSSSSSSKLFHSACKAARSFLASSPASASAPRAASSVLADGRNAALAALANLGRNSTLPAAYAHHTNAAASSHGYAWIAAIPAAVYMLQDQEVHAAEMERTFIAIKPDGVQRGLISEIVSRFERKGYKLVAIKLVVPSKQFAEKHYHDLKERPFFSGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 17194 - protein, 545 aa, Physcomitrella patens
MDSGGRPVAPVAVEYYLPNYKMGKTLGIGSFGKVKVAEHTPTGHKVAIKILNRRKVKSMDMEEKVRREIKILRLFMHPHIIRLYEVIETPTDIFVVMEYVKSGELFDYIVEKQRLGEDEARRFFQQIVSGVEYCHRNMVVHRDLKPENLLLDSKWNVKIADFGLSNIMRDGHFLKTSCGSPNYAAPEVISGKLYAGPEVDVWSCGVILYALLCGSLPFDDENIPNLFRKIKGGIYTLPSHLSPGARDLIPRMLLVDPMKRVTIPEIRQHPWFLNHLPRYLAVPPPDTLQQAKRIDEEILERVVALNFDRVHLIESLLNRVQNKATVAYYLMLDNRRRLSNGYLGSEFDEGKEQSLSPMSPYGAHGGTPRSTYPRSLIRTPSMDRRGSSSSVLQHRVVAERKWALGVQLRSHPKEIMSDVLDTLRKCDINWKKTGAYNLKCRWVAPNQHLNDRASEHRGIPDSPMAGTTPRVSSGRWSSEQQGISGSVASGNKDDESGVESNVLKFELQLFKMREEKYLLDLQRVEGPTYLFLDLFSAFLIELRVA

SEQ ID NO: 17195 - protein, 491 aa, Sulfitobacter sp. EE-36
MTDAKTDLKSMLKDPSLLETRAYIGGEWVDGDDGTFDVVNPARGDVIAKVANLSRAQVAGAIAQAEKAQKEWASWTGKERAGVMRKWFDLMMENQDDLGAILTAEQGKPLGEAKGEIAYGASFIEFFGEEAKRVYGETIPGHQRDKRITVIKQPIGVAASITPWNFPNAMITRKAAPALAAGCAFVARPAAETPLSAIVMGVLAERAGIPAGVFNVLPSSSSSAVGKEFCENPAVRKLTFTGSTEVGRILLKQAADQVMKCSMELGGNAPFIVFDDADLDAAVEGAILCKFRNNGQTCVCANRIYVQAGVYDAFAEKLKARVEKMKVGDGFEDGVELGPLINGDASDKVKEHVEDAVSKGAEILLGSKEEKMEGNFLAPTIITGVTQDMKVSKEETFGPLAPLFKFDNEDDVIEMANDTIFGLASYFYAKDLSRVYKVAEALEYGIVGVNTGIISTEVAPFGGVKQSGLGREGSHHGIEDYLEMKYICMSV

SEQ ID NO: 17196 - protein, 251 aa, Silicibacter pomeroyi DSS-3
MRRKLAAGNWKMNGTGAALDALEAIAGAHSAAAVDLLICPPATLLYRAAQVAEGSRVRIGGQDCHAVTAGAHTGDISAMMLADAGASAVILGHSERRADHGETDAQVCDKARAALEAGLIAIICIGETLAQREAGQTLDVVCAQLAGSVPDGIDGTRVVVAYEPVWAIGTGLVPTLEQIAEVHDTLRQQLIGRFGSETAEAIRLLYGGSVKPGNAAEIFAVSNVDGALVGGASLTAADFSPIVSALEQAAG

SEQ ID NO: 17197 - protein, 271 aa, Methanosarcina mazei
MVRSILKKYNIKGGTFDQHFLIDAGYLDRIVAAAELSPQDTVLEIGAGIGNLTERLARRAKKVIAVELDPALVSVLHDRFDAAENIEIIAGDALKVDFPEFDKVVSNLPYSISSEITFKLLRHKFKLGVLMYQYEFAVRMVSPPGCKDYSRLTIDTCYFADASIVMKVPKGAFQPAPEVDSAVIKLIPRPAPFEVRDETFFLQFVAAVFSQRRKKLRNAILNTSSLLKIPDIKEIVSQLPEDFMNKRAEDLTPEELASVANMIFDLKSRNF

SEQ ID NO: 17198 - protein, 139 aa, Triticum aestivum
MKTESPRHLRNPLLVLLFLAAAAAAPVAQIAMAAEPEQAPAAQEAAVHIVYVDRPEDADPEEFHIRTLAPVLGSEEKARGAVLYHYKHAASGFSAKLTTEQVEDLKKQPGVLQVVPSQTVQLHGNEGGHAKTTRTMGLM

SEQ ID NO: 17199 - protein, 484 aa, Agrobacterium tumefaciens str. C58
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 17200 - protein, 56 aa, Lycopersicon esculentum
SATILCASFGSGTHAFTLDHTTGDFLLTHPNINIPPRGQIYSVNDARYFDWPEGLR

SEQ ID NO: 17201 - protein, 447 aa, Bacillus anthracis str. 'Ames Ancestor'
MLHRYLPMTEEDKKEMLQTIGVQTIDELFSDIPESVRFKGDLKIKEAKSEPELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 17202 - protein, 423 aa, Saccharophagus degradans 2-40
MTLPKDPESSTVKPVKKDKRKNIIKSEKLLGVCYDIRGPVLEHANRLEEEGHRILKLNIGNPAPFGFEAPDEIITDVVYNIREAQGYTASRGLFPARKAIMHECQRQEIPNVEIEDIFLGNGVSELIVMANQALLNNGDEVLVPSPDYPLWTAAVNLAGGKAVHYMCDEQSDWFPDIDDMRSKITSRTRAIVVINPNNPTGAVYSQELLEQIVALAREHQLVIFADEIYSKILYDDAEFVPMGRIAKDVLCVTFNGLSKSYRLAGFRSGWIILSGAKHLAKDYIRGIDMLASMRLCANVPAMLAVQTALGGYQSINELILPGGRLLEQRDAAIEELAKIPGVSCVVPKGAIYLFPKIDRTMYDFDDDQQLILDFLIQEKILLVQGTAFNWKQPDHFRIVFLPQADQLRQAIIKFGEFLQQYRI

SEQ ID NO: 17203 - protein, 576 aa, Arabidopsis thaliana
MVKKEKKSNVSGKPKHSLDANRADGKKKTTETRSKSTVNRLKMYKTRPKRNAGGKILSNEYQSKELPNSRIAPDRRWFGNTRVVNQKELEYFREELQTKMSSNYNVILKERKLPMSLLTDNKKQSRVHLLDMEPFQDAFGRKTKRKRPKLVASDYEALVKKAAESQDAFEEKNGAGPSGEGGEEEDGFRDLVRHTMFEKGQSKRIWGELYKVIDSSDVIVQVIDARDPQGTRCHHLEKTLKEHHKHKHMILLLNKCDLVPAWATKGWLRVLSKEYPTLAFHASVNKSFGKGSLLSVLRQFARLKSDKQAISVGFVGYPNVGKSSVINTLRTKNVCKVAPIPGETKVWQYITLTKRIFLIDCPGVVYQSRDTETDIVLKGVVRVTNLEDASEHIGEVLRRVKKEHLQRAYKIKDWEDDHDFLLQLCKSSGKLLKGGEPDLMTGAKMILHDWQRGRIPFFVPPPKLDNVASESEVIVPGIDKEAIADNSQAAAALKAIAGIMSTQQQKDVPVQRDFYDEKDLKDDKKAKESTETDAENGTDAEEDEDAVSEDGVESDSDADEDAVSENDEEDESDSAE

SEQ ID NO: 17204 - protein, 335 aa, Chlamydia muridarum Nigg
MRIVINGFGRIGRLVLRQILKRNAPIEVVAINDLVSGDLLTYLFKYDSTHGSFASQATFSDGCLVVGERKIRFLAEKDVQKLPWKDLDVDVVVESTGLFVNKDDAAKHLDSGAKRVLITAPAKGDVPTFVMGVNHQKFDPANDVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAVCEAVKHAASTSMRNIMHYTEEAVVSSDFIGCEYSSVFDAQAGVALNDRFFKLIAWYDNEIGYATRIVDLLEYIQGNSK

SEQ ID NO: 17205 - protein, 172 aa, Saccharomyces cerevisiae
MSANSKDRNQSNQDAKRQQQNFPKKISEGEADLYLDQYNFTTTAAIVSSVDRKIFVLLRDGRMLFGVLRTFDQYANLILQDCVERIYFSEENKYAEEDRGIFMIRGENVVMLGEVDIDKEDQPLEAMERIPFKEAWLTKQKNDEKRFKEETHKGKKMARHGIVYDFHKSDMY

SEQ ID NO: 17206 - protein, 463 aa, Pseudomonas fluorescens PfO-1
MSSTQSSNGLEQGLKPRHVTMLSIAGVIGAGLFVGSGHAIAAAGPAVLLAYAAAGALVVLVMRMLGEMAVASPDTGSFSTYADRAIGHWAGFTIGWLYWWFWVLVIPLEANAAATILHAWFPGVDIWAFALIITMLLTVTNLFSVKNYGEFEFWFALLKVVAIIGFIILGVAAIFGFLPNSQVSGVSHIFDTQGFLPNGMGAVLGAILTTMFSFMGTEIVTIAAAESKNPGKQISKATNSVIWRIGLFYLVSIFIVVALVPWNDPVLASVGSYQTVLERMGIPNAKMIVDIVVLVAVTSCLNSALYTSSRMLFSLGKRGDAPVMSTRTNKSGTPYWAVMLSTGAAFLCTFANYVAPAAVFEFLLASSGAIALLVYLVIAISQLRMRKQRMARGEKIVFSMWLFPGLTYAVIAFIVAALTIMLFQDAHRVEILATGLLSLVVVATGLLVARRRKMENRGAAVLN

SEQ ID NO: 17207 - protein, 121 aa, Physalis longifolia
DNISTTLNKCKSIPYDKNMTDDKKNMLYIRWPDLLVGEASCKKDQKFWKNEYEKHGTCCEESYNQEQYFDLAMGLKDKFDLSNSLGRYGIIPGKSYPVQIINSTVKAITQGFPRLSCTNLM

SEQ ID NO: 17208 - protein, 141 aa, Legionella pneumophila str. Lens
MAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEPHELCNR

SEQ ID NO: 17209 - protein, 321 aa, Papaver somniferum
MESNGVPMITLSSGIRMPALGMGTAETMVKGTEREKLAFLKAIEVGYRHFDTAAAYQTEECLGEAIAEALQLGLIKSRDELFITSKLWCADAHADLVLPALQNSLRNLKLDYLDLYLIHHPVSLKPGKFVNEIPKDHILPMDYKSVWAAMEECQTLGFTRAIGVCNFSCKRLQELMETANSPPVVNQVEMSPTLHQKNLREYCKANNIMITAHSVLGAVGAAWGTNAVMHSKVLHQIAVARGKSVAQVSMRWVYQQGASLVVKSFNEARMKENLKIFDWELTAEDMEKISEIPQSRTSSAAFLLSPTGPFKTEEEFWDEKD

SEQ ID NO: 17210 - protein, 314 aa, Mentha x piperita
MAEVQRYALVTGANKGIGFEICRQLAEKGIIVILTSRNEKRGLEARQKLLKELNVSENRLVFHQLDVTDLASVAAVAVFIKSKFGKLDILVNNAGVSGVEMVGDVSVFNEYIEADFKALQALEAGAKEEPPFKPKANGEMIEKFEGAKDCVVTNYYGPKRLTQALIPLLQLSPSPRIVNVSSSFGSLLLLWNEWAKGVLGDEDRLTEERVDEVVEVFLKDIKEGKLEESQWPPHFAAERVSKAALNAYTKIAAKKYPSFRINAICPGYAKTDITFHAGPLSVAEAAQVPVKLALLPDGGPSGCFFPRDKALALY

SEQ ID NO: 17211 - protein, 321 aa, Papaver somniferum
MESNGVPMITLSSGIRMPALGMGTVETMEKGTEREKLAFLNAIEVGYRHFDTAAAYQSEECLGEAIAEALQLGLIKSRDELFITSKLWCADAHADLVLPALQNSLRNLKLEYLDLYLIHHPVSLKPGKLVNEIPKDHILPMDYKSVWAAMEECQTLGFTRAIGVSNFSCKKLQELMATAKIPPVVNQVEMSPTLHQKNLREYCKANNIMITAHSVLGAIGAPWGSNAVMDSKVLHQIAVARGKSVAQVSMRWVYQQGASLVVKSFNEARMKENLKIFDSELTAEDMEKISEIPQSRTSSADFLLSPTGPFKTEEEFWDEKD

SEQ ID NO: 17212 - protein, 321 aa, Papaver somniferum
MESNGVPMITLSSGIRMPALGMGTAETMVKGTEREKLAFLKAIEVGYRHFDTAAAYQSEECLGEAIAEALQLGLIKSRDELFITSKLWCADAHADLVLPALQNSLRNLKLDYLDLYLIHHPVSLKPGKFVNEIPKDHILPMDYKSVWAAMEECQTLGFTRAIGVCNFSCKKLQELMAAAKIPPVVNQVEMSPTLHQKNLREYCKANNIMITAHSVLGAICAPWGSNAVMDSKVLHQIAVARGKSVAQVSMRWVYQQGASLVVKSFNEGRMKENLKIFDWELTAENMEKISEIPQSRTSSADFLLSPTGPFKTEEEFWDEKD

SEQ ID NO: 17213 - protein, 341 aa, Beta vulgaris
MDHAADATRTDLMTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 17214 - protein, 152 aa, Corynebacterium efficiens YS-314
MTSLRQDRGRSVDSASMTERTLILIKPDGVTNGHVGEIIARIERKGLKLAALDLRVADRETAEKHYEEHADKPFFGELVEFITSAPLIAGIVEGERAIDAWRQLAGGTDPVSKATPGTIRGDFALTVGENVVHGSDSPESAEREISIWFPNL

SEQ ID NO: 17215 - protein, 390 aa, Bacillus licheniformis ATCC 14580
MRTTYISKAAQQIKPSGIRKFFDLASTMEGVISLGVGEPDFVTAWNVREASILSLEQGYTSYTANAGLLSLRKEISAYLNKRFHLDYAPDDELIVTVGASQALDIAVRAILDPGEEVLIPEPCFVAYEALVSLAGGKAVHIHTNAERGFKASAADFEAVLTERTKAIILCTPSNPTGSVYSKKELEEIAAFAEKHDLIVIADEIYAELTYDEAYTSFAEIAGMKKRTILISGFSKGFAMTGWRLGYVAAPAYLRDPMLKIHQYSMMCAPSMAQFAAEEALKNGLEDVEKMKKSYRRRRNVFVDSLNEIGLDCHQPGGAFYAFPSVKKTGMSSEQFAEELLISEKVAVVPGNVFGPSGEGYIRCSYASSLEQLQEALVRMKRFVEKVGAVK

SEQ ID NO: 17216 - protein, 319 aa, Glycyrrhiza echinata
MAAAAAAAIEIPTKVLPNSTCELRVPVIGMGSAPDFTCKKDTKEAIIEAIKQGYRHFDTAAAYGSETALGEALKEARDLGLVTREELFVTSKLWVTENHPHLVIPALRKSLETLQLEYLDLYLIHWPLSSQPGKFSFPIQVEDLLPFDVKGVWESMEECLKLGLTKAIGVSNFSVKKLQNLLSVATIRPAVNQVEMNLAWQQKKLREFCTANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEL

SEQ ID NO: 17217 - protein, 301 aa, Rickettsia conorii
MLPSIAKHAALHQVNPLKKHGQNFIFDSSLCDKIVRASNLAENSRVLEIGPGTGGLTRSILQKNPESLTVIETDARCLPLLNEIKEYYPNLNIIKQDALKINLTDLSYDIVNSVGFAYKKREVKPITNRRANDIGESKSIDYKVTIISNLPYHIGTELVIRWLKEARLITSMTLMLQKEVVERICAIPSTKAYGRLSVICQLIAKVEKCFDVAPTAFYPPPKVYSAIVKLIPLENPPSIALINKVEQITKLAFAGRRKMIKSSLKNLVPNIYEVLTQLKINDNYRAENLAPQDYLRIAEIL

SEQ ID NO: 17218 - protein, 458 aa, Candida albicans SC5314
MASRQSRLEAEKLAIIQQSMTRGRSTSPRGGSHSRSSSLNREDFNKELKWSIVNHDPSERIIKSDKQQTDNDFWENEVSEEEHISDDDTNEKFQYDDTGNILPNYACQDEKINEISQILENSNLNDRATIKRLEELTASERAFAAARKAGSKIDQEILNKLASDKQKLTGTNLNLDESDQDALARRQKLENYQAYRKKIIDQENGLRNGSVSPTRPEEGEGSSEDFMAPYTSAVEDKLDSEFASQLNETIKEGPVDSNKSHSRVIQTITRGNFFQLINPKVKPKMFLLCMDFSPESIFALEWSLGTVLVDGSVLFIVCVIEDGDTNHHLKGNTSNETSREQTRLNMLNKAKQQVLNLLKLTKLQIHIVIEIIHHPIPRHLILEFIDNLQPTLVIVGSKGQSAIKGVLLGSLSNYLVTKSTVPVMVVREKLKKINRFKSGSSVFSNNVKPLTLSEARVD

SEQ ID NO: 17219 - protein, 265 aa, Bradyrhizobium japonicum USDA 110
MTLTLTILGCGSSAGVPRPALGWGACDPSNPKNRRRRCSLLVERTSEHGTTRIVIDTSPDLREQLLSTNVDHIDAVFLTHEHADQTHGMDDLRSVVMHMRRRIPTYFNQSTAKDILSRFSYCFIAPEGSDYPPILTRHSIEAGESQTVLGKGGAVTMTAFLVQHGNIPALGYRIGDAAYTPDLNDIPRESWGALENLDLWIVDGLRYTSHVSHFSINDALSWIERFKPKRAVITNMTADVDYEVIRQSLPPGVVPAYDGLRLETH

SEQ ID NO: 17220 - protein, 273 aa, Vibrio cholerae
LLETEQDERILNSKSLNYLSLEFLIGRLTGNNLISMGVYEAVAEAMEELGQNLSDLLEEERDPSLGNGGLGRLAACFMDSCAAQEYPTVGYGLHYEYGLFKQSFEEGRQKEAPDAWCGVEGYPWEVARPELKQEIGFYGHVEVINENGKERRRWVPGMLVQAMPWDLPIVGYQSDTVYPLRLWECRAIAPFSLESFNNGNYFEAQHALIDAGNITKVLYPNDNHEKGKTLRLMQQYFHSAASVRDILRRHEAAGHALADLPKYETIQLNDTHP

SEQ ID NO: 17221 - protein, 290 aa, Bacteroides fragilis YCH46
MMERKLAVITGADGGMGTEITRAVACAGYDVIMACYSSSKAETKCRELVKETGNEKIEVWQIDLASLASVRAFADRMLRQKTPVALLMNNAGTMETGLHITEDGLERTVSVNYVGPYLLTRLLLPLMGEGTRIVNMVSCTYAIGKLDFPDFFLRGRKGSFWRIPIYSNTKLALLLFTIELAERLRARGITVNAADPGIVSTNIIRMDQWFDPLTDIFFRPFIRTPLQGAATAIGLLLDAEVEGRTATFNLNNHCRLLPEKYTRPDRRAQLWEETERILSEKGFLPINDKR

SEQ ID NO: 17222 - protein, 91 aa, Arabidopsis thaliana
  misc_feature (52)..(52): Xaa can be any naturally occurring amino acid
  misc_feature (72)..(72): Xaa can be any naturally occurring amino acid
  unsure (1)..(91): unsure at all Xaa locations
MASSMLSSATIVASLDHATMVAPFSGLKSSAVFTVIRRANNDITSITINGGXVNFMHVWPPTGNNKFETLSXLPDLTDSELAMEVDYLIRD

SEQ ID NO: 17223 - protein, 343 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKSPNGIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMAIFVRRTVGGGGNTQLERNEPGTKPMARVLLLRTCVAEHLSENMGRQTRERERSSDHSLGPCQGQFVGSARKIHR

SEQ ID NO: 17224 - protein, 273 aa, Vibrio cholerae
LLETEQDERILNSKSLNYLSLEFLIGRLTGNNLISMGVYEAVAQAMDELGQNLSDLLEEERDPSLGNGGLGRLAACFMDSCAAQEYPTVGYGLHYEYGLFKQSFEEGRQKEAPDAWCGVEGYPWEVARPELKQEIGFYGHVEVVNENGKERRRWVPGMLVQAMPWDLPIVGYQSDTVYPLRLWECRAIAPFSLESFNNGNYFEAQHALIDAGNITKVLYPNDNHEKGKTLRLMQQYFHSAASVRDILRRHEAAGHALADLPKYETIQLNDTHP

SEQ ID NO: 17225 - protein, 273 aa, Vibrio cholerae
LLETEQDERILNSKSLNYLSLEFLIGRLTGNNLISMGVYEAVGQAMEELGQNLSDLLEEERDPSLGNGGLGRLAACFMDSCAAQEYPTVGYGLHYEYGLFKQSFEEGRQKEAPDAWCGVEGYPWEVARPELKQEIGFYGHVEVINENGKERRRWVPGMLVQAMPWDLPIVGYQSDTVYPLRLWECRAIAPFSLESFNNGNYFEAQHALIDAGNITKVLYPNDNHEKGKTLRLMQQYFHSAASVRDILRRHEAAGHALADLPKYETIQLNDTHP

SEQ ID NO: 17226 - protein, 321 aa, Papaver somniferum
MESNGVPMITLSSGIRMPALGMGTAETMVKGTEREKLAFLKAIEVGYRHFDTAAAYQSEECLGEAIAEALQLGLIKSRDELFITSKLWCADAHADLVLPALQNSLRNLKLEYLDLYLIHHPVSLKPGKFVNEIPKDHILPMDYKSVWAAMEECQTLGFTRAIGVSNFSCKKLQELMAAAKIPPVVNQVEMSPTLHQKNLREYCKANNIMITAHSVLGAIGAPWGSNAVMDSKVLHQIAVARGKSVAQVSMRWVYQQGASLVVKSFNEGRMKENLKIFDWELTAEDMEKISEIPQSRTSSAAFLLSPTGPFKTEEEFWDEKD

SEQ ID NO: 17227 - protein, 220 aa, Oryza sativa
MDAMAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 17228 - protein, 482 aa, Methanothermobacter thermautotrophicus str. Delta H
MNEIIGKFAREGILIEDNAYFRLREMDDPASVSSELIVKIKSNGGKFTVLTSEMLDEFFEIDNPAEIKARGPLMVPAERDFDFEVISDTSNRSYTSGEIGDMIAYFNSRYSSLKNLLSKRPELKGHIPIADLRGGEDVVSIIGMVNDVRNTKNNHRIIELEDDTGEISVVVHNENHKLFEKSEKIVRDEVVGVHGTKKGRFVVASEIFHPGVPRIQEKEMDFSVAFISDVHIGSQTFLEDAFMKFVKWINGDFGSEEQRSLAADVKYLVVAGDIVDGIGIYPGQEKELLIRDIHEQYEEAARLFGDIRSDIKIVMIPGNHDSSRIAEPQPAIPEEYAKSLYSIRNIEFLSNPSLVSLDGVRTLIYHGRSFDDMAMSVNGLSHERSDLIMEELLEKRHLAPIYGERTPLASEIEDHLVIDEVPHVLHTGHVHINAYKKYKGVHLINSGTFQSQTEFQKIYNIVPTCGQVPVLNRGVMKLLEFS

SEQ ID NO: 17229 - protein, 333 aa, Zygosaccharomyces rouxii
MVNVSVNGFGRIGRLVTRIAISRKDINLVAINDPFISTDYAAYMFKYDSTHGRFDGEVSHDKDHIILNGKKVAVFNEKDPAALPWGKLGVDVAIDSTGIFKEMDSANKHIEAGAKKVVITAPSGSAPMYVMGVNEETYTPDQKIVSNASCTTNCLAPLAKVIHNEFGIKEGLMTTVHSMTATQKTVDGPSHKDWRGGRTASGNIIPSSTGAAKAVGKVLPSLQGKLTGMAFRVPTVDVSVVDLTVNLAKETSYDEIKAALKKASEGSMKGILGYTEDDVVSSDFLGDAHSSIVDAAAGIQLTPTFVKLVSWYDNEFGYSTRVVDLVEHVAKSA

SEQ ID NO: 17230 - protein, 232 aa, Exiguobacterium sibiricum 255-15
MYEQEKKMLAEAAIKQVKNGMILGLGTGSTTRSFIDALGEWVKAGGEVQGVATSNETVEQAKRLNIPLLSLEEATHIDLVIDGIDQIDPRFRVLKGGGGALFREKVVALMSREILYLADASKFVHHLTGPLPVEIDAFARPYVERYLRDKQLDVTLREHDGQPFVTDGGHLILDVDLERVQDVRHFAQELKSLTGVLETGYFERQPDHVLTVEQGKVRQLAHPNLRDGGGLV

SEQ ID NO: 17231 - protein, 429 aa, Legionella pneumophila str. Lens
MSRSSDLFHKAQTIIPGGVNSPVRAFKGVGGEPVFFKSGKGAYLTDVDDKQYIDYVGSWGPLILGHCHPKVIEAVDNVLHSGMSFGAPTELEIQLAEKIASLMPSIEKIRMVNSGTEATMTAIRLARGFTNKNKFIKFNGCYHGHSDSLLVKAGSGLLTLGIPSTPGIPQCITEHTLTADFNNLEQVAQLFEKYPNDIATVILEPVPGNMGFILPKIEFLKGLRELCDQYNALLIFDEVMTGFRVGLHGAQGLFGIKPDITTLGKIIGGGMPVGALGGKREIMSFLAPEGPVYQAGTLSGNPLAMAAGLATLKEIEKINFFEDLSSTTNKLTEALSDAAENANIPLFAASLGGMFGFCFTDKNSVENYLDVASSDEVLFKKFFHAMLAQGVYFAPSMYEAGFVSSMHGDLEIQKTYDAAELVLNQLKSA

SEQ ID NO: 17232 - protein, 321 aa, Papaver somniferum
MEIGGVPVVTLSSGRGMPILGMGTAENNLQGSERVKLAILKAIEVGYRHFDTAFVYQTEGSLGEAVAEALQNGLIKSRDELFITSKLWCADAYPDHVLPALQNSLRNLKLEYLDLYLIHWPVSLKPGKFVHPIPKDEIFPIDYKSVWAAMEKCQMLGLTKSIGVSNFSCKKLHYLMATANIPPAVNQVEMNPIWQQQKLRDYCKTNNIMVTAYSPLGAKGTMWGSSGVMDSEVLNQISQVRGKSVAQVSLRWVYEQGASLLVKSFNEERMKENLKIFDWELSPEDLKNISELPQRRVSTGDPFVSINGPFKSVEELWDDEV

SEQ ID NO: 17233 - protein, 94 aa, Oryza sativa
  misc_feature (22)..(22): Xaa can be any naturally occurring amino acid
  misc_feature (62)..(62): Xaa can be any naturally occurring amino acid
  unsure (1)..(94): unsure at all Xaa locations
DTILDAGTNNVTTTQGHDDPGXKCAKHYKAGARYNKRRDVLKIGPNQPDKLAIDLNAQGLAXYAIICHENGMVPIGEPDILDHGPHDIDRSAYK

SEQ ID NO: 17234 - protein, 491 aa, Clostridium acetobutylicum ATCC 824
MTSKKEQKNELKRTLTARHMNMIAIGGSVGTGLFFASGSAISTAGPGGALLAYIITGILVYVLMMSLGEMSTLLPISGSFETYATRFVDPALGFTLGWNYWFSWSICVASELVAGSLIVKFWFPHTNTTIWSIGFLLVIFILNILSAKAYGESEYWFSSIKVVTIIIFIIVGVLMIFGIMGNDSPGFKNWVISGNGSRAPFVGGIAAIINVFLVAGFSFSGTEIVGLAAGETENPEENVPKAIKSVFWRILLFYICAIIIIGFLVPFNDKNLLKSGVNNIAYSPFTMVFAKCGIAFAASAMNAVILTSVLSCGNSGLYVSSRMLYSLAKEGKAPKFLAKVNKQGVPMNALYATTLVASSAFLSSLIGEGKIYYVLYNASGITALFAWLGIGICHYRFRKAYVAQGRDLKDLKFKAKFYPYGPIMAIVLCVVIIFGANIWIFQAPKFSWFDFISNYICIPIFIALYIAYKYIKKTKLVPLEECDFEYNGKDK

SEQ ID NO: 17235 - protein, 168 aa, Haloarcula marismortui ATCC 43049
MVASLMVLYGPYTTLTIARSDRDVVQEHLLRDGHSERWGQFELPAEATVVGLAGKTGERSDAFNDIAQSFERDLKLRYGGATVADLAQVLEYGGLFGYPVTSGYPNGKLRVHFESAPLAYLVEAAGGASSDGSQSLLDVEPDGIHDRTPTFLGNAELVDELEAALSET

SEQ ID NO: 17236 - protein, 290 aa, Streptococcus pneumoniae
MRIADYSVTKAVLERHGFTFKKSFGQNFLTDTNILQKIVDTAEIDDQVNVIEIGPGIGALTEFLAERAAQVMAFEIDHRLVPILADTLRDFDNVTVVNEDILKVDLAQHIQNFKNPDLPIKVVANLPYYITTPILMHLIESGIPFCEFVVMMQKEVADRISAQPNTKAYGSLSIAVQYYMTAKVAFIVPRTVFVPAPNVDSAILKMVRRPEPAVAVEDENFFFKVSKASFTHRRKTLWNNLTGYFGKTEEVKDKLTKALDQAGLSPSVRGEALSLAEFAGLADALKGQGL

SEQ ID NO: 17237 - protein, 168 aa, Triticum aestivum
  misc_feature (52)..(52): Xaa can be any naturally occurring amino acid
  misc_feature (141)..(141): Xaa can be any naturally occurring amino acid
  misc_feature (163)..(163): Xaa can be any naturally occurring amino acid
  unsure (1)..(168): unsure at all Xaa locations
ERAHQWSQVYSEETKKQSIPVITAWQLNERMYGELQGLNKQETADLFGKEQXVHEWRRSYDIPPPNGESLEMCAERAVSYFKEQIIPQLVSGKHVMIAAHGNSLRSIIMHLDKLTSQEVISLELSTGIPMLYIFKEGKFIXRGSPAGPSEAGVYAYTKIWQYXQNLTH

SEQ ID NO: 17238 - protein, 248 aa, Agrobacterium tumefaciens str. C58
MTHTPPTALVTGANKGIGLAIARQLGAAGHTVWLGCRDMSRGEMAAFELRENGVDARAVQLDVTDDASASSAAKTIESEVGHLDVLVNNAGLMFGSPPSLAEESIDEIQQMFNTNVFGVMRVTQAFLPLLRKSKAARIVMMSSGLSSLTDALDMRSETWTVGFGGYCASKTALNMLTVKLAKELDREGIKVNAVDPGLTSTDMTGNGPGHSPEDGARPAFALATTHAYGPTAGFYACAPSGELVQKSW

SEQ ID NO: 17239 - protein, 64 aa, Triticum aestivum
MPPKKAAAAKADDAKKQKGAEDKTYGLKNKNKSKNGQKYVQTADQADQAKPDPTKTSVKKKKEE

SEQ ID NO: 17240 - protein, 237 aa, Zea mays
MVASAFTVDLDKPLVFQVGHLEEQYQEWVHQPIVCKEGPRFFENDILEFLTRTKWWAVPLIWLPIVCWCLSTSIKMGNTITDVAMMIGFGIFLWTLIEYVLHRFLFHIKTKSYWGNTAHYLLHGCHHKHPMDGLRLVFPPAAAAILCFPFWNMIKLFSTPSTTPGLFGGGLLGYVIYDCTHYYLHHGQPSSDPAKYLKKYHLNHHFRIQTKGFGITSTLWDHVFGTLPSTKTVDKSI

SEQ ID NO: 17241 - protein, 490 aa, Staphylococcus aureus subsp. aureus MRSA252
MTSKSSPLIFERSREGRYAYSLPISDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSEHFEIPYKQYCKHEFVLSGVRQKEFGVRTLDMAKRLLDFGVHPPTIYFPLNVEEGMMIEPTETESKETLDYFIDTLISIAEEAKNDPDKVLEAPYTTVIDRLDEATAARKPILKFENLKQEK

SEQ ID NO: 17242 - protein, 313 aa, Synechococcus sp. WH 8103
WNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLKFRSGDALANPYLAFSAMVMAGLDGIKNQIDPGDGENRDLFELPAEKLAKIATVPPSLNGALEALNADRGFLTAGGVFSDDFIDNWIDFKYEEVQQLRQRPHPHKFAMYYDA

SEQ ID NO: 17243 - protein, 89 aa, Candidatus Kuenenia stuttgartiensis
MVVDLHSVLLEGGVYFYPEDAGHEGWKLRLLYECAPLAFLVEQAVGLSSTGTRRIPDIKAESIHQRALLVIGSTEEVSLYEKFFMNGSP

SEQ ID NO: 17244 - protein, 451 aa, Staphylococcus aureus subsp. aureus MRSA252
MCIVSHRYIPLTEKDKQEMLQTIGAKSIGELFGDVPSDILLNRDLNIAESEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDDTAAVAVQYPNFYGSIEDLEKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 17245 - protein, 430 aa, Arabidopsis thaliana
MSPIPKPLFFFFFLNYVSLSTSLSLHLPLTSLPISTTTNSHRFTTSLLSRKNPSPSSPPYNFRSRFKYSMALIISLPIGTPPQAQQMVLDTGSQLSWIQCHRKKLPPKPKTSFDPSLSSSFSTLPCSHPLCKPRIPDFTLPTSCDSNRLCHYSYFYADGTFAEGNLVKEKITFSNTEITPPLILGCATESSDDRGILGMNRGRLSFVSQAKISKFSYCIPPKSNRPGFTPTGSFYLGDNPNSHGFKYVSLLTFPESQRMPNLDPLAYTVPMIGIRFGLKKLNISGSVFRPDAGGSGQTMVDSGSEFTHLVDAAYDKVRAEIMTRVGRRLKKGYVYGGTADMCFDGNVAMIPRLIGDLVFVFTRGVEIFVPKERVLVNVGGGIHCVGIGRSSMLGAASNIIGNVHQQNLWVEFDVTNRRVGFAKADCSRVV

SEQ ID NO: 17246 - protein, 397 aa, Magnetococcus sp. MC-1
MPATITDHKEFQNYAINFGPQHPAAHGVLRLLLELDGEVVERADPHVGLLHRGTEKLLEQKTYIQGTPYFDRLDYMSMMSEEHAWVIAVERLGQIEVPERAQYIRTIYAEITRFINHLLFFAAHGLDVGAMTMFLYCFREREELMDIYEAACGARMHANYFRPGGVARDLPDGLEQRIRDFCNHFPSKLDEYETLLTNNRIWKQRLVDIGKVSQEDAFSWGFTGPMLRGSGVAFDLRKAEPYDAYDRVEFDIPVGKNGDSYDRYLVRIEECREGVKIIQQCLDQMQPGPVRNDNFKISMPYRQDMQQDMESMIHHFKLCTEGFNLPAGEVYAAVETPKGELGVYLVSDGGNKPYRARIRAAGFNHLQAVKEMARGHMIADVTTIIGSIDIVFGEIDR

SEQ ID NO: 17247 - protein, 116 aa, Prunus avium
PSNYSNPTKPSNCKGSQFNFTKVSPQLRSILKTSWPDVESGNDTKFWEGEWNKHGTCSEQTLNQMQYFQRSFAMWRSYNITNILKNASIVPSATQTWTYSDIVSPIKAITQTTPLL

SEQ ID NO: 17248 - protein, 650 aa, Medicago truncatula
MVRVFPPPPTSVFDKLLGAIVRMGHYPTAISLFTQLQSKGISPSIATFTILINCYFHQSHTAFAFSLLATILKSGYQPNLVTFNTIINGFCINGMIFKALDFCQNLLAQGYLFDQFTYGTLINGLSKNGQIKAALHLLQEMEKSSVQPNLVMYSALIDGLCKDGFVSDALGLCSQIGERGILLDAVTYNSLIDGCCSVGRWQEVTQLLTKMVRENVDPDDYTFNILIDALCKEGRILEAQGVLAMMSKRGEKPDIVTYNALMEGYCSRENVHEARELFNRMVKRGLEPDVLNYNVLIDGYCKTKMVDEAMVLFKELCNKNLVPTIASYNSLIDGLCNSGRISHVKKLLDEMHGSAQPPDVVTYNILIDALCKEGRILEALGVLVMMMKKGVKPNIVTYNAMMDGYCLRNNVNVAKDIFNRMVKSGLEPDILNYNVLINGYCKTEMVDEAIVLFKEMRHKNLIPDIASYNSLIDGLCNLGRIPHVQELLDEMCDSGQSPDVITYNILLDAFCKTQPFDKAISLFRQIVEGIWPDFYTNHAIVDNLCKGEKLKMAEDALKHLLMHGCSPNVQTYTILINALCKDGSFGEAMLLLSKMEDNDRPPDAITFEIIIGVLLQRNETDKAEKLREEMIARGLVNIEKRLMYEEGGNL

SEQ ID NO: 17249 - protein, 348 aa, Listeria innocua
MKALKLYGKRDLRYEDADMPTIEQPDDVILKVKTVGICGSDISRYSKLGPYVPGMVWGHEFSGEVIEVGSAVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 17250 - protein, 589 aa, Bacillus clausii KSM-K16
MKVAIYHRPKSEDAYAYDKDTIHIRLRTRKDDAHEVMLIYGDPYDWAGNEWVTAKKTMTQAGADGEYDYWFVEVKPPYHRLRYGFEIKAKDETIYYGESGFCDTPAKDISDYFCFPFMNQADLFTPPEWVKETIWYQIFPERFANGDHSRDPENTLAWGSAPPTATNYFGGDLQGIVDHLDYLQKLGINGIYLTPIFKAFSNHKYDTIDYLKVDPQFGDETTLKLLVDECHKRGIRVMLDAVFNHAGLYFPPFQDVLKHQQESEYRDWFHIRQFPVRAEEPPNYDTFAFTPLMPKLNTANEAVKDYLLNVATYWIKEFDIDGWRLDVANEVDHAFWREFRNRVKALKPDLYILGEIWHNAYPWLQGDQFDGVMNYPLTDAIFDFVQHGKSATTFQYAVTKHLYSYPKLVNEVQFNLLGSHDTPRILTVSGGNKKLVKLSYLLLFSFPGSPCIYYGDEIGMAGENDPGCRACMVWEEDQQDQELFQFLQKLIKIRKTHQAMGTYNTLKFYDSGTEDVLLYSTSAGGELLLFAVNRSKQEATVKLPDSLKSLAFVDVICESPLQSEELHVEGECFLFLHSVDANKCGQVDK

SEQ ID NO: 17251 - protein, 346 aa, Nicotiana tabacum
MSKQGAFDLASGVGGKINKEEVLSAVDKYEKYHGYYGGEEEERKNNYTDMVNKYYDLCTSFYEYGWGESFHFAPRWKGESLQESIKRHEHFLALQLGLKPGQKVLDVGCGIGGPLREIARFSSTSVTGLNNNEYQISRGQVLNRKVGLDQTCNFVKGDFMKMPFPDNSFDAVYAIEATCHAPDPLGCYKEIYRVLKPGQCFAVYEWCMTDSYNPNNEEHNRIKAEIELGNGLPEVRLTTQCLEAAKQAGFEVVWDKDLADDSPVPWYLPLDTSHFSLSSFRLTAVGRLFTRNLVSALEYVGLAPKGSQRVQAFLEKAAEGLVGGAKKGIFTPMYFFVVRKPISDSQ

SEQ ID NO: 17252 - protein, 817 aa, Vibrio vulnificus
MKPTQQKQFDKVSFQESVKKHLSATYAHTLENADSRAWYLAMGRALAELTTFDLLATETDKKIVEAKSVNYLSLEFLIGRLTGNNLISMGLYEQITEAMAELGQNLTDLLEEERDPSLGNGGLGRLAACFMDSLAAQEFPTVGYGLHYEYGLFKQSFEAGRQKEAPDAWRGVEGYPWEVARPELAQEIGFYGHVEVINEGGKERRQWVPGMHVKAMPWDLPIVGYESDTVYPLRLWECQAIAPFSLESFNNGNYFEAQHALIDAGNITKVLYPNDNHEKGKTLRLMQQYFHSAASVRDILRRHEAAGHTLASLPNFETIQLNDTHPTIAIPELMRILIDEKGLNWDEAWAICSKTFAYTNHTLLPEALETWSESLIQHLLPRHMEIIYEINHRFLQEVRAKWPGDVAKQQKLSIIQEGFHRMVRMANLCVIGSYAVNGVAALHSELVKRDLFPEFDELYPTRLQNVTNGVTPRRWLKFCNPGLSALISEKIGTDWPAHLEQLEGVAKFADDAKFQKEYMAVKKANKERLANWVKENMNIDLDTNAIFDVQIKRLHEYKRQHLNMLHILSLYHRLLNDANFDMAPRVVFFAAKAAPGYHLAKEIIFALNKIAEKINNDPRIGNKLKVVFIPDYRVSMAEIIIPAADVSEQISTAGKEASGTGNMKMALNGALTIGTMDGANVEIREEVGDDNIYIFGLEVDGVEALKAKGYNPFDYYNADPLLKASMDLLLGEEFTPGQPGLLRATFDSLLDGGDPYLCLADFASYVKAHEAMDKQYRDQAGWAKKAILNTALVGKFSSDRSIRDYVNNIWKLEAVHR

SEQ ID NO: 17253 - protein, 508 aa, Pseudomonas fluorescens PfO-1
MTTTPKPLVLMILDGFGHSDSPESNAVYAAKKPVLDRLWATVPNGLISGSGMDVGLPDGQMGNSEVGHMNLGAGRVVYQDFTRVTKAIRDGEFFENPTICAAVDKAVAAGKAVHFMGLLSDGGVHSHQDHLIAMAELAFKRGAEKIYLHAFLDGRDTPPKSAASSIELLDATFQALGKGRIASLIGRYYAMDRDNRWDRVAQAYNLIVDGKGEINAATAQEGLEAAYARGESDEFVKATSIGEPVKVEDGDAVVFMNFRADRARELSRVFVEDGFKEFERARQPKVQYVGLTQYAESIPAPAAFAPGSLENVLGDYLAKNGKTQLRIAETEKYAHVTFFFSGGREEPFPGEERILIPSPKVATYDLQPEMSAPEVTDRIVEAIENQRYDVIVVNYANGDMVGHSGVFEAAVKAVECLDTCVGRIVEALEKVGGEALITADHGNVEQMADESTGQAHTAHTTEPVPFIYVGKRDLKVREGGVLADVAPTMLKLLGLEKPAEMTGTSILV

SEQ ID NO: 17254 - protein, 606 aa, Mycobacterium sp. MCS
MSAAPTLKKALNQRQLRMIAIGGVIGAGLFVGSGVVIADTGPGSFLTYAMSGVLIIMVMRMLAEMAVANPSTGSFADYSRNALGNWAGFSVGWLYWYFWVIVVGFEAIAGAKIIQYWIDVPLWASSLVFMVLMTATNLFSVKSYGEFEFWFAGIKVAAIVAFIALGALFVVGLWPGKDADFSNLTAHGGFMPMGFGVITVGIVTVIFSMVGAEIATIAAAESADPERAVSKAANSVIVRILLFYVGSALLLVTILPWNDEGIAASPFVAAFTEMGIPYADHVMNAVVLTAVLSCLNSGMYTASRMLFVLAARREAPPSLVRVTRRGVPAQAILASSVVGFLCVIAAAVSPDTIFAFLLNSSGAIILFVYLLIAVSQIILRRRTPDSELRVKMWLFPVLSVLTAVGIVAILVQMFIDDALRSQLVLSLLSWGVVLLLYFANKHFLKRRPTKAGVTGTGKPHRVLVLANQTVNSTELLDELHRIGADQETHYFVVVPVSPIETGTAETHGPLDVEEATQKAASERLDLTLNALRGHDFTADGELGDRRPLRALADAVESFDPDQIVISTLPPEKSVWQRFDVVDRARAQHRVPVTHVVATGAEATATP

SEQ ID NO: 17255 - protein, 174 aa, Zea mays
SPPPSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAV

SEQ ID NO: 17256 - protein, 140 aa, Novosphingobium aromaticivorans DSM 12444
MAVTRTFSIIKPDATRRNLTGAVTKMLEEAGLRVVASKRIHMSREQAEGFYAVHKERPFFGELVEFMISGPVVVQVLEGEDAVKRNRDIMGATNPKDAAPGTIRKELAESIEANSVHGSDSEENAAIEIAYFFKPEEIVG

SEQ ID NO: 17257 - protein, 382 aa, Burkholderia vietnamiensis G4
MSNAMSAGRPADSRADIATALEIIEEARAGRMFILVDDEDRENEGDLVIPAQFATPDAVNFMATHARGLICLAMTRSRCESLGLHLMSRINGSRHETAFTVSIEARDGVSTGISAADRSRTISLAINPETGRDELVSPGHVFPLMARDGGTLVRAGHTEAAVDIARLAGLAPAGAICEIMNDDGTMARLPDLIAFSRRHQLKLGTIADLIAYRRRTERLVEAVEHGSFTEPNGRHWRIVVYRNRIDQVEHIAFVMGDLRGADPVLVRMHAMDTMNDVIGGHHLASLRGAARLLENENRGVIVVIRESRLTAVSERVRAMMHPKPAEPELRDYGIGAQILTELGVKNMILLSNHERTIVGLEGYGLNMVEQRKIERIHDYQEV

SEQ ID NO: 17258 - protein, 825 aa, Pseudoalteromonas tunicata D2
MAHSKNDVCKLKTAHDAPLIDEISLQEDLDRHFYYTLGRDVVGESRLYLYHALALTIRDRLVALCRSTRQMQKANPTRQVAYLSLEFLMGRALGNAVLNLDLEDNVRKALADYCSTFESVAEAEHDAGLGNGGLGRLAACFLDSCATLGLPVTGYGIRYEYGMFNQSIEQGNQVEHPDNWLREGHPWEITAPDHSRRVKFFGHVEIYQDKQGRKHHQWVGTQDVLAVAYDVPVPGYRNDVVNTLRLWKSEATDEFNLSEFNAGSYTEAVARKNLAEQITMVLYPNDSSENGKELRLRQQYFLSSASLQDILASWVSRYDKDFTNFAKFNVFQLNDTHPSIAVAELMRLLIDDYDLEWDSAWAITTSTMAYTNHTLLPEALEKWSVTLFARLLPRLLEIIYEINARFLMEVACRWPGDTDKQCAMSLIEEGSHPQIRMAYLAIVGSFSVNGVAALHTELLTQGLFNDFYQLWPEKFNNKTNGVTPRRWLSHCNPLLADLISEKIGTDWVADFGQIEKIRRYYDNPTFGQQWREVKEHNKQELIDLVRVQCGVEFDASMMFDVQVKRIHEYKRQLLNILHVIYLYERIRKGDTANLTPRCVLLGGKAAPGYFMAKLIIKLFNNVADAINSDPLAKPYLRVAFLPNYNVTAMETICPATDLSEQISTAGKEASGTGNMKFMMNGAITIGTLDGANIEIRDAVGADNFFLFGAKSEELTQIRANYNPNKIIAENQALNEVMSLLESGHFNLFEPGLFQPIIDSIRDSNDQWLVAYDFDSYIKAQQQVELAYQDKEYWTRLSILNTAASGGFSSDRTIKQYSQDIWQLDQ

SEQ ID NO: 17259 - protein, 1137 aa, Arabidopsis thaliana
MGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHKKDCGLKAQKKERVAKRLQRDRDKKTMLKRDCSSVVGSERERDGSSLALKRHCSSVVKLLLPHDVVGLILERLPVESLLRFKCVSNQWKSTIESQCFQERQLIRRMESRGPDVLVVSFADDEDKYGRKAVFGSSIVSTFRFPTLHTLICYGSCEGLICIYCVYSPNIVVNPATKWHRSCPLSNLQQFLDDKFEKKEYDFPTPKLAFGKDKLNGTYKQVWLYNSSEFRLDDVTTCEVFDFSNNAWRYVHPASPYRINDYQDPVYSDGSVHWLTEGKESKILSFHLHTETFQVLCEAPFLRERDPVGDSMCILDNRLCVSEINGPAQLIWSLDSSGGNKC

SEQ ID NO: 17260 - protein, 411 aa, Streptomyces coelicolor A3(2)
MHSAVLLIEFGSIILGLGLLGRFAGRYRLSPIPLYLLAGLAFGEGGLLPLGASEEFVATGAEIGVILLLLMLGLEYTASDLVTNLKSHYPAGLVDCALNAVPGAVAALLMGWGPVAAVVLAGVTWISSSGVIAKVLGDLGRVGNRETPVILSVLVLEDLAMAVYLPIVTALVAGAGLMTGSITLAVALAAAGLVLFVAVRYGRLISRFVSSDDPEKLLLVVLGLTILVAGVAQQLQVSAAVGAFLVGIALSGEVAEGAHTLLSPLRDLFAAVFFVFFGLHTDPASIPPVLLPALALALLTAVTKIATGYWAARRAGISVKGRWRAGGALVARGEFSIVIAGLAVSAGIEPSLGPLATAYVLILVVLGPLTARFTEPLAMRLFPRRDNPDRPSGLAEGTPRAAATEEASVGD

SEQ ID NO: 17261 - protein, 153 aa, Brassica napus
  misc_feature (138)..(138): Xaa can be any naturally occurring amino acid
  unsure (1)..(153): unsure at all Xaa locations
SLSLSLALAPKLFLAAMSGTFSLNSNYVPGYTLSVSVSDSRCFYNPAVYRRTPATLPFSSCLDHKRNGSLKCSPDSSSFVCQASSGGYRRNPDFSRLNKHGRNRQSVDGDGFDGDNSDMLSSRNGSLLSLSNSPKFQXATSSPGPREKEIVEL

SEQ ID NO: 17262 - protein, 273 aa, Vibrio cholerae
LLETEQDERILNSKSLNYLSLEFLIGRLTGNNLISMGVYEAVGQAMEELGQNLSDLLEEERDPSLGNGGLGRLAACFMDSCAAQEYPTVGYGLHYEYGLFKQSFEEGRQKEAPDAWCGVEGYPWEVARPELKQEIGFYGHVEVVNENGKERRRWVPGMLVQAMPWDLPIVGYQSDTVYPLRLWECRAIAPFSLESFNNGNYFEAQHALIDAGNITKVLYPNDNHEKGKTLRLMQQYFHSAASVRDILRRHEAAGHALADLPKYETIQLNDTHP

SEQ ID NO: 17263 - protein, 181 aa, Brassica napus
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDARYWTMWKLPLFGCTDSAQVLKEVQECKTEYPNAFIRIIGFDNNRQVQCISFIAYKPPSFTGA

SEQ ID NO: 17264 - protein, 364 aa, Cupriavidus necator
MPEVQRMTLTQFLIEERRRYPDASGGFNGLILNVAMACKEIARAVAFGALGGLHGKASNQAGEAGAVNVQGEIQQKLDVLSNTTFLRVNEWGGYLAGMASEEMEAPYQIPDHYPRGKYLLVFDPLDGSSNIDVNVSVGSIFSVLRAPEGASAVTEQDFLQPGSAQVAAGYALYGPTTMLVLTVGNGVNGFTLDPNLGEFFLTHPNLQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 17265 - protein, 1147 aa, Schizosaccharomyces pombe
MSFLFKRNKGSAHKPTKPNFSKTSTTPSTSQLKHSHESNVKMSTSTVTEHRKKPTGSGSHITASPWSKLTVRGSSNVLPRYSHASHLYAEGGQEIYIFGGVASDSQPKNDLWVLNLATSQFTSLRSLGETPSPRLGHASILIGNAFIVFGGLTNHDVADRQDNSLYLLNTSSLVWQKANASGARPSGRYGHTISCLGSKICLFGGRLLDYYFNDLVCFDLNNLNTSDSRWELASVVNDPPPARAGHVAFTFSDKLYIFGGTDGANFFNDLWCYHPKQSAWSKVETFGVAPNPRAGHAASVVEGILYVFGGRASDGTFLNDLYAFRLSSKHWYKLSDLPFTPSPRSSHTLSCSGLTLVLIGGKQGKGASDSNVYMLDTSRFRLGSVPTTSGRQRNTSFFSNSTGNTNPSAFNGLLTSSRIPSYNGSKVRSTSHPSRQQYIGSSNSRFNTRHQTISTPVSGRASNDLPSPVVPTRSNSSSILQPSYNLNSHSSDRRNTNDDDQSSLNSQQLSNQAKAQGEVSPTLSFVPSSHSMEQGNGSVASANNAQSEAATRSINSISEVSEVRFPEQSSVKTVDERKSLDGRITSVTLETLVEKYSELSKQQIVEWFKSKLYEILRDSASKIDSLTEKLKVANAEKNAALCEAALEKVPLAKHNKLSDGTFSTPDKENVQSTNDAHIMQENFSLHKALEVMRETSSDLDKQLKDATASQKELIVQTSSFQKELVEERERHNAISKRLQEIESLYRDRELLVTNLEDQLVDQTVTINKFAFERDQFRERSMGFENTIKDLTRKMEATDMLNVSLHESLRSVQTENSELVTEMALLKAELVKKQAIIDANANIYDKLTADHTNYETVSADINQNLKETLDKLLNGSSDFKNNEIELLHDQIRITNAKLEKREKLINASKYIEDTLRSEIQEAAEKVSNLEFSNFNLKEENSNMQLQLMKALEQRNTGAKQLVNLRMQLSTATSELDMLKLKLRTTALALEESPDDYSDILSILRADMSPFHDLHKQCGVLIDTLNGVKRGFGIFEKKFTDYHKFLENISDKLKSEEDTSLETPIHENQSIQSDQIKEVGEVLSAIKSLSDSVMLLKNQIDDLAKEKLPLSSSDDEKVNIKEKTDFMKLLVKSGLSNPPAKEPVHDNEN

SEQ ID NO: 17266 - protein, 273 aa, Vibrio cholerae
LLETEQDERILNSKSLNYLSLEFLIGRLTGNNLISMGVYEAVAEAMEELGQNLSDLLEEERDPSLGNGGLGRLAACFMDSCAAQEYPTVGYGLHYEYGLFKQSFEEGRQKEAPDAWCGVEGYPWEVARPELKQEIGFYGHVEVVNENGKERRRWVPGMLVQAMPWDLPIVGYQSDTVYPLRLWECRAIAPFSLESFNNGNYFEAQHALIDAGNITKVLYPNDNHEKGKTLRLMQQYFHSAASVRDILRRHEAAGHALADLPKYETIQLNDTHP

SEQ ID NO: 17267 - protein, 444 aa, Thiomicrospira crunogena XCL-2
MTLEEAKKLLADNDVKYILAQFVDIHGVAKTKSVPANCLEDIVTSGAGFAGFAVWGLGLEPHQSDYLAKADLSTLSLVPWQPGYARVACTGHVNGQPYAYDSRYIMLKQIERLSEKGWTLNTGIEPEFSLLRKDENGQMVPFDKTDVLDKPCYDYKGMSRSRQFLETFVDSLQQVGFDVYQIDHEDANGQFEINYTYSDAKTSADRITFVRMAGSEIANEMGMTCSFMPKPNSSRTGNGFHYHLSITDEQGRNLFSDDSDENNLGLSEMAYHFLGGLIHHAKALCAFSAPTVNSYKRLVVGRSLSGATWAPAFISYGDNNRTAMVRVPYGRLEFRLPDSGSNSYLVTAAIIAAGLDGIEKKMDPGTPKNINHYSLSMEELADLGVETLPQSLSEAIHELERSTLFHEQFGEAFVKEFIDIKRMEWVEYQRHVSDWEINRYVEFF

SEQ ID NO: 17268 - protein, 153 aa, Triticum aestivum
NKFVQKSRLVPVRNSRDIVDPRVRSPRHLRNPLLALLFLAAAAASAAQIAMAAEPEQQAAVHIVYVDRPEDADPEEFHIRTLAPVLGSEEKARGAVLYHYKHAASGFSAKLTTEQVEDLKKQPGVLQVVPSQTYQLHGHEGGHASTTRTMGLM

SEQ ID NO: 17269 - protein, 1065 aa, Bacillus cereus E33L
MDKKVSAIPQPKTYGPLGNLPLIDKDKPTLSFIKIAEEYGPIFRMQTLSDAIIVVSGHELVAEVCDETRFDKSIEGALAKVRAFAGDGLFTSETDEPNWKKAHNILMPTFSQRAMKDYHAMMVDIAVQLVQKWARLNPNENVDVPGDMTRLTLDTIGLCGFNYRFNSFYRETPHPFITSMTRALDEAMHQLQRLDIEDKLMWRTKRQFQHDIQSMFSLVDNIIAERKSSGNQEENDLLSRMLNVQDPETGEKLDDENIRFQIITFLIAGHETTSGLLSFTIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEDYQLGVKQTLTLKPGDFKIRIVPRNQTISHNTVLAPTEEKLKNHEIKQKVQKIPSIIGADNLSLLVLYGSDTGVAEGIARELADTASLEGVQTEVAALNDRIGSLPKEGAVLIVTSSYNGKPPSNAGQFVQWLEELKGDELKGVQYAVFGCGDHNWASTYQRIPRYIDEQMAQKGATRFSTRGEADASGDFEEQLEQWKESMWSDAMKAFGLELNKNIEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYHEQILKKRISMLDLLEKYEACEIRFERFLELLPALKPRYYSISSSPLVAQNRLSITVGVVNAPAWSGEGTYEGVASNYLAQLHNKDEIICFIRTPQSNFQLPENPETPIIMVGPGTGIAPFRGFLQARRVQKQKGMKVGEAHLYFGCRHPEKDYLYRTELENDERDGLISLHTAFSRLEGHPKTYVQHVIKQDRIHLISLLDNGAHFYICGDGSKMAPDVEDTLCQAYQEIHEVSEQEARNWLDRLQEEGRYGKDVWAGI

SEQ ID NO: 17270 - protein, 468 aa, Pseudomonas fluorescens PfO-1
MSKSVQLIKDHDVKWIDLRFTDTKGTQHHVTMPARDALEDDFFEVGKMFDGSSIAGWKGIEASDMILLPDDETAVLDPFTEEPTLILVCDIIEPSTMQGYDRDPRAIARRAEEYLKTTGIGDTVFAGPEPEFFIFDEVKFKSDISGSMFKIYSEQGSWMSDQDVEGGNKGHRPGVKGGYFPVPPFDHDHEIRTSMCNALEEMGLTVEVHHHEVATAGQNEIGVKFNTLVKKADETQTLKYVVHNVADAYGRTATFMPKPLYGDNGSGMHVHMSISKDGKNTFAGEGYAGLSDTALYFIGGIIKHGKALNGFTNPATNSYKRLVPGFEAPVMLAYSARNRSASIRIPYVNSPKGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 17271 - protein, 362 aa, Mycobacterium sp. MCS
MSQTVRGVISRSKQQPVEVVDIVVPDPGPGEVVVDIIACGVCHTDLTYREGGINDEYPFLLGHEAAGTVESVGEGVTNVVPGDFVILNWRAVCGQCRACKRGRPHLCFDTHNAAQKMTLTDGTELTPALGIGAFADKTLVHEGQCTKVDPAADPAVAGLLGCGVMAGIGAAINTGAVGRDDTVAVIGCGGVGDAAIAGAALVGAKKIIAVDTDDKKLQWAREFGATDTINARSVDDVVEAIQELTDGFGTDVVIDAVGRPETWKQAFYARDLAGTVVLVGVPTPDMRLEMPLVDFFSRGGSLKSSWYGDCLPERDFPTLISLYLQGRLPLDKFVSERIGLDGIEDAFHKMHAGEVLRSVVVL

SEQ ID NO: 17272 - protein, 90 aa, Zea mays
MAAAATKASSWMVAMSVGAVEALKDQGGLCRWNYALRSVHRTAKANVRSGFAAQRDKDLAPAAEKGRQEDKAAAEEGLRTVMYLSCWGPN

SEQ ID NO: 17273 - protein, 144 aa, Vibrio fischeri ES114
MTIERTFSIVKPDAVKRNLIGAIYRRIEKTGMQIVAAKMLRLTKEQAEGFYAEHEGKEFFDELVAYMMSGPVMVQVLEGENAVVRYRELMGKTNPEEAACGSLRADYAISMRYNSVHGADSPESAAREIAYFFAEDEICPRPAE

SEQ ID NO: 17274 - protein, 528 aa, Zea mays
  misc_feature (185)..(185): Xaa can be any naturally occurring amino acid
  unsure (1)..(528): unsure at all Xaa locations
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATXLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 17275 - protein, 428 aa, Bacillus cereus E33L
MKNKAIGLFQGIALYISAILGSGVLFLSGVTASIAGPASIVSWFIVIIISFPLAYSFASLARIFPDSGGAATFVRNSFGYHLGNIVGWFYFVTAAVGQTIVSLTGAFYVSQAFGFSHFETILIAVFILVIAGVSNYYGVNVSGKVALILSSLLLILLASAVFVAFPRIQWGNFNPFVPNGWFSVGNAITVIFWSFFGWEAICNLAEHFKRPEKDIVKGAVISVVVIGLLFLALSLVTIGTATYGSQESNLSPIGVIMGDTVGGGAKVVTAVLALIICTGTANAFVASLTQLGYSLSRDGAFPKFFSRLHATTQIPRQMVLFVICFSVAGVLVTKALSLTFDDILFIPTSLGILVYVLSMAAGVKLFRKNTPAWWASLISFILCLLVIPFFQLYIFVPLIVVAIYTIYMILSNKIFAYKGGLKSNEGSK

SEQ ID NO: 17276 - protein, 299 aa, Streptomyces thermotolerans
MAALLKRILRRRMAEKRSGRGRMAAARTTGAQSRKTAQRSGRSEADRRRRVHGQNFLVDRETVQRFVRFADPDPGEVVLEVGAGNGAITRELARLCRRVVAYEIDRHFADRLREATAEDPRIEVVAGDFLKTSQPKVPFSVVGNIPFGNTADIVDWCLNARRLRTTTLVTQLEYARKRTGGYRRWSRLTVATWPEVEWRMGERISRRWFRPVPAVDSAVLRLERRPVPLIPPGLMHDFRDLVETGFTGKGGSLDASLRRRFPARRVAAGFRRARLEQGVVVAYVTPGQWITLFEELHGR

SEQ ID NO: 17277 - protein, 222 aa, Petunia inflata
MVKSRIISVFFIFLFSFSPVYGNFEYLQLVLTWPASFCFRPKNICKRPAKNFTIHGLWPEITGFRLEFCTGSPKYETFKDNNIVDYLERHWVQMKFDENYAKYHQPLWSYEYRKHGMCCSKIYNQKAYFLLATRLKEKFDLLTTLRTHGITPGTKHTFGDIQKAIKTVTNQVDPDLKCVEHIKGVQELNEIGICFNPAADNFYPCHHSYTCDETDSKMILFR

SEQ ID NO: 17278 - protein, 115 aa, Arabidopsis thaliana
MPSLQTSLPPELANNVVRLYRECLRRAKFIGKQSLSNLEQNVERFSFVSVDSLEQHNTELVVGMVRQQFKKHMNETDPEKIQKLKDDAARGLINHMLFESAKLTGGKANNATKLA

SEQ ID NO: 17279 - protein, 222 aa, Petunia inflata
MFKSQLISALFISLFAFSPVCANFDYIQLVLTWPASFCYRPKNICRRIPNNFTIHGLWPEKEHFRLEFCDGDKFVSFSLKDRIVNDLERHWVQMKFDEKFAKIKQPLWTHEYNKHGICSSNLYDQRAYFLLAMRVKDKFDLLTTLRTHGITPGTKHTFGEIQKAIKTVTNNKDPDLKCVEHIKGVKELKEVGICFTPAADSFHDCRHSNTCDETDSTKILFR

SEQ ID NO: 17280 - protein, 258 aa, Parvularcula bermudensis HTCC2503
MSDAELRRTRAGRPVWHYRAVGSTNDTAAELARMQGEMDRSPCWVIADHQTAGRGRRGRAWSDHADNFSGTLLWPLAPEHGRTPALFSFLAALAIVDSFEAVGIPRTIIGLKWPNDVLLEGGKVCGILVETVAGLEGLMAATIGIGVNLAQVPPHAPPEGRALSQWITPPPPTAFLETLDARFDEWWAIYGAHGFSRIRSAWLERATGLNQALVVRLSDRTLEGIFRGLDKDGALLLEHQGEVTRFLAGDVFLRRQTA

SEQ ID NO: 17281 - protein, 181 aa, Solanum tuberosum
MASSVISSAAVATRTNVTQAGSMIAPFTGLKSAATFPVSRKQNLDITSIASNGGRVRCMQVWPPINMKKYETLSYLPDLTDEQLLKEVEYLLKNGWVPCLEFETEHGFVYRENHKSPGYYDGRYWTMWKLPMFGCTDATQVLAEVQECKKSYPQAWIRIIGFDNVRQVQCISFIAYKPEGY

SEQ ID NO: 17282 - protein, 248 aa, Burkholderia vietnamiensis G4
MYKLVLIRHGESTWNKENRFTGWVDVDLTEQGRNEAYQAGALLKEAGYTFDIAYTSVLKRAIRTLWHVQDKMDLMYLPVVHSWRLNERHYGALSGLNKAETAAKFGDDQVLVWRRSYDTPPPALEPTDERAPFSDPRYAKVPREQLPLTECLKDTVARVLPLWNESIAPAVRAGKQVLIAAHGNSLRALIKYLDGISDSDIVGLNIPNGVPLVYELDENLKPIQHYYLGDQDAIAKAQAAVAKQGKAG

SEQ ID NO: 17283 - protein, 220 aa, Petunia x hybrida
MFKSHLTAVIFILLFSLPPIYGDFDYMQLVLTWPASFCYRPRYLCKRTAPNNFTIHGLWPDNEQRRLQFCTSTEYSLFDGDILDDLDRHWIQLKFDKETGMQDQPLWHEQFRKHGTCCENRYKQMPYFLLAMRLKNKFDLLTTLRTHGIIPGTKHTFDEIQKAIKTVTNQVDPDLKCVQHIQGVPELNEIGICFTPAADRFFPCPQSKSCPKTGTKILFR

SEQ ID NO: 17284 - protein, 204 aa, Magnetospirillum magnetotacticum MS-1
MTVFLVRHGQSEGNRDVVFSGLSDHPLTPLGRAQAAEAGRSLLGLRFAHVLTSCLSRAVETCDLLLAASGSEVGNRRRLERLNERNFGVFEGNADDSATLAADPIRRSVAYDVAYRPEGGESMLDCLERSVICFEADILPLAVDGHVLVVTHGNVVRSLALYHLGWPVDMLPEMPSRNCLITRIEPLGWVKPARTARWPGGSHP

SEQ ID NO: 17285 - protein, 180 aa, Solanum tuberosum
MASSVMSSAAVATRGNGAQASMVAPFTGLKSAASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 17286 - protein, 172 aa, Arabidopsis thaliana
  misc_feature (6)..(6): Xaa can be any naturally occurring amino acid
  misc_feature (94)..(94): Xaa can be any naturally occurring amino acid
  misc_feature (101)..(101): Xaa can be any naturally occurring amino acid
  misc_feature (106)..(106): Xaa can be any naturally occurring amino acid
  misc_feature (113)..(113): Xaa can be any naturally occurring amino acid
  misc_feature (118)..(119): Xaa can be any naturally occurring amino acid
  misc_feature (121)..(121): Xaa can be any naturally occurring amino acid
  misc_feature (123)..(123): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(134): Xaa can be any naturally occurring amino acid
  misc_feature (139)..(139): Xaa can be any naturally occurring amino acid
  misc_feature (142)..(142): Xaa can be any naturally occurring amino acid
  misc_feature (144)..(144): Xaa can be any naturally occurring amino acid
  misc_feature (155)..(156): Xaa can be any naturally occurring amino acid
  unsure (1)..(172): unsure at all Xaa locations
MASSMXSSTAVVTSPAQATMVAPFTGLKSSASFPVTRKANNDITSITSNGGRVSCMKVWPPIGKKKFETLSYLPDLSDVELAKEVDYLFRNKWXPCVEFEXEHGFXYREHGNXSGYYXXTXYXQFXRFPFXGXXDSVKXFKXVXDSKKGSLGLIXXPGLENGHDFSLSPSFR

SEQ ID NO: 17287 - protein, 180 aa, Solanum tuberosum
MASSIVSSAAVATRANGAQASMVGPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 17288 - protein, 180 aa, Solanum tuberosum
MASSVMSSAAVATRGNGAQASMVAPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 17289 - protein, 269 aa, Methylococcus capsulatus str. Bath
MTDPVTLPDLLAMKRRGEKIACLTAYDASSAALQDEAGIEVILVGDSLGNVIQGQPTTLSVTLDHMVYHTACVQRAARRALVLADLPFLSYCTPEQAVRSAARLIRDGGAQVVKLEGGRERLDVVRFLTEQNVPVCGHLGLQPQAIHRLGRYALQGRDAESACRMVEDARQLAEAGAMLLVLECIPWELAQEITAAVDIPTIGIGAGRHCDGQVLVWQDMLGMSARLPRFCKDFLAGNAGVREAVSAYVREVKAGIFPGDRHSFGRDGP

SEQ ID NO: 17290 - protein, 404 aa, Arabidopsis thaliana
MTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNAKKETLVKGLKEVGFTVFPSSGTYFVVADHTPFGMENDVAFCEYLIEEVGVVAIPTSVFYLNPEEGKNLVRFAFCKDEETLRGAIERMKQKLKRKVLSLN

SEQ ID NO: 17291 - protein, 463 aa, Burkholderia thailandensis E264
MKGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGIGAVLAAMLTTMFSFLGTEIVTIAAAESEHPERQIVRATNSVIWRISLFYLGSIFVVAALVPWNDALLPAHGSYQRAMELIGVPHAKAIIDVIVLVSVASCLNSALYTASRMIFSLSRRGDAPALLRRTDASGTPRAAVLASTAFGFITVIANYVMPEQVFGFLLATSGAIALLVYLVIAISQLRMRKMLDATGERLQLRMWCFPWITWAVILFICGVLTVMLVSEAHRMEVGATAVLALIVLAASWLNKRGRDAQASVGRRVSAT

SEQ ID NO: 17292 - protein, 251 aa, Zea mays
MVKRSKKSKSKRVTLRQKHKVLRKVKEHDMEKMVTKADPSKRIVLLHNKIDLVPKEAVEKWLTYLREEMPTIAFKCNTQEQRTKPGWKSSKLDKTNSIPQSSDCLGAENLIRLLKKYSRSHELKLAITVGIVGLPNVGKSSLINSLKRSRVVNVGSTPGVTRSMQEVQLDKKAPMEAMELVVALTACADSVAACNHDVANYYLVRLGEMASPAGPTLMHRVAAYFVEVLTLRMVHAKAFKFAKLHSKNMYQ

SEQ ID NO: 17293 - protein, 309 aa, Xanthomonas campestris pv. vesicatoria str. 85-10
MSGWTLADLPSQRGRVAIVTGASPGGLGYETALALAGAGAHVVLTARNPDRGEAARWALLARHSEAEVRVEALDLASLASVRAFAKRLTTRHAAVDLLINNAGVMAPPQRQTTADGMELQLGSNYLGHFALTAQVLPLLRAASAPRVVNLSSLAHRQARIDFDDLQSERPYRPWKAYGQSKLAMLMFSLELQRRSNTHGWGVRAIAAHPGIARTALIANGPDGAGRRSASGVATGLFTRCIGHSASAGARPTLYAATSPQAQAGGYYGPNGLFELKGDPAPAKIAHQAHDQQVAARLWDTACALTGVAF

SEQ ID NO: 17294 - protein, 183 aa, Magnaporthe grisea 70-15
MVPDNKTGRRRRSSSILQVYHEPQEPIDQLNDQSTLPNLNAEWVNAKGAWGIHIVLIIALKILYDVIPGVSQETSWTLVNISYMLGSYIMFHYVRGVPFEFNAGAYDNLNMWEQIDDGAQYTPAKKFLLSVPIVLFLLSTHYTHYDLTYFTINFLAVLGVVIPKLPFSHRMRVGLFSGPPEDQ

SEQ ID NO: 17295 - protein, 318 aa, Oceanospirillum sp. MED92
MSNIRLQCANGDSLPMIGLGTWKAKPGEVYEAVKSAIEVGYRHIDCASVYGNEAEIGQAIADQINAGTVSRDELWITSKLWCDSFAAEDIKPALISTLHDLQLEYLDLYLMHWPIPLKKGHGMRTADDFVDPVLLPYPDTWLNMNQLSAEGLVRHYGVSNFTVKKLKVLLENTPFKPAVNQVELHPYLQQADLVNFCQGAGIHLTAYSPLGSSDRPDPLKQAGEPVLLENSVIGEIAKELSASAAQVIIAWLNSQGISTIPKSTHLDRQKQNLDSRHLNLSEEQVNKIAEIDLARRYITGEFWIKDEGFYTLEDIWDE

SEQ ID NO: 17296 - protein, 816 aa, Pseudomonas fluorescens PfO-1
MTQEPLVREAEVAAFRDAVLTKLTYAVGKDPDHAFDHDWFEAIALAARDHMVEHWMDHTRQIYRKGQKRVYYLSLEFLIGRLLYDSLSNLGLLDVAREALTELGVDLERIRILEPDAALGNGGLGRLAACFMESMSTLGIAGHGYGIRYEHGLFRQAIVDGWQQEQTEHWLDFGNPWEFERPEVVYPIGFGGSVETVTDANGNSRQVWHPAETVRAIAYDTPVVGWRGASVNTLRLWRARAMEDLHLERFNAGDHLGAVAEVARAESISRVLYPADSTEAGQELRLRQEYFFVAASLQDLLRRHRNMHTSVLTLGDHAAIQLNDTHPSIAVAELMRQLVDVYDVAWDAAWQVTVDTLSYTNHTLLPEALETWPVGLMERMLPRHMQIIYLINAQHIDSLRAKGIHDFDVLRAVSLIEEDNGRRVRMGNLAFLGSHSVNGVSGLHTQLMRKTVFAELHKLYPERINNKTNGITFRRWLYQANPELTSMLVDALGPDVLDNPEERLLDLEPFAEKPAFRKAFAEQRLHSKKALAYLIHERLGIAVNPAAMFDVQVKRIHEYKRQLLNLMHTVALYQAIRAEPEIDWVPRVKIFAGKAAASYHQAKLIIKLTNDIARVVNNDPTVRGLLKVVFLPNYNVSLAESIIPAADLSEQISTAGFEASGTSNMKFGLNGALTIGTLDGANVEMCENIGAEHMFIFGLSAQQVEARKQNHEFSAVPDIAASHRLNDVLQAIRSGVFSPDDTSRYTGLIDSLVDYDRFFVCADFDSYWEAQMRVDAHWHDANNWWRSAVLNTSRMGWFSSDRTIREYATDIWKALE

SEQ ID NO: 17297 - protein, 336 aa, Pseudomonas fluorescens PfO-1
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 17298 - protein, 390 aa, Legionella pneumophila str. Lens
MHDGSVFYTIFLIFAGAAFFSTLVLYTKQSLLVAYITLGAILGPWGFKLVSDVTVVKQIGDIGIVFLLFLLGLHLQPQNLIHMLRKVTWIAIVSSILFAALAYGIGRWFGLTVTESLILGGAMMFSSTIIGLKLLPTTILHHQHTGEVMISVLLMQDVIAIVLLILLNSAHQDGNLSINDFILVIIALPALCLFSFLFERYILIKLLARFDRTQEYVFLLSIGWCLGISVLAQTIGLSEDIGAFIAGVALASSPISLFIAESLKPLRDFFLVMFFFSIGATFNFGFGAQVVIPAVILATLILIIKPLLFYILLARSGEKKQVAKEVGIRLGQGSEFSLLVASIALSANLISEVASNLIQATTILTFIVSSYLVVLKYPTPIALSEKMRKD

SEQ ID NO: 17299 - protein, 444 aa, Chlorobium tepidum TLS
MPFIVNTDAERAEMLREIGVENFEALIADIPEEIRLKKALDLFPAMGEPEVKSLLEKMASGNAATCDHVSFLGAGAYDHFIPSAVKTIASRSEFYTAYTPYQAEVSQGTLQAIYEYQSVMCRLYGMDVANASMYDGASALAEAALIALNVTGRNGIVVAGKLHPYTSQVLETYLEAAGDRSIVQNGLENGIGSVEALEALVSSETAAVIVQQPNFYGCLEEVEAIGEIARKNGALFIVSADPVSLGVLEAPGNYGADIAVGEGQSVGNAQSFGGPYLGILTVKQAHVRKIPGRLVGMTKDKDGNDGFILTLQTREQHIRREKATSNICSNQALCALQSVVHLSLLGKEGIRDVANRSMQKAHYLADRIAELPGYSMKFSAPFFREFVVETPVPSATIIEKMLEKKVFAGVDLSAWGEDGLLVAVTEKRTKEELDSFVSELAALG

SEQ ID NO: 17300 - protein, 399 aa, Oryza sativa
MSFSRLLTPRILLDTTAVFPPSSSVVAPSLSRQLRCTRTGGSPPAPPHRLVARRAMSNGAAEPAIYGGGGGAQQAASSAAARRVTLATLRGKHRRGEPISMVTAYDYPSGVHVDAAGFDICLVGDSAAMVAHGHDNTLPISLDLMIEHCRAVARGAARTFLVGDLPFGSYEASTAQAVGSAVRVMKEGGVNSIKLEGSAPSRISAARAIVDAGIAVMGHIGLTPQSVSALGGFRPQGKTVESAVKVVEAALALQEAGCFAVVLECVPAPVAAAATSALTIPTIGIGAGPFCSGQVLVYHGLLGTFQTSHAKVSPKFCKQYGNIGDVINRALSKYKQEVETQSFPGPSHTPYKLAATDVDAFLNALKMKGLNVAADAAADAVEYTDEKEIDGTPQLKVYA

SEQ ID NO: 17301 - protein, 425 aa, Zea mays
MRVSVRAWLALRSPFTHVQPSFVSGLNSPALPETPSHGRLCFLLRQPRRRPPPQLSGAAMEALHEEMPFDLDFHPSSPLVVTSIITGELCLFRYGPESQPERLLLLKAHKESCRAVRFVDSGKVILSGSADCSVLASDVESGKAIARLEDAHENAINRLVCLTESTIATGDDEGCIKVWDTRERSCCNSFEVHDDYISDMTYVAETNQILATSGDGTLSVNNLRRNKVRSRSEFSEDELLSLVLMKHGKKVVCGTPSGALLLYSWGYFNDCSDRFIGHTQSVDTMLKLDEDTLVSGSSDGVIRLVGILPNRIKQPLAEHSEYPIEALALSNDKKYLGSISHDKMLKVAMLSLSLLLWDLEELLSGPQVANGDEPAEAGSDDSDDDSDDDVMDVDMAATSSKGSRSKKAGKGQSSSRPASDFFADL

SEQ ID NO: 17302 - protein, 511 aa, Rhodobacter sphaeroides 2.4.1
MHSARPSGQPQIHCPREDQMLDSVTDLRSLLKDPSLLETRAFVAGEWVDADDGATFEVTNPARGDVICTVPDLGRAETARAIAAAEEAMKEWAARTGKERAQVMRKWFDLMMANQDDLGAILTAEMGKPLAEAKGEIAYGASFIEWFGEEAKRIYGETIPGHMRDKRITVLKQPIGVVGSITPWNFPNAMITRKCGPALAAGCGFVARPAAETPLSALALAVLGERAGLPKGILSVITSSRSSDIGKEMCENPIVRKLTFTGSTEVGRILLRQAADQVMKCSMELGGNAPFIVFDDADLDAAVQGAMASKFRNNGQTCVCANRIYVQSGVYDAFAEKLAAAVKKLKVGDGLVEGTEAGPLINEKAVAKVEEHIRDVLDGGGQVLTGGKRHALGGTFFEPTVVTGVKQEMKVSTEETFGPLAPLFRFETEDEAVGYANDTIFGLASYFYARDVGRITRVQEALEYGIVGVNTGIISTEVAPFGGVKQSGLGREGSRHGIEDYLEMKYICLSI

SEQ ID NO: 17303 - protein, 280 aa, Flavobacteria bacterium BBFL7
MAKYNKHKSAHKGSDKGVTAKKHLGQHFLKDEDVAQRIADVLSYDGYDQILEIGPGTGVLTKHVIRKNMKVTALELDSESVIYLKHSFPLEHVKIVNDQTFQVIEADFLKKDLKEIYGEQSFAIIGNFPYNISTQIVFKTIENREQIPEFGGMFQKEVAQRICAPHGSKTYGILSVLAQAYYEADYVFTVGPEVFDPPPRVDSGVLFLKRRDNYDNLTCSYSILRQVVKLAFQQRRKTLRNSLKTLNLPDEMREKDIFSLRPEQISVDAFVELATEIEKL

SEQ ID NO: 17304 - protein, 377 aa, Clostridium acetobutylicum ATCC 824
MKAITFEGMNNVKVKNVNDPNIIKNDDAIIKITSTTICGSDLHLLRGTMPKVPHGFIIGHEAMGIVEETGKEVTNLKKGDRVIVPFPVSCGHCWYCTHGLSSQCDNSNEHGEVGAIYGYGDLMGGYDGGQAEYLRVPYANFGPKLVPENLTDEQVLFLTDILPTSYWGTIVNGGVKQGDTVVVLGCGPVGLLAQKWAAYAGASRIIAVDNIDYRLEHAKKYNSAEILNFNDYDNTGEYIKEITHGGADVVIDCVGMDGERSPIENVETLLKIQGGSKSAIEISTQAVRRGGTVSVVGVYGARYNNFPFGDFFSRNITIKTGQCPAHSYVDVILDLIKQNKFDATDIITHTMSLSDGEKAYNLFNNKLDNCIKVILKP

SEQ ID NO: 17305 - protein, 222 aa, Petunia x hybrida
MFQFQLTSVFCIFLFAFSPIYGAFDHWQLVLTWPAGYCKIKGCPRTVIPDNFTIHGLWPDSVSVMMYNCDPPTRFNKIRETNIKNELEKRWPELTSTAQFALKSQSFWKYQYEKHGTCCLPFYSQSAYFDFAIKLKDKTDLLTILRNQGVTPGSTYTGEKLNSSIASVTRVAPNLKCLYYQGKLELTEIGICFNRTTVAMMSCPRISTSCKFGTNAGITFRQ

SEQ ID NO: 17306 - protein, 670 aa, Oryza sativa
  misc_feature (208)..(208): Xaa can be any naturally occurring amino acid
  unsure (1)..(670): unsure at all Xaa locations
MATPRGHLPACVAAVAAAAALLTSLLPPPVAGQPLGNFCGDSGNYTANSTYQGNIRSISATLPKNASSSRTLFATATLGAVPDIVYALALCRGDTANATACAGCVAAAFQDAQQLCPYNKDATVFYDACALRFSNQNFLASTNGDNKFLILMNTQNVSAPAKVFDAAVGVLINATADYAAANSSRRFGTGEEGFNGSKIYGLAQCTPXMATATCRSCLGGIVGMMPKYFSGKQGGRVLGLRCNYRYEIYPFFDGVSLLQLPAASLGAPPAPSPAAVNVTPPATTTGTRRRGNTTGRVLAIALPIVAAILAAVVICFYIWKRKTERARKPSIADPTDPADIESIDSLILSISTLRVATNNFDDSNKLGEGGFGAVYKGVLPSDQEIAVKRLSQSSRQGIEELKNELVLVAKLQHKNLVRLLGVCLEEHEKLLVYEYMPNKSLDTILFDPDRSNVLDWWKRLKIVNAIARGLQYLHEDSQLKIIHRDLKASNVLLDSDFNPKISDFGLARLFGNDQSQDVTNRVVGTYGYMAPEYAMRGHYSIKSDVFSFGVLILEIVTGRKNNVSYDSEQSVDLLTLVWEHWLAGTVVELADSSMAGHCPGDQILKCVHIGLLCVQEDPTERPMMSMVNVMLSSSTVSLQAPSRPAFCIQKSSVNSDSYSEPFRGANQSTV

SEQ ID NO: 17307 - protein, 343 aa, Oryza sativa (japonica cultivar-group)
MDHAAEAQRTDLMTITRHVLNEQGRHPESRGDFTILLSHIVLGCKFVASAVNKAGLAKLIGLAGDTNVAVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 17308 - protein, 424 aa, Novosphingobium aromaticivorans DSM 12444
MAQDIVARARQLIEDRIISRAALARAAGLHPNTLRDALSPDWNPTVDTLTKLERAMDDSEDDDFALASVEEIIAEVRNGRMVVLVDDEDRENEGDLLIPAQMATPETINFMATHGRGLICLCLTSDRASNLGLELMSRHNGTRHGTAFTVSIEAREGVDTGISAADRARTIAVAVDATKTRDDLVTPGHVFPLIARDGGVLVRAGHTEAAVDLPRLAGLNPSGVICEIMNDDGTMARLDDLIPFARKHGLKIGTIRDLIEYRRRHDHLVECANQAPFHTDYGGEWTIKTYRNKVDGSAHLVLQKGAVVPGKPTLVRMHAISVLSDVLGQPGPRKRILQRAMTAIGEAGSGVIVLLMPTDPQQLMNEVAGTAGHDMELRSYGIGAQILADLGVHDMVLLTNSHHNLVALEGYGLSIVGEQAIPEA

SEQ ID NO: 17309 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYRENHKSPGYYDGRYWTMWKLPMFGCTDATQVLAEVQEAKKAYPQAWIRIIGFDNVRQVQCISFIAYKPEGY

SEQ ID NO: 17310 - protein, 1110 aa, Debaryomyces hansenii CBS767
MTVPASDGYRGTKRRTEEDEEGGDMFNPMREQSVSDYMSQILESKRRKMTQKGSDDSESESESDSDDELENEDQVDSSPAKAGVIEKIILKNFMCHDSFELNLGPQLNFIIGRNGSGKSAILTGISIGLGVKASDTSRGSSIKNLIKDGKSTARVTVVFRNEGIEAYKPEEYGSKIIVERKIQRQGSNGYFIRSENLKTISTKKSVLDEILYKFNIAIDNPLAFLSQDKAREFLTLTTDKVKYDYFMAGSLINDIIENYRITSGNIVEVQNKLKLAKTHLDVATKNYDESASLYNKFKKSDSLRKHLELIHAKIYWYNVTVIEKKIQKYKDQLQQASHDIEVIEKKFEEIEQKSNQREQNVKKLEEKNIAISKEIVESQDSYQEIKMTYQRLKSGINEVINEIKKGEEDIEGFHKDIERCQNIIAKEQQRIDEINGGSKEKLNDSLSELKAKLEDLAQERERVRSELNEAGNYNDSELLDCEKKVNESKEIVSTLQEKKRRILASQKDKYSPWGNNITHLLANIKAINQWHQEPIGPIGSLVSVKEEYSDWRDLINASIGKTLDSFLVCDEHDRKILSDLFKKYRINKNIITRRFESFNFEDGIAYGHTTFLDILSIENENVLYTLIDLNSIEKNVICDDRNRARDLVTYPKILNVYSLLNSKSGQRSSGDRNTFKIDPIYYRLNEPHKLSNKSQSSTNDIKKTDEQVDEEIVKIHKLERRKREIKMKLQNEKQNLENRYETIQKETRRLNDELFKIENSLNENGDLSKIEALKIQIAEDEAQASQKEGILESLNEDLEKDRSQFITVRENMKKLKQEIQEQLQLQEDTKKALVECEIERSAMLSETEHYKMTTSKRRDAMVVCETKISQGNERLAPLVLDAESKCPRTQVNITNEDTNESISTEYERAQEAVKEAEKSVGRSYQEIQQELLTNKDTKEVCEERVIDLDKIYRSLSDDLNSRFNYLHTTILKNINEASSSFERSLALRGFKGELKFDFGEKSLTMLVQTKGDSKKRTVESLSGGEKSFTQIALLLAIWKVMDSKVRGLDEFDVFMDSVNRSISIKLLLSELRKYPKSQSIFITPQDIAVVGDLDSKDVKIHKMNDPRSDN

SEQ ID NO: 17311 - protein, 223 aa, Solanum tuberosum
MAKSQLVSALFVFFFSLSPIYGDFDYMQLVLTWPRSFCYPRGFCNRIPPNNFTIHGLWPDKKPMRGQLQFCTSDDYIKFTPGSVLDALDHHWIQLKFEREIGIRDQPLWKDQYKKHGTCCLPRYNQLQYFLLAMRLKEKFDLLTTLRTHGITPGTKHTFKKIQDAIKTVTQEVPDLKCVENIQGVLELYEIGICFTPEADSLFPCRQSKSCHPTENPLILFRL

SEQ ID NO: 17312 - protein, 966 aa, Solanum tuberosum
MATANGAHLFNHYSSNSRFIHFTSRNTSSKLFLTKTSHFRRPKRCFHVNNTLSEKIHHPITEQGGESDLSSFAPDAASITSSIKYHAEFTPVFSPERFELPKAFFATAQSVRDSLLINWNATYDIYEKLNMKQAYYLSMEFLQGRALLNAIGNLELTGDFAEALKNLGHNLENVASQEPDAALGNGGLGRLASCFLDSLATLNYPAWGYGLRYKYGLFKQRITKDGQEEVAEDWLEIGSPWEVVRNDVSYPIKFYGKVSTGSDGKRYWIGGEDIKAVAYDVPIPGYKTRTTISLRLWSTQVPSADFDLSAFNAGEHTKACEAQANAEKICYILYPGDESEEGKILRLKQQYTLCSASLQDIISRFERRSGDRIKWEEFPEKVAVQMNDTHPTLCIPELMRILIDLKGLNWNEAWNITQRTVAYTNHTVLPEALEKWSYELMQKLLPRHVEIIEAIDEELVHEIVLKYGSMDLNKLEEKLTTMRILENFDLPSSVAELFIKPEISVDDDTETVEVHDKVEASDKVVTNDEDDTGKKTSVKIEAAAEKDIDKKTPVSPEPAVIPPKKVRMANLCVVGGHAVNGVAEIHSEIVKEEVFNDFYELWPEKFQNKTNGVTPRRWIRFCNPPLSAIITKWTGTEDWVLKTEKLAELQKFADNEDLQNEWREAKRSNKIKVVSFLKEKTGYSVVPDAMFDIQVKRIHEYKRQLLNIFGIVYRYKKMKEMTAAERKTNFVPRVCIFGGKAFATYVQAKRIVKFITDVGATINHDPEIGDLLKVVFVPDYNVSVAELLIPASDLSEHISTAGMEASGTSNMKFAMNGCIQIGTLDGANVEIREEVGEENFFLFGAQAHEIAGLRKERADGKFVPDERFEEVKEFVRSGAFGSYNYDDLIGSLEGNEGFGRADYFLVGKDFPSYIECQEKVDEAYRDQKRWTTMSILNTAGSYKFSSDRTIHEYAKDIWNIEAVEIA

SEQ ID NO: 17313 - protein, 589 aa, Saccharomyces cerevisiae
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSEEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 17314 - protein, 245 aa, Xylella fastidiosa 9a5c
METATVTRVNSTQPANACAPSHIPIIINNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 17315 - protein, 329 aa, Bradyrhizobium japonicum USDA 110
MATNKKKIFVTQTLSQGARTLLTQRDDIELVEFANLISAKDFQALLKSHAPVHGVALGATAFGETELEASKDMKVVTRIGVGYDAVDVPALSRRKVPLMVAGSANSPSVAEQALFMMLTLAKRAQEMHSCVKDGKWADRLGMLPFDLYGKTVLIIGFGRIGTRTAKRCLAMEMRVQVYDPYKPAAEIKAAGYEPVADLDAALPHADFVTIHCPKTPETVGLFDAARIGRMKPKSYLINTARGGIVKEAALYDALTSGKLAGAGIDVFEVEPPPVSNALFALPNVIMAPHVAGVTVEAVSRMSEQTARNILSVLDGDPIRQNIINQDVLG

SEQ ID NO: 17316 - protein, 93 aa, Brassica napus
MKCILPPAFTQMFGYSSNQINQTSNFVNTHNKIKVMEREEFPGGFQVPLHYPKYSKSDYEAMDDLCLDLLLKQYGISFDGSLEDKRVFAMESF

SEQ ID NO: 17317 - protein, 266 aa, Yersinia pestis CO92
MMKTTTMSQLRQWKQEKRKFATLTAYDASFAQLFAEQGIQVLLVGDSLGMTLQGFDSTLPVTVADMAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 17318 - protein, 662 aa, Thiomicrospira crunogena XCL-2
MFDHILLNIVFLLVITVGLVSISRRFHLPPILNYILVGIIVGPFGFGLIESEKSISFLAEFGIVFLLFSIGLEFSLTQMMSMRKMVFGYGGLQVLLTGAFVYLTCQMFGLDIETSIVVASAFALSSTAIVIKQLTEQSEIQTRHGRAAVGVLIFQDLMAIPLLILIPALGTASGDSLSSELGIAFLKGGIVVVVMLFAGRYLLRPLFHEVASSKSQELFTLTVLTVVLSAAAFTEEMDISMTLGAFLAGMMLGETEYRHQIEADIRPFQDILLGLFFITVGMMISPAVLQSDFFIIITITFSIMLIKAVVIFGIMKTFKKPEGVSIRAAVSLAQVGEFGLVLITLALSYELLSGELGQILLTSAVLSMMITPLLVKFNGRIANRLCRKSYQNNFSELENVIKEDTKYLADHVVLLGFGRVGQTTAKFLEQAHVPFVALDMDIKRVHEAQQSGEPVYFGDSAKHSIIKATNLSKAKVAIITFHNYHAAIKTLKTLKDVAPELPILVRTQDDSHINELMAAGATEVVPDTFESSIMLASHLLLMIGQPPSQVLRQTRAARKGRYSLLNGMYPGESDHTPFDNAQIGQVIQPIQINDSAFAVGKRLEELPFSKLNINIKSVKRGSVRGDDPDVRTRIRAADVLIVQGLPENVDKFENYLNSGKQP

SEQ ID NO: 17319 - protein, 104 aa, Arabidopsis thaliana
  misc_feature (93)..(93): Xaa can be any naturally occurring amino acid
  unsure (1)..(104): unsure at all Xaa locations
GTQPSGPWVSFMLFSVLLVASPAKATRGVLLNGLKSSVAFQATRRVNTNFPSLTGNGGGVNCLQGWPPIGKKNLETFFNLPDLTDSKWVKEVXYLIRNRWFPWL

SEQ ID NO: 17320 - protein, 474 aa, Clostridium perfringens ATCC 13124
MQKTKMIFTIGPASDSEEILREFIRIGMNAARLNFSHGDHASHKEKIELIKRLRKEEKSATAILLDIKGPKIRTHNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFQIAETGDNIMVAAGFPTSITGGTNMLKIEKI

SEQ ID NO: 17321 - protein, 101 aa, Brassica napus
PARPVLTSYYRSEHFKKRPYDAYNVYTSPNEAILCPDSSQSMYTQMLCGLLMRHEVLRLGAVFASGPLRAIRFLQTNWQELVKDIATGTLSARNLEPGNTE

SEQ ID NO: 17322 - protein, 377 aa, Striga asiatica
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNSPAMYVAIQAVLSLYASGRTTGIVLDSGDGVSHTVPIYEGYALPHAILRLDLAGRDLTDHLMKILTERGYSFTTTAEREIVRDIKEKLAYIALDYEQELETAKTSSAVEKNYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 17323 - protein, 346 aa, Hydrogenophilus thermoluteolus
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEATRRTTPTSTRSS

SEQ ID NO: 17324 - protein, 377 aa, Coccidioides immitis RS
MASTKLEREDHARDAAFNKALHGDSAKARGGLRAMMSKDKAAQEAALDEYFKHWDKKPSADETEEIREARRAEYATLTRHYYNLATDMYEYGWGGSFHFCRFAYGEPFRQAIARHEHYLAHSIGLQEGQTVLDVGCGVGGPAREIAKFAGVNIVGLNNNDYQIERATRYAAKEGLSKQLRFTKGDFMQMSFEPNTFDAAYAIEATVHAPSLEGVYRQIYNSLKPGGVFGVYEWVMTDAYDNDNPVHREIRLGIEQGDGISNMVRATEALEAFKAAGFELIKAEDLADRGDDIPWYYPLAGSWKHMSSLWDVLTIARMTWWGRGLVHKFMGGMETIGLFPKGSQKTADSLAYAADCLVKGGEMKLFTPMYLMVGRKPE

SEQ ID NO: 17325 - protein, 483 aa, Escherichia coli
MSQCLYPVIIAGGTGSRLWPLSPVLYPKQFLNLVGDSTMLQTTITRLDGIECENPIVICNEDHRFIVAEQLRQIGKLTKNIILEPKGRNTAPAIALAAFIAQKNNPNDDPLLLVLAADHSINNEKAFRESIIKAMPYATSGKLVTFGIIPDTANTGYGYIKRSSSADPNKEFPAYNVAEFVEKPDVKTAQEYISSGNYYWNSGMFLFRASKYLDELRKFRPDIYHSCECATATANIDMDFVRINEAEFINCPEESIDYAVMEKTKDAVVLPIDIGWNDVGSWSSLWDISQKDCHGNVCHGDVLNHDGENSFIYSESSLVATVGVSNLVIVQTKDAVLVADRDKVQNVKNIVDDLKKRKRAEYYMHRAVFRPWGKFDAIDQGDRYRVKKIIVKPGEGLDLRMHHHRAEHWIVVSGTAKVSLGSEVKLLVSNESIYIPQGAKYSLENPGVIPLHLIEVSSGDYLESDDIVRFTDRYNSKQFLKRD

SEQ ID NO: 17326 - protein, 377 aa, Striga asiatica
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDHLMKILTERGYSFTTTAEREIVRDIKEKLAYIALDYEQEMETAKTSSAVEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 17327 - protein, 382 aa, Vibrio fischeri ES114
MALDIKPGQTHIKSKAMVAWAAGEPLKMEEVDVQLPKAGEVLVRIVATGVCHTDLFTLSGDDPEGIFPSILGHEGGGIVEMVGEGVTGLEVGDHVIPLYTAECGECKFCKSGKTNLCQAVRETQGQGLMPDGTSRFSINGETIFHYMGCSTFSEYTVLPEISLAKVSKDAPLEEVCLLGCGVTTGMGAVLNTAKVEKGDTVAVFGLGGIGLSAIIGAKMAGASRIIGVDLNESKYELAKKLGATDCINPMNYDKPIQEVIVEMTDGGVDYSFECIGNVNVMRSALECCHKGWGESIIIGVAGAGQEISTRPFQLVTGRVWRGSAFGGVKGRTELPGIVDRYMQGEFALDDFITHTMGLADVNAAFDLMHEGKSIRTVLHMDK

SEQ ID NO: 17328 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGVCKKVIISAPSADAPMFVCGVNLDAYDSKYKVISNASCTTNCLAPLAKVIHDKFGIVQGLMTSVHATTATQKTVDGPSNKDWLGGRSVGNNIIPSSTGAAKAVGKVIPSLNGKLNGLAFRVPTVDVSVVDLVVRLEKPASYDEIKQAIKEASETTHKGILGYTEEKVVSTDFTGNDNSSIFDRDAGIALNKTFVKLISWYDNEWGYSRRCCDLLGYAAKVDGAL

SEQ ID NO: 17329 - protein, 180 aa, Lycopersicon esculentum
MASSVISSAAVATRSNVTQASMVAPFTGLKSSATFPVTKKQNLDITSIASNGGRVSCMQVWPPINMKKYETLSYLPDLSDEQLLSEIEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 17330 - protein, 213 aa, Rhodococcus sp. RHA1
MTTSFAPRAPRQRSWSTIAAGSRALAAGELIILSHLRRVVLVGSASAVTTEQMAFLIRHTTGFLQVALHERICDLLVLPEATPTVRTSSTLGHGQCVTVDAAAGITTGISGADRARTARILADPATGPGDLTRPGHLVPVRLTPTEFRTRQTTASLALALTDATATQCSGAVFADLDGIADPISVGDRHDAEILADRYGLTLVAGPDLKGNVR

SEQ ID NO: 17331 - protein, 216 aa, Oryza sativa (japonica cultivar-group)
MLKKLLSKPKSKKKEAASSALPTLDRLHETLEMLEKKECFLQKKASAEVEKAKDYTKAKNKSAAIQCLKKKKLYETQIEQLANFQLRVHDQIIMLESAKATTDTVDALRSGSSAVKAIHQSVSIDDIENAIEEANEHTENMRQIQEALATPIGASADFDEDELEAELEDLEEEELDHELPEPPQSTRMEPSARVTTSSQPANDLAELTKLQAEMAL

SEQ ID NO: 17332 - protein, 330 aa, Rhodobacter sphaeroides 2.4.1
MKQFQIVGIGNALVDVLSHCDDAFLAENGIAKGIMQLIDMGRAVDLYGRIGPAQEISGGSAANTIAGIAQLGGRTAYVGKVCDDQLGAIFAHDLRAQGAVYETPMAPKGGAQETGRCIILVSPDGERSMNTCLGWSEFLTPDDIDEAQMASTEWIYLEGYRFDGPESHAAFAKAIAACRGAGGRVSLTLSDPFCVERHRDAFRRMIREDVDLLFANRAEILSMYRTEDFGAALKAAAAEVAIVACTESEKGAHILADGQHWHVPALPTQIVDATGAGDLFAGAFLWGLTHGHGYETAGRMGCIAASEVISHLGARPEADLRALFRAQGVL

SEQ ID NO: 17333 - protein, 278 aa, Robiginitalea biformata HTCC2501
MSTITDIQGTFELNNGVQMPYLGLGVYQAEEGGEVERAVQWALEAGYRHIDTARAYGNEAGVGKALRESGVDREEVFVTSKVWNSDQGYESTLKAFDSTMDDLGLDYLDLYLVHWPVEGKYKDTWRALEHLYDTGRVRAIGVSNFLQHHLEDLLADAEVIPAVDQLEFHPYLVQQPLQDYCQAKKIQYEAWSPLMQGEIFKLPEMEAMADSYGKSIAQVVLRWDLQKGVVTIPKSSKKERIRANADLFDFELSEEDVAKLDAMDRGHRFGPDPDNFDF

SEQ ID NO: 17334 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVEVGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFLLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 17335 - protein, 336 aa, Triticum aestivum
SFPPSRSNFIVFKHSESILILYRVLEDPSSSSDAVRTKEVAITNLTNYLTKENRAEELRNLLTQLRPFFALIPKAKTAKIVRGIIDAVSKIPGTSDLQISLCKEMVEWTRAEKRTFLRQRVEARLAALLLESQEYTEALTLLPGLIKEVRRLDDRLLLVDIDLLESKLHFSLRNLPKAKASLTAARTAANAIYVPPAQQGTIDLQSGILHAEEKDYKTAYSYFFEAFEGFNALDDPKAIFCLKYMLLCKIMVNQADDVAGVISSKAGLKYVGPDVDAMKAVADAYSKRSLKYFETALGDYKAQLEEDPIVHRHLSSLYDTLLECLNTIKLELEGGK

SEQ ID NO: 17336 - protein, 302 aa, Arabidopsis thaliana
MSPSKQRHRCSTGENKSKPVRSASSSAIPEWITESTNGGSLRRVDPDTGTDGWASPPGDVFSLRSDSYLSKKQKTPAGDYLLSPAGMDWLKSSTKLENALARPDNRVAHALRKAQSRGQSLKSFIFAVNLQIPGKDHHSAVFYFATEEPIPSGSLLHRFINGDDAFRNQRFKIVNRIVKGPWVVKAAVGNYSACLLGKALTCNYHRGPNYFEIDVDISSSAIATAILRLALGYVTSVTIDMGFLAEAQTEEELPERLIGAVRVCQMEMSSAFVVDAPPPQQLPSQPCRTLSSAKVNHDEDED

SEQ ID NO: 17337 - protein, 133 aa, Triticum aestivum
  misc_feature (34)..(34): Xaa can be any naturally occurring amino acid
  misc_feature (70)..(70): Xaa can be any naturally occurring amino acid
  misc_feature (91)..(91): Xaa can be any naturally occurring amino acid
  misc_feature (100)..(101): Xaa can be any naturally occurring amino acid
  misc_feature (103)..(104): Xaa can be any naturally occurring amino acid
  unsure (1)..(133): unsure at all Xaa locations
MAPAVMASSATTVAPFQGLKSTAGLPVGRRSSGXLSSVSNGGRIRCMQVWPIEGIKKFETLSYLPPLSTXALLKQVDYLIRSKWVPCLEFXAKVGFVLRXXHXXSPGYNERGEYWDNVESWMRHLTPIHATER

SEQ ID NO: 17338 - protein, 497 aa, Arabidopsis thaliana
MAMEQRPKTKIVCTLGPASRSVPMVEKLLMAGMSVARFNFSHGSYEYHQETLDNLRQAMLNTGMLCAVMLDTKGPEIRTGFLKDGKPIQLKQGQEITISTDYDLKGDEKTICMSYKKLAQDVNPGMVILCADGTISLKVLSCDKEKGTVRCRCENTSMLGERKNVNLPGVVVDLPTLTEKDKQDILEWGVPNQIDMIALSFVRKGSDLVQVRKLLGKHAKTILLMSKVENQEGVANFDDILINSDAFMIARGDLGMEIPIEKIFLAQKVMIYKCNFMGKPVVTATQMLESMIKSPRPTRAEATDVANAVLDGTDCVMLSGETAAGAYPELAVRTMAKICVEAESTLDYGDIFKRIMLHAAVPMSPMESLASSAVRTATSSRATLMMVLTRGGSTARLVAKYRPGIPILSVVVPEITSDSFDWACSNEAPARHSLIYRGLVPVLYAGSARASIDESTEETLEFASEYGKKKQLCKTGDSVVALFRTGNAIVIKILTVK

SEQ ID NO: 17339 - protein, 479 aa, Shigella flexneri 2a str. 301
MSVPVQHPMYIDGQFVTWRGDAWIDVVNPATEAVISRIPDGQAEDARKAIDAAERAQPEWEALPAIERASWLCKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNLLGEALQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 17340 - protein, 451 aa, Gibberella zeae PH-1
MATQAAYGVEKIVGHSDNAITAQDVTSYQETGDHSQTMKALAWMGKNKVQMVDAPKPKVIEDRDVILRVTGSTVCGSDLHLLHGTVIQLSEGDILGHEFCGVVDEVGAGVTGIDVGGRYVASFQIACGDCFFCKQKLSSQCEKTNSNTTERAMYGGRTAGMFGYSHFTGGFAGGQAEYVRVPLGDVNLLKIPDDVPDEKALYLSDVLATSYNAVKDTAVYPNDSVAVFGAGPIGQMAGIFALKEGASKVIFVDTEPRLSFVRERWPAEHKDKLELVDFKQLSHGVTNKPTVVSRLKELTGNRGPDCAIECVAGEYPKGWMHTIELAIGAETDTSEIINEMIEGVRNYGRCGVTGVYVGYTNHFNIGSLMERGIRLIGNGQAPVHKYWDELLEMIQRGELDPAQMLSHRVRLEDLDKVYYKFEKKEDGMQKVFVETKFSFPRDPSTPALTTY

SEQ ID NO: 17341 - protein, 253 aa, Aspergillus flavus
MGHEDAVYLAKLAEQAERYEMVENMKVVASADVELTVEERNLLSVVYKNVIGARRASWRIVTSIEQKEESKGNESQVTLIKEYRQKIESELAKICDDILEGLDKHLIPSGQSGESKGFYHKIGDYHRYLAEFAIGDRRKGAADASLEAYKAATEVAQTDLTPTHPIRLGLALNFSVFYYEILNSPGQACHLAKLAFDDAIAELDTLSEESYKDSTLIMQLLRDNLLDTLSEESYKDSTLIMQLLRDNHPLDLV

SEQ ID NO: 17342 - protein, 932 aa, Brucella suis 1330
MTEFLPFVARHIGPRHEDERAMLAALGLPSMETLITQAVPASIRLNRALNLPAALSEADALAELGTIMGRNVVKKSFIGAGYHGVHTPPVIQRNLFENPAWYTAYTPYQSEISQGRLELLFHFQTLVAELTGLPVACASLLDEATAVAEAIGVACRHHRDKRSRILLAGELHPQTVDVVNTRAEPLGWEIATGSDVDDNTAAIVVPWPDTRGVYGDFAKVIADAKAKGALVIAVADPLALTIMEAPARWGADMAVGSMQRYGVPMGFGGPHAAYLAVSEALTRIIPGRIVGQSVDAHGRAAYRLALQTREQHIRRDKATSNICTAQALLANMAAAFAIWHGPAGLQAIATRVAALAARFAAALKAAGVEIAGESLFDTVTAKVPGKAAAIAAEADKGGRLIRIIDADTVGVTFDETSTEEDLTALASLFGAKPVGGDTVLVPGKERGEGFLTQEVFHSHRSETEMMRFLRRLADKDLALDRAMIPLGSCTMKLNAAAEMMPVSWNTVANLHPFAPAEQVQGYAKMTSDLEAWLCEITGFAGVSLQPNAGSQGEYAGLMAIRHYHQAWGQGHRNICLIPSSAHGTNPASASMAGMSVVVVNCRPDGDIDIDDLKAKAEKHRDNLAAFMITYPSTYGVFEEGIKAFCEIVHDNGGQVYFDGANLNALVGLARPADIGADVCHMNLHKTFCIPHGGGGPGVGPIGVAKHLVPYLPGHVEAGSEHAVAAAQFGSASILVITWMYIRMMGGAGLKKATEAAILNANYIAHRLKGVYPILYTGAHDRVAHECIVDTRVLKDSAGITVEDVAKRLIDYGFHAPTMSWPVAGTLMIEPTESEPKLEIDRLCDAMIAIAGEAKKVADGVWPADDNPLANAPHTASDTLATEWKHPYTREEAVFPGGAFDPTAKYWPPVSRVDNVGGDRNLICSCPPVAAYG

SEQ ID NO: 17343 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNRNYVVDLYLERDIGDLEVASEAILRFPGVVKHGMFLGMATTLIVAGKFGVTVKDRFG

SEQ ID NO: 17344 - protein, 379 aa, Bacillus clausii KSM-K16
MKAVTFQGKKQMEPKEVPAPSIQQDTDIIVRITASGICGSDLHLYHGGIVPETDYVVGHEPMGIVEEVGPMVKSLKKGDRVVIPFNVSCGECFFCQHQMESQCDNSNGNPHSDAGGLFGFAEQFGNYPGGQAEYLRVPYGDFTSFKLPAESELDDEQVVLLSDVIPTAYWSVKHAGVSTGDTVIILGCGPIGLMAQKFAWLHGAKRVIAVDQVAHRLEHGKRTNLVETYNFSNTPDIGKQLYEDTEGGADVVIDCVGMDGTVPPGETFGSSGDNQFGTIQPIVTASEAVRKFGTVQITGVYGSEANQFPINDFFTRNVSLKMGQAPVVHLMPTLYTMIERGTIDPTDIITHRMGIEDAPDAYRIFDQKEDGNIKTIFKL

SEQ ID NO: 17345 - protein, 1063 aa, Coccidioides immitis RS
MVAPFSVVRLGARQLVSSSLRNASLRPSRVSPLTACRQCLQLVRYQQTQSHRRAVHLSSSGDTENLLPRDLHSPLDTFPRRHIGPGADATEQMLAVLDPPAKNLDEFVKQVLPADILTAKNLSVSEPQAAAELRKDGVLGGLGEKDMVKLLESYKNKIDATGKSFIGCGYYSTVVPPVIQRNVLENPAWYTSYTPYQAEISQGRLESLLNFQTLTADLTGLPVGNASVLDEGTAAAEAMTMSWATLPMNKQKQDGKVFVVSHLCHPQTIAVMRSRAEGFGIRLEIGDIMADNFKLVKDQGDRLIGVLAQYPDTEGGVFDFQSLSDSIHAQGGSFCVATDLLALTVLKAPGEFGADIAFGNAQRLGVPMGFGGPHAAFFACTDKYKRKIPGRIVGVSKDRLGNRALRLALQTREQHIRREKATSNICTAQALLANMTAMYAVYHGPQGLKAIAERIMALTALLRTKLQLLGFNVPVRGNASFDTLVVETKSSAEADAIVGSALSAGLYLRRVSPTKVGISLDEAVGVDELKELLAVFANLSDKKGAETLDLSKDIPSVDVPVDIRRTSSYLTHPVFNTHHSETEMLRYMQHLVSKDLSLAHSMIPLGSCTMKLNATTEMVPVTWPEFSTMHPFTPAQKVEGYVNMVEDLEKQLADITGMAEVTIQPNSGAQGEFAGLRVIKMYQDSLGEPGKRNICLIPVSAHGTNPASAAMAGMKVVPVKCDTGTGNLDVADLRAKCQKHKDELGAIMITYPSTFGVYEPTIKEVCDIVHEYGGQVYMDGANMNAQIGLCSPGEIGADVCHLNLHKTFCIPHGGGGPGVGPIGVAEHLRPFLPSHPLSEPLLAKRPASVDSPPISAAPYGSASILPITFSYINMMGSKGLTHATKITLLNANYLLSRLKQHYPILYTNENGRCAHEFILDVRKFKATAGIEAIDIAKRLQDYGFHAPTMSWPVANTLMIEPTESEPKGELDRFCDALVSIREEIAAIERGEQPKDKNVLKMAPHTQRDLLTGDWDRPYTREKAAYPLPWLLEKKFWPTVTRVDDAFGDQNLFCTCGPVEDTSE

SEQ ID NO: 17346 - protein, 417 aa, Rhodococcus sp. RHA1
MTRFDSIERAVADIAAGKAVVVVDDEDRENEGDLIFAAEKATPELVAFMVRYTSGYLCVPLDGADCDRLGLPPMYATNQDKHGTAYTVTVDAREGIGTGISASDRAATMRLLADPSSGAQDFTRPGHVVPLRAKEGGVLRRPGHTEAAVDLARMADLRPAGVICEIVSQKDEGHMAQTDELRVFADDHNLALISIADLIAWRRKHEKHVERVASARIPTRHGEFTAVGYRSIYDDVEHVALVRGDLPGPDGDGSDVLVRVHSECLTGDVFGSLRCDCGPQLDAALDMVAQEGRGVVLYMRGHEGRGIGLMHKLQAYQLQDAGSDTVDANLELGLPADARDYGIGAQILVDLGISSMRLLTNNPAKRVGLDGYGLQITERVSMPLRANAENLTYLRTKRDRMGHDLIGLDDFEAGEML

SEQ ID NO: 17347 - protein, 232 aa, Kluyveromyces lactis NRRL Y-1140
MWGYFFGTSKQQKELPKKAIVDLREHIQLLNKKQAHLQTQIDQQQQLAKKSLQSGNKNNAKTYLKKKKLYESQLDKLQSQIDSLDQQLYSIENANLNLETLKAMKQGASAMKNIHKGLDLDKVDDTMDEIREQVELNQEISEAISKPLILQDELDEDELDQELELLESENLQKEHIAPVPQQQIQQPSIDLPSVPDVKLSTPELNSAQADEEDEEEDEDERALRELQAEMGL

SEQ ID NO: 17348 - protein, 264 aa, Kineococcus radiotolerans SRS30216
MTTRPRPLVGVSLKMYFSLARTRSYLADVATLGPDVAGSGVDAFVIPDFLNITTGIDLLRGTGIAVGAQDASWEDFGALTGEVSPAALREAGARFVEIGHAERRRMFAEDDIVTARKAAAAARNGLVPLICIGENVRIDVADAARTTISQVLAALEDVPSEAEVVIGYEPNWAIGQTEPAPPEHVVGVTTRLRDALAHRRGLTRILYGGSAGPGMFTDVAEGVDGLFLGRFAHDVANFRSVIQEIADHPLNAHGSTAEPATDRA

SEQ ID NO: 17349 - protein, 339 aa, Rhodococcus sp. RHA1
MTVRVGVNGFGRIGRNFFRAVDAQKALGTTDIEIVAVNDLTDNATLAHLLKYDSILGRLPHDVSLEGEDTIVVGNQKIKALAIKEGPAALPWGDLGVDVVVESTGIFTDAAKAKGHLEAGAKKVIISAPAKGEDITIVMGVNDDKYDGSQNIISNASCTTNCLGPIAKVLDDEFGIVKGLMTTVHAYTQDQNLQDGPHSDLRRARAAALNVVPTGTGAAKAIGLVLPQLLGKLDGYALRVPIPTGSVTDLTANLKKSASVEDINAAMKAAAEGPLKGILKYTDAPIVSSDIVTDPHSSIFDSGLTKVIDDQAKIVSWYDNEWGYSNRLADLIGLVAKSL

SEQ ID NO: 17350 - protein, 93 aa, Zea mays
  misc_feature (70)..(70): Xaa can be any naturally occurring amino acid
  misc_feature (74)..(74): Xaa can be any naturally occurring amino acid
  unsure (1)..(93): unsure at all Xaa locations
MACGISMSRILKEIRVLFCQSSPGSAAAREFVKKNYGDIKARNPSLPFLVRECSRVPPHVWDRYNMGVDXCVNXDGLTKAHIDKNLAGACQGR

SEQ ID NO: 17351 - protein, 261 aa, Rhodococcus sp. RHA1
MARKPLIAGNWKMNLNHLEAIALVQKIAFSLPAKYFDKVDVTVIPPFTDIRSVQTLVEGDKLLLTYGAQDVSAHDSGAYTGEISGSMLAKLGCTFVVVGHSERRTLHCEDNDTVLAKTKAALKNGITPIVCIGEGLDVREAGEHVSYNVEQLRGSLAGLSGEDIAKVVIAYEPVWAIGTGRVASAANAQEVCAAIRATLGELASQDVASGVRVLYGGSVNAKNVGEIVGQTDVDGALVGGASLKADEFATLSAIAAGGPLP

SEQ ID NO: 17352 - protein, 445 aa, Nocardia farcinica IFM 10152
MSASPRATHASAAASARLFDRAAQVIPGGVNSPVRAFRSVGGTPRFIASADGYTLTDADGNEYVDLVCSWGPMILGHAHPAVVDAVRRAATGGLSFGAPTEAEVELAEHIVARVAPVDRVRLVNSGTEATMSAVRLARGFTGRTKIIKFAGCYHGHVDALLADAGSGVATLGLPTSPGVTGAQAADTIVLPYNDLDAVAAAFEANPGEIACVITEAAAGNMGAVAPLPGFNAGLRELTENHGALLIMDEVMTGFRVSRSGWYGREGVAGDLYTFGKVMSGGLPAAAFGGRAEVMNQLAPLGPVYQAGTLSGNPVAVAAGLATLRAADDAVYAALDRNAERLGGLLTEALTAAGVEHQVQFAGNMVSVFFSDRPVTDYATAKASQTWRFPAFFHALLDGGVYAPPSAFEAWFVSAALDEDAFARIAAALPAAARAAAAATPEGSRA

SEQ ID NO: 17353 - protein, 465 aa, Yersinia pestis CO92
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 17354 - protein, 808 aa, Exiguobacterium sibiricum 255-15
MFKDKEKFKKRFNERFISMHGKALEDATENDVYQTLAYMVREYVTTDWMRTKETYIHKKSKQVYYFSLEFLLGRFLYNNLLSLDVLEEVRSGLTELGYDLADLTEEEPEPGLGNGGLGRLAACFLDSLAALGLPGHGNGIRYQYGLFKQKIIDGYQVELPDNWLKNGNMWEIRRSDKAVDIPFGGNVWLEEVESGKYRVHHEPAEIVRAVPYDMPIVGYQNGIVNNLRLWSAESPYDDDELLSQHRGNYKDLLSHKQAIQTISEFLYPDDTTYEGKVLRLKQQYFFVSAGLRSILLSHKKRNTSLKHLGNQIAIHINDTHPVVAIPELMRILIDEEEYSWEESWRITKSVMSFTNHTLLSEALERWPVDLFRNLLPRIYLIVEEINRRFCKDVLDNYPHLEANMREIAIIADGMINMANLAVVGTHSTNGVAQIHTEILKQREMRLFYEMFPLRFNNKTNGITHRRWFLLSNPALANRVTEAIGDSWINHPSDLQKLTKFAEDRTLQQDIQAIKLASKKELAELIENETGIVVDPHSIFDVQVKRLHAYKRQLLNALHIHSLYYRLKEDQSFQMTPRTFIFGAKAAPGYHYAKEVIRYINALANLINSDPDVSPYMKVVFLENYRVSLAEKIFPASDVSEQISTASYEASGTGNMKFMMNGALTVGTLDGANIEIRDEVEDPNIFIFGLTPQEVMNYKKYGGYSAYDQYSAQPELRRVIDGLVDGSLFPTGEFQAIYDSLLTYNDEYLILKDFLSYQQAQERIGRAYQDPEKWYKMVIMNIGKSGVFSSDRTIKEYANAIWNIKPVQI

SEQ ID NO: 17355 - protein, 133 aa, Brassica napus
MAGGKIRKEKPKAPSNNYQGGISFHKSKGQHILKNPLLVDSIVQKAGIKSTDVILEIGPGTGNLTKKLLEAGKEVIAVELDSRMVLELQRRFQGTPYSNRLKVIQGDVFKTELPRLDICVANIPFQISSPLTS

SEQ ID NO: 17356 - protein, 281 aa, Corynebacterium glutamicum ATCC 13032
MDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 17357 - protein, 528 aa, Fusarium heterosporum
MALTVFEHASALWYRLQGSVSLAVLSTLAVVIAGWYILSSISLYFSRRQFIALHGCKPIANRYPSKWFGINFILEAGRTYKERRYLDALTWNFRNIGYTHEVRALGGTSVWTVEPENIKAVLTSKFKDYSLGNRPAVMGPLLGRGVFVTDGEEWSHSRALLRPNFAKDQVADLSMIERHLQQLLKMIPDDGKAIDLNDLILSFTMDSSTEFLFGESTETLTSGINRQFSDAFAYSLHDISSGLRLGPWYKFRRTDPKAVQSHRICREYADKYVEKALEYRRNYIKSVEDGATDKPSIDGGDSRRTFLRELALATDDREKLRDELLSLLLAGRDTTASLIGSLLFSLAKKPECWEKVRSEIEETLHGDLPSYEQLRNFKYAKYRVNEALRLYPPVPNNAKIGIRDTVLPRGGGPEGRDPIIVPKDAPVIYTVYALHRRYDLFGDDADDFRPERWENQRYTWEFLPFNGGPRICLGQQYALVETLYVLVRFAQHFSKIESMDPEPWTESLALTVSSGNGVKVKLERGSSE

SEQ ID NO: 17358 - protein, 299 aa, Glycine max
MGETTERYAVVTGANKGIGLEIVRQLASAGIKVVLTARNEERGIQALQTLKDSGLSHLVLFHQVDVADATSVASLADFIKSKFGKLDILVNNAGILGAVIKDTDSFTSFLLKRGAAPEEDGTKAITQSYELAEECLQINYYGAKTTVESLLPLLQLSDSPRIVNVSSTMGQLERLPKGSWAREVFSDANIITEEKVDEILKKFLRDFQEGSLESNGWPRHLGAYIVSKAAMNAYTRILAKKYPSFCINSVCPGYVKTDITSNTGLLTVEEGAASPVRLALLPNGSPSGLFYYRSDVASF

SEQ ID NO: 17359 - protein, 634 aa, Methanocaldococcus jannaschii DSM 2661
MSAEEVLENIRKEIIKKSPKEAKIVDVQFEGPEVVVYVKNPEIFTNEIIKSLAKDLRKRISIRPDPSVLVEPEIAKQKILEIVPEEAEITNFVFDANTGEVIIESKKPGLVIGKEGKTLEMIKKAIRWAPKPVRTPPIQSETIKAIRATLYRERHEVKEILRRIGRRIHRDIVVRGDYWIRVSFLGGAREVGRSCLYVQTPDTRVLIDCGINVACEDKAFPHFDAPEFSIEDLDAVIVTHAHLDHCGFIPGLFRYGYDGPVYCTRPTRDLMTLLQKDYLEIAKKEGKEVPYTSKDIKTCVKHTIPIDYGVTTDISPTIKLTLHNAGHVLGSAIAHLHIGEGLYNLAYTGDIKFETSRLLEPAVCQFPRLETLIIESTYGAYDDVLPEREEAERELLRVVSETTDRGGKVLIPVFGVGRAQELMLVLEEGYNQGIFNAPVYLDGMIWEATAIHTAYPEYLSKEMRQKIFHEGDNPFLSEVFKRVGSTNERRKVIDSDEPCVILATSGMLTGGPSVEYLKHLAPDEKNAIIFVGYQAEGTLGRKVQSGWKEIPIITRNGKTKSIPINLQVYTIEGFSGHSDRKQLIKYIRRLKPSPEKIIMVHGEESKCLDFADTVRRLFKKQTYVPMNLDAIRVK

SEQ ID NO: 17360 - protein, 321 aa, Lycopersicon pimpinellifolium
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYLDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 17361 - protein, 394 aa, Zymomonas mobilis subsp. mobilis ZM4
MKIAKRAERIEPFYVLEVAKAAAQLSQDAGNDTKPMIHLTIGEPDFTAPPLVQEAAIRAIRAGATQYTPAIGLGLLRERISDWYRQRFGIDVPARRIVVTAGASAALQLICTALIEAGDEVLMPDPCYPCNRHFVIAAEGCPVVVPTTAAERYQLSAEKVAENWSDKTRGVLLASPSNPTGTSIHPEELRRIHAFVQSKGGITLLDELYLGLSHDDAFGQTGLTLDENVISINSFSKYFSMTGWRLGWLVAPEPLVPVIERLAQNFFLCPSTVSQHAALACFEPESIAEYERRRAEFKARRDWFIPALEKIGFKVPVAPDGAFYAWADCSEWFHAWDVPSSWEFAFEAMKRARVAISPGRDFGAAETARFVRFSTANSMDNLQEAVARLSALRP

SEQ ID NO: 17362 - protein, 306 aa, Zymomonas mobilis subsp. mobilis ZM4
MHNNVNQHGRSAEPGVASEGIAPYGDAHRGIAAKRKKTTTARISQMRVDGEKIAVLTAYDATFAAAADAAGVDCIMVGDSLGMVCQGRTTTVGVSLEDMLYHTRCVSQGIARADGSALIIADLPFGSYQQSNEQAIASAVQLMQAGAHMVKLEGGDWWTVDIVEFLVQRGIPVCAHLRLTPQTVSALGGYRVQGRSEEAAEKLRVDAGALDNAGASMMVLEMIPTELATSITSEMKSCATIGIGAGSGTAGQVLVMHDMLGINLGRMAKFVRNFMRDAEDVPTAFAAYVAAVKDGSFPDDKLHGFL

SEQ ID NO: 17363 - protein, 303 aa, Lycopersicon parviflorum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELDQTHLSTVVKGTLGYLDPEYFIKGRLNEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17364 - protein, 188 aa, Triticum aestivum
  misc_feature (87)..(87): Xaa can be any naturally occurring amino acid
  misc_feature (93)..(93): Xaa can be any naturally occurring amino acid
  misc_feature (114)..(114): Xaa can be any naturally occurring amino acid
  misc_feature (131)..(132): Xaa can be any naturally occurring amino acid
  misc_feature (137)..(137): Xaa can be any naturally occurring amino acid
  misc_feature (139)..(139): Xaa can be any naturally occurring amino acid
  misc_feature (147)..(147): Xaa can be any naturally occurring amino acid
  misc_feature (153)..(153): Xaa can be any naturally occurring amino acid
  misc_feature (155)..(156): Xaa can be any naturally occurring amino acid
  misc_feature (159)..(159): Xaa can be any naturally occurring amino acid
  misc_feature (162)..(163): Xaa can be any naturally occurring amino acid
  misc_feature (167)..(167): Xaa can be any naturally occurring amino acid
  unsure (1)..(188): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVXCLEFSXVGFIFREHNASPGYYDGRYWXTCGKLPMFGWNDATKVXXRRWRXAXKELPDAYXRIIGFXNXXKCXWVXXIASXQPGWKESGKGKLNHQRAKKCH

SEQ ID NO: 17365 - protein, 692 aa, Bacteroides thetaiotaomicron VPI-5482
MNKHLHFLSLLWLSMLMAFMTACSDDKNITDPAPEPEPPVEGQWTALTASPDTWDETKRADISYQLLLYSFADSDGDGYGDLNGVTQKLDYLNQLGVKALWLSPIHPCMSYHGYDVTDYTKVNPQLGTESDFDRLVTEAHNRGIKIYLDYVMNHTGTAHPWFTEASSSSESPYRNYYSFSEDPKTDIAAGKIAMITQEGAAGYNAAEWFQVSDETAAVKGLLKFTLDWSNAPSPILVVSTGTKADEDNPDTGTDNAKYLYYGEDICKKFYDKGNNIYELTVDFESTWGLLIRTSNASFWPSGTKYGASSSSEKLALNKDFKLTNAGNPANIMFDSQQITYFHSHFCTDWFADLNYGPVDQAGESPAYQAIADAAKGWIARGVDGLRLDAVKHIYHSETSEENPRFLKMFYEDMNAYYKQKGHTDDFYMIGEVLSEYDKVAPYYKGLPALFEFSFWYRLEWGINNSTGCYFAKDILSYQQKYANYRSDYIEATKLSNHDEDRTSSKLGKSADKCKLAAAVLLTSAGHPYIYYGEELGLYGTKDNGDEYVRSPMLWGDSYTTNYTDKTDATVSKNVKTVADQQADTHSLLNIYFSLTRLRNTYPALAEGNMTKHSVYNESQEKDYKPIAAWYMTKDNEKLLVIHNFGGTAMQLPLTDKIEKVLFVNGETQQNTDSDSYTLKLGGYASVVFKLGN

SEQ ID NO: 17366 - protein, 376 aa, Oceanobacter sp. RED65
MSDTFIKSKAAIAWGPGQPLSVEEVDVMMPRKGEVLVKIIATGVCHTDAFTLSGEDPEGNFPAILGHEGGGIVEAVGEGVTSVAVGDHVIPLYTPECGECKFCTSGKTNLCQKIRETQGKGLMPDGTSRFYKDGKPIYHYMGTSTFSEYTVLPDISLAKVNKSAPLEEVCLLGCGVTTGMGAVMNTAKVQAGDSVAIFGLGGIGLSAIIGATMAGASRIIGIDINESKFELAKQLGATDCINPNDYDKPIQEVIVELTDGGVDFSFECIGNVDVMRSALECCHKGWGESVVIGVAGAGQEISTRPFQLVTGRVWRGSAFGGVKGRSELPGIVEKYLAGEFKLNDFITHTMGLEDINEAFDLMHEGKSIRSVIHYNK

SEQ ID NO: 17367 - protein, 198 aa, Triticum aestivum
  misc_feature (73)..(73): Xaa can be any naturally occurring amino acid
  misc_feature (88)..(88): Xaa can be any naturally occurring amino acid
  misc_feature (125)..(125): Xaa can be any naturally occurring amino acid
  misc_feature (142)..(142): Xaa can be any naturally occurring amino acid
  misc_feature (183)..(183): Xaa can be any naturally occurring amino acid
  unsure (1)..(198): unsure at all Xaa locations
MANSAALLHSLLSTAWTPRRRLDRASATRLAPSPGPPCRSRRPARSERPMASSTTAARADAAPPGLKEGIIGXLYNDSSSLCEIIWGXHMHQGFYNSGEAVSMSDHDQARIRMIEEALAFADDPXDKTNTPVTIVDGGCGIXGNSKYLENKYGSEGSGTTLNPELADKGTPSEQHGGWTKMDXPIADGLEQQLPHGNF

SEQ ID NO: 17368 - protein, 332 aa, Prosthecochloris aestuarii DSM 271
MNKLITIERHFLEQQKSHPEATGELTDLLNDVAFAAKLVRREVVRAGLADILGMAGTTNVQGEEVKKLDLFANEKIINAIGEHGRFALMGSEENEGTIIPPNNDTGRYILLFDPLDGSSNIDVNVSVGTIFSIYRLTGDDPKEADINDCLQKGSEQVAAGYVIYGSSVMMVYTTGQGVHGFTYDPTIGEFLLSHENITTPERGKYYSINEGSLHQFNDSTVNFINYLKEDDEATGRPYSTRYIGSLVADFHRNLMTGGVFVYPATKGHPNGKLRLMYEANPLAFICEQAGGRATNGKERILDINPTELHQRTPLYIGSKEDVLKAEEFEKEG

SEQ ID NO: 17369 - protein, 468 aa, Burkholderia pseudomallei K96243
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAIVVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKAAGLERRYGRG

SEQ ID NO: 17370 - protein, 354 aa, Chlamydomonas reinhardtii
MASLRKPSNHADRACSRRLRVATRVAGRRMCRPVAATKASTAVTTDMSKRTVPTKLEEGEMPLNTYSNKAPFKAKVRSVEKITGPKATGETCHIIIETEGKIPFWEGQSYGVIPPGTKINSKGKEVPTARLYSIASSRYGDDGDGQTASLCVRRAVYVDPETGKEDPAKKGLCSNFLCDATPGTEISMTGPTGKVLLLPADANAPLICVATGTGIAPFRSFWRRCFIENVPSYKFTGLFWLFMGVGNSDAKLYDEELQAIAKAYPGQFRLDYALSREQNNRKGGKMYIQDKVEEYADEIFDLLDNGAHMYFCGLKGMMPGIQDMLERVAKEKGLNYEEWVEGLKHKNQWHVEVY

SEQ ID NO: 17371 - protein, 404 aa, Brassica rapa
MGICMSVQVKAESPSNTGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 17372 - protein, 324 aa, Arabidopsis thaliana
MSSGTVRRVSRQDIQLVQNLIERCLQLYMNQKEVVDTLLEQAKIEPGFTELVWQKLEEENREFFKAYYLRLMVKHQIMEFNKLLEQQVHHMRQMHPTGVASVQNTNGSHLQSMNQKQLCYPSEHTDQSLKSESAHHPMASSLSNAFLNGSSTLNTNVPSSINISTHARRVDASPNMLSSQTTNMPMMQGMNGGMIKSETAFTNPASFMYGGERNALEGHSAVGDTSIPNFSNESNNQPLSDPLLEAEASTFGFLGQIPRNFSLSDLTADFSQSSEILESYDRSPFLVPNAENFLDSRDRGEYQGDNKRLDTISEGFSYDNIGSE

SEQ ID NO: 17373 - protein, 377 aa, Bacillus clausii KSM-K16
MKAVTYQGMNHVEVSTIKAPEIQDPEDVIVRITSTAICGSDLHLYQGNMYTPKGFVIGHEPMGIVEETGPEVTKVKKGDRVVIPFTVACGHCPYCQNHQESQCDRSNPHYDSGGLFGYSEKFGDYPGGQAEYLRVPFGNYTPFRLPDDCELEDEQVLFLSDVLPTAYWSVVHAGVKKGDTVIVLGCGPVGLMTQAFAWQQGAERVIAVDYFDYRLEKARQMNHTETFDFTKDKDTGETLKELTKGGADVVIDCVGMDGKKSPLEMVEQKLKLQGGTLGPIQIATKAVKKCGIVQLTGVYGGNYNLFPLGAFFSRNVTLKMGQAPARAYMETLYEQISKGLINPTSIITHKLALSDAPKGYDLFNNKKDGCIKVVLKP

SEQ ID NO: 17374 - protein, 360 aa, Blastopirellula marina DSM 3645
MLHAVIMAGGAGTRFWPASRVDRPKQLLDLTGDGTMIQATASRLGDLMSPERILIVTNERLIEPIQQQFPSLPASAIVGEPCKRDTAPCIGLAALLVARHDPDAIMVVMPSDHVISPESAFQSAIRYGAALVADSADKIVTFGIQPKYPAETFGYIERGDSLTSDAEAPPTFSVARFREKPKGDVAREYFESGRFYWNSGIFIWKAKTILDALRRHEPEMFAHLEAIGAAWGTPEQAETFTAEFTAIRGKSIDYAVMEHHQDVAVIEAPFLWDDVGNWQSLQRLNDSDLDGNTVLANHLGIDTQQCIIKADDDHLIVTLGMREVIVVHTRDATLVADKNREEEIREVVKQLQANGWDAHL

SEQ ID NO: 17375 - protein, 99 aa, Tulipa gesneriana
MAKNHKLPAAALKQMLMRCSSIGRRQNCQGLPVDVPKGHFVVYVGEKRSRFIVPISYLARPEFQQLLRHAEEEFGFEHDIGLTIPCEEVVFRLLTLALR

SEQ ID NO: 17376 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAAAVKSA

SEQ ID NO: 17377 - protein, 390 aa, Legionella pneumophila subsp. pneumophila str. Philadelphia 1
MHDGSVFYTIFLIFAGAAFFSTLVLYTKQSLLVAYITLGAILGPWGFKLVSDVTVVKQIGDIGIVFLLFLLGLHLQPQNLIHMLRKVTWIAIVSSILFAALAYGIGRWFGLTVTESLILGGAMMFSSTIIGLKLLPTTILHHQHTGEVMISVLLMQDVIAIVLLILLNSAHQDGNLSISDFILVIIALPALCLFSFLFERYILIKLLARFDRTQEYVFLLSIGWCLGISVLAQTIGLSEDIGAFIAGVALASSPISLFIAESLKPLRDFFLVMFFFSIGATFNFGFGAQVVIPAVILATLILIIKPLLFYILLARSGEKKQVAKEVGIRLGQGSEFSLLVASIALSTNLISEVASNLIQATTILTFIVSSYLVVLKYPTPIALSEKMRKD

SEQ ID NO: 17378 - protein, 107 aa, Tulipa gesneriana
MAVRKSSNLPQAAVIRHILKRCSSFGRKNGACSDKGHSLPLDVPKGHFAVYIGEKRSRFIVPISLLAHPEFQSLLRAAEEEFGFDNDMGLTIPCEEVVFRSLTAVLC

SEQ ID NO: 17379 - protein, 471 aa, Herbaspirillum seropedicae
MARTAAEVLKMVKDNEVKFVDFRFADTRGKEQHVSVPVSHFDIDKFESGHAFDGSSIAGWKGIEASDMLLIPDPNTANIDPFMEETTLFMQCDVIEPSDGKGYDRDPRSIAKRAEAYLKSSGLGDTAYFGPEPEFFIFDGVRWGADMSGSFVKIDSEEASWSTGAKIEGGNSGHRPTVKGGYFPVPPVDSFQDMRSEMSLIIESLGIPVEVHHHEVAGAGQNELGTKFSTLVERADWTQTMKYVIWNVAHTYGKTATFMPKPLVGDNGSGMHVHQSVWKDGKNLFAGDGYAGLSEFALYYIGGIIKHAKALNAITNPGTNSYKRLVPGFEAPVKLAYSARNRSASIRIPHVANPKGRRIETRFPDPLANPYLCFSALLMAGLDGVQNKIHPGEAATKDLYHLPPEEDKLIPTVCSSLDEALEHLDKDREFLTRGGVFTDSMIDAYIDLKMQEVQRFRMTTHPIEFDMYYSL

SEQ ID NO: 17380 - protein, 273 aa, Nocardia farcinica IFM 10152
MTRIAVIGGGRIGEALIAGLLESGRASKDLVVVETHQDRAELVASRFGVRVTAEVADAAIGADLLVIAVKPGDVDTVLTQLGKAELNAGDVDQVLVSLAAGVPTARLEAKMPAGFPVVRVMPNTPMLVGQGMIVLAPGRYTKPSQLELVTEVLGTVGKVVTVAESQMDAVTAVSGSGPAYFFLVVEAMIDAAVSLGLSRDIATDLVVQTMVGSAALLDEAEQSAVELRAAVTSPAGTTAAALRELERAGVRSAFLEALHAAKERSAEQGASAE

SEQ ID NO: 17381 - protein, 425 aa, Oryza sativa
MGNAQASASSTSSPRFSMASRAFSRQELDDLRALFVSLAAQSQTGGRAISRPVFLEYFGIRGALGDRLFQLVARESGGGEGVTFEDLIVSKATYERGTRDEVDEFIYQLCDVTGDEVLERSDLETILASIRETIFSENKEAGEGSNKRTFEAFINSAVFSKDAEGVARKSMSLSDFRSWCILIPSLRKFLGSLLMPPDSGRPGFQVPALHYLENISPDLLLLNKEYAWHIGGGFSQQEVQEWRLLYHSSLHGQSFNTFLGNVTNGDAQTVIIVKDTEGFVFGGYASHPWERHSDFYGDMKTFLFKLYPEASIFRPTGGNRNLQWCAVNFSSDSIPNGIGFGGQPHHFGFFLSANFDQGHSFTCTTFTSPALSKTNRFRPEVIECWGIQTKGALDEKAELVKGTVLERFKEDRNMLKLVGLANASD

SEQ ID NO: 17382 - protein, 529 aa, Alvinella pompejana epibiont 7G3
MSKFTVVVCDHIHQSGLDILSNEPKINLIVAADEPKDKLVKDIIPQANVAITRSSTDVDEFFLEHAKELKAIVRAGVGVDNVDIDGCSKRGIVVMNVPTANTIAAVELTMAHMLSCVRKFPYAHNNLKQDRIWRRQDWYGTELKNKKLGIIGFGNIGSRVGIRAKAFEMDVIAYDPYIDPKRATDLDITYTKNFDDILSCDIITIHTPKTKETIGMVGEKEIEKMRDGVILINCARGGLYDEKALYNGLKSGKIAMAGIDVFEKEPATNNPLLDLDNITVTPHLGANTKESQRNIAVQSAESAILSAKGISYPNALNLPIKENDIPDSIKPYFELIQKMGNILAQATREKVEKIKVITEGEVSKYIDSITTFGVVGILKESLEDGVNYVNAEFIAKEVGITIEKEKSLKNSGLANRVTVILTTTNQTVQISGTIFGENTQRIIEINGYKLDLEPKGKMILFRNTDVPGVIGDVGRIIASYNVNISDFRLGRDSNSQALAVVKVDDNVNKSLLQELSSLETCISVAYVVI

SEQ ID NO: 17383 - protein, 348 aa, Neisseria meningitidis MC58
MKMQAVVVNKNVAGDVEVIEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHH

SEQ ID NO: 17384 - protein, 701 aa, Borrelia garinii PBi
MNKKIFYTTILLHLPNLLFSYSTKYDIEAKMSYFVMSLAIIVISSISLGNLVTKIGIPKVIGQITAGIILSPNAFGKIKIPLLFPLGITQIGENYLIDEKIFAISTIASIILLFTAGLETDLKLFIKFLPRGGIIGITEVIGTFTSFVLMASIIFNVPLISPTSLFIGIIGTPTSAGIAASILSAKKKMSTSEGVTIISTSIIDDVLSMLMLTSVITISRSISDLDIASSIKTIIQSIVIWLCLTFSLIYVSETLSKLLKKLNSVTLATVITLSLALTIASIFQNLGMSFVVGAYVFGLAMSKTDIVYVIQDKLTIFERFFIPIFFTSIGLMSDINEILSKEVLILGLAISAIAIITKSIFCFIPALFLGFNKLGALKIATGMVPRGEVSLIMANVALSSGFISQKIFGIIIIMVFLPTIIVTPIINFLFKINKSGLKKELPIDQNTHICVYFEYDNLAKILIWDLKNELRKEGFFTQQIKNDSSQYINARKNNISFSIKREGSQITFECPNNHLIIIQDLFRETILNLEKITEEVKTVSLRAKKLDYSINYDKILSKINLNKRIKKENIILELKASNKADVIRELLSVINIEIDKKRIFQDLMEREKLITPALKEGFAIPHLKTNLISKIHIAIGISHEGIDFNALDKNLSHVFILILCPAKDYVSYPRILASVVGKVDLYKKEILNAKTDKEIYNIIVG

SEQ ID NO: 17385 - protein, 563 aa, Clostridium acetobutylicum ATCC 824
MSKVIYKISIDLGGIVKRNFEKETKNCGKVNEEVLFKILKSNDKSEIGIKFKFKDIKSIRQFKDSVPITEYKDYEKYINRMADGEGNVLMSEKVEYFGHTSGTTGKQKLVPCTKNSRRRASKYMALLVNRFCYDNFKENWNYARGMMIADIVMTTYTKGKIPICSATSGGMKGIKHLLPYLYTSPIEVMEIKDKETALYLHLLFGLEEEELLYISGVFISNILDLFRTLEKNNKALVRDIQKGSISEELNIDEGLRKVLNKKLKPNNKRAMELEKEFKKGFKGIAKRIWPNLLYIASVTGANFSIYNDKVYYYIDSIPIYSAAYGSTEAMIGINPYASKVLYVITPSAVFYEFIPIGEKGEESFDTLLLSELKLGGRYEVVITNYAGLYRYKIGDVVKVVGFYNKCPEIEFLYRKNQVLNMAAEKTNEEHLTYAIKNTIKKLNLDLVDYTTEPDNSITPGRYIFYFEFRNNMYGFSTEKLQNILDDELRVSNLAYNRARNNKKLGMLKVEVLAPNTFDLIKEALFNKGISKNQIKIPRVIINNKIVMDIINRNKIKFVKKSVI

SEQ ID NO: 17386 - protein, 122 aa, Triticum aestivum
GETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 17387 - protein, 613 aa, Oryza sativa
MAAPSQTTATTTHHRVLLPSHHHHRAVPPSLLRLPLRAARRGRLSAAAAAAAPAASTAAPSEPAAGAVPGKPTVLVAEKLGAAGLELLRGFANVDCSYGLSPEELRAKIPLCDALIVRSGTKVGRDVFEASGGRLRVVGRAGVGIDNVDLAAATEHGCLVVNAPTANTVAAAEHGIALLTAMSRNIAQADASLKAGKWQRNKYVGVSLVGKTIAILGFGKVGSEVARRAKGLGMHVIAHDPYASADRAHAIGVELVSMEDALTTADFISLHMPLTPATNKMLNDETFAKMKKGVRIINVARGGVIDEDALVRALDSGIVAQAALDVFTKEPPAPDSKLVLHENVTVTPHLGASTVEAQEGVAIEIAEAVIGALKGELAASAVNAPMVPAEVLSELAPYVVLAEKLGRLAVQLVAGGGGIKSVKVTYASARAPDDLDTRLLRAMITKGLIEPISSVFVNLVNADFTAKQRGVRITEERILLDGSPETPIDYIQVHIAHVESKFPSAISESGEITVEGKVKDGIPHLTKVGSFQVDVSLEGSLILCRQVDQPGMIGAVGSVLGEENVNVSFMSVGRIAPRKHAVMAIGVDEEPKKSTLTKIGEIPAIEEFVFLKL

SEQ ID NO: 17388 - protein, 67 aa, Triticum aestivum
DTYYSLTRSMLHKLGLEKYEKNFRKGLLNDQTLPLLTDSALRDVKIPPGPRLLILDQIKRDPGLRAK

SEQ ID NO: 17389 - protein, 480 aa, Kineococcus radiotolerans SRS30216
MAHPHGKKHDTSTDDGGGLTGAVVVVALVSAISGLLYGYDTGIISGALLQIGDEFEIGNGWEQLIAASILAGAVVGALTCSRLSERRGRRGTLLVVAVVFVVGTLGAAFAPNPELLSLARLVLGFAVGGATQTAPVYVAELAPTKYRGRLVLFFQIAIGVGILTATIVGASEAVDWRVSIGAAAVPAAIMLVLMLRLPESPRWLLKSDQQDRARQSLERVRPRGADVAGELHEIDALVREESSAGTRGWRGLREAWVRPALVVGCGLAIATQLSGIEMIVYYSPTILTDNGFADSTALQVSVGLGATYLITQLIGLAIIDRVGRRRLTLITLPGAALALIVLGTFFVTGNDGKEQVPYIIATLIAFMAFTAGGIQLMGWLTGSEIYPLATRSAGAAAQSASLWGTNLLITLTLLSIIDTIGTGQTFWLYAAFNVLAFVFLYKRMPELTGHSLEEIEGRLHEGRFRPADFAKEPAERAASR

SEQ ID NO: 17390 - protein, 171 aa, Pinus thunbergii
MATGAGAGAATVVSAFTGLKSTAQFPSSFKMSNAAAEWEQKTTSNGGRVRCMQVWPPFGNPKFETLSYLPTLTEEQLVKEVEYLLRNKWVPCLEFDLEGSISRKYNRSPGYYDGRYWVMWKLPMFGCTEASQVINEVRECAKAYPKAFIRVIGFDNVRQVQCISFIVHKPE

SEQ ID NO: 17391 - protein, 511 aa, Synechococcus sp. CC9605
MVDDEQRENEGDLICAAQFATPEAINFMATEARGLICLAMEGQRLDELDLPLMVDRNTDANETAFTVSIDAGIEHGVTTGISAEDRAATIQVALNPATRPAELRRPGHIFPLRARPGGVLKRAGHTEAAVDLAQLAGLSPSGVICEIQNSDGSMARLPELRSYADRWGLKLISIADLIRYRLDNERFVRRMAQAQMPSRFGNFQAVGYRNELDGSEHVALIKGEPNALSEPVLVRMHSECLTGDAFGSLRCDCRPQLEAALHQIEAEGEGVVVYLRQEGRGIGLINKLKAYSLQEAGLDTVEANERLGFPADLRNYGVGAQILSDLGIHRLRLLTNNPRKIAGLGGYGLQVEERVPLVMDPGAYNADYLAAKREKLGHLFESESPCVVLALAVNVGPESWPTVRREVEAIAQRHGFSLEALHEPRLLALWDRPQFVWKLIPDGADAAPLLKNLAALAATERVGLMRVPTERMALHPPQTLERVEHQLNELINLGSDGLLENGPSLLHWTRS

SEQ ID NO: 17392 - protein, 107 aa, Tulipa gesneriana
MAVKKSPKISEAAAIKQILKRCSSIGRKHGAYSEENYCLPLDVPKGHFAIYVSEKRSRFVVPISLLAHPEFQSLLRDAQEEFGFDHDMGLTIPCEEIVFKSLTAVLW

SEQ ID NO: 17393 - protein, 181 aa, Lactuca sativa
MASISSSAIATVNRTTSTQASLAAPFTGLKSNVAFPVTKKANNDFSSLPSNGGRVQCMKVWPPIGLKKYETLSYLPPLSDEALSKEIDYLIRNKWIPCLEFELEHGFVYREHHHSPGYYDGRYWTMWKLPMFGCTDSAQVMKEVGECKKEYPNAFIRVIGFDNIRQVQCISFIVAKPPGVL

SEQ ID NO: 17394 - protein, 91 aa, Triticum aestivum
MAGAAKASWTVAMSVGAVEALKDQAGLCRWNYALKSIHRTAKARVNVHGGASQSTKQLPASAAAVAERRRAEKAEEGLRTVMYLGCWGPNC

SEQ ID NO: 17395 - protein, 463 aa, Glycine max
GLLGSIFPKPFGTTSKFPHCPLPQRNNSTVPYDKGFLRAGAMSSPYLPATTDSLALATEAKDPSEAISILYRVLDDPSSSPDALRMKEQAITNLTKLLTDENRGEDLRSLLTQLRPFFSLIPKAKTAKIVRGIIDSVAKIPGTSDLQIALCKEMVLWTRAEKRTFLRQRVEARLAALLMESKEYSEALTLLSGLVKEVRRLDDKLLLVDIDLLESKLHFSLRNLPKAKAALTAARTAANAIYVPPAQQGAIDLQSGILHAEEKDYKTAYSYFFEAFESFNALDDPKAVFSLKYMLLCKIMVNQADDVGGIISSKAGLQYLGPDLDAMKAVADAHSKRSLKLFEIALRDYKAQLEEDPIVHRHLSSLYDTLMEQNLCRLIEPFSRVEIAHIAELIELPTDHVERKLSQMILDKKFAGTLDQGAGCLVIFDDPKTDAIYPATLETISNVGKVVDSLYVRSAKIMA

SEQ ID NO: 17396 - protein, 432 aa, Exiguobacterium sibiricum 255-15
MSTHTKRPTSESLYEVAQKCIVGGVNSPSRSYKAVGGGAPVYMERGEGAYFYDVDGNRYIDYLAAYGPIITGHGHPHITEAITNASRNGLLYGTPHRLEIDFAHKLQQAIPSLEKVRFTNSGTEAVMTTIRVARAYTGRELVVKFSGCYHGHSDLMLIAAGSGPATLGSPDSAGVTKATAKEVITTPFNDIESYRQIMAEWGDQVACVLVEPIVGNFGIVEPQPGFLEAINEITHEHGALVIYDEVITAFRFTYGSAQELLNIRPDMTALGKIIGGGLPIGAYGGRQDIMEHVAPLGPAYQAGTMAGNPASMAAGIACLELLEQPGVYEEFDRLGAKLEQGILEAADTHGVTITINRLKGALTVYFTDETVVDYLGAERADSEMFGRFFKLMLEQGVNLAPSKYEAWFLTTAHTETDIDETIAAVNRAFAQL

SEQ ID NO: 17397 - protein, 334 aa, Corynebacterium efficiens YS-314
MTIRVGINGFGRIGRNFYRAVLERSDDLEIVAVNDLTDNKTLSTLLKFDSILGRLSEEVEYDDESITVGGNRIAVYAERDPKNLDWAAHNVDIVIESTGFFTDAQAAKAHIDAGAKKVIISAPASNEDATFVYGVNHQDYDPENHHVISGASCTTNCLAPIAKVLNDKFGIENGLMTTIHAYTGDQRLHDAPHKDLRRARAAAVNIVPTSTGAAKAVALVLPELKGKLDGYALRVPVITGSATDLTFTTNSDVTVESINAAIKEAATGELAETLAYTEEPIVSTDIVTDSHGSIFDAGLTKVSGNTVKVVSWYDNEWGYTCQLLRLTELVASKI

SEQ ID NO: 17398 - protein, 479 aa, Triticum aestivum
  misc_feature (87)..(87): Xaa can be any naturally occurring amino acid
  unsure (1)..(479): unsure at all Xaa locations
MAAPSAVGCFLGLAFLLCGAARGAPQLDAEAARQQAADRVGRLPGQPAVKFAQYAGYVTVNEAHGRALFYWFFEATAGAAKKPLVLXLNGGPGCSSIGYGEAEELGPFLVPKGKPELKWNPYSWNKEANLMFLESPVGVGFSYTNTSSDLGKLGDKITAADAYVFLLNWFKRFPQYKHHEFYIAGESYAGHYVPQLSEKIFDGNKHGPKENRINFKGIMIGNALMDDETDQAGMVQYAWDHAVISDRVYADVKAHCDFAMANTTAACDQALEEYFAVYRLIDMYSLYTPVCTDGSSSSPLAKRVGVHGAAPKIFSKYHGWYMRPAGYDPCTTQYSEVYFNRPDVQAALHANVTKIGYNWTHCSDVIGKWNDAVPSTLPIIRKLVAGGIRVWVFSGDTDGRIPVTATRLTLNKLGLKTVQEWTPWYDRLQVGGWTITYEGLTFVTIRGAGHEVPMHTPRQALSLFSHFLGDTKMPPAAFS

SEQ ID NO: 17399 - protein, 323 aa, Lactococcus lactis subsp. lactis Il1403
MRTTKQFVLLKLLQQKGNWVSGDELAEELKLSRESIWKAINTLKRKGNQIESRKNLGYKYVGNESLDEDTINFYSGMKFEDKIFVFDEVTSTQELAKQYLSSHEVKQPFIFVANNQTEGHGRRGRNFYSPSDTGLYFSLILPNPSHDILKIGLLTTSTAVAVVKVLEQFYKDKNFQLKWVNDIYLGTYKVGGIITEAALDLESSSAGNFIMGIGLNLSTKDFPADLSEKAQGINPEFKIDRNQLLAEMAKEVINNFANYRQPDLIDEYRKRSLLFGKNVTLKLGTKAVNGKVEGISDDGSLILKAKSGELQTFKSGEVVKVDW

SEQ ID NO: 17400 - protein, 408 aa, Candidatus Pelagibacter ubique HTCC1002
MLKNIVKGLKPSSTLKINEISRKLEDKGEKIFKFGFGQSPFQVPNDIVNALKDNAHQNKYLPMQGLNELRDAVAKYTSVKKDYNYKPENIIIGPGSKELMFLLHIIFDGEIILPAPSWVSYAPQAILGRNKIQSIQTKRENNWFPTGSEIEEVILKDKNKNYLLFLNSPNNPSGQICKNLEEISEIAKKYNLIILSDEIYSELSFDEEFKSISSYCPEKTIISTGLSKWCGAGGWRLGYFIVPDSLNILKNSINVLASETFSAVSAPIQYAAITAYTRDHSKYIDSSKNILKAVGNYVYENLKSNKVLINKPQGGFYLMPEFLNKKFNTSSEMCDNILKETGVALLPGSDFGFDKNKMLARLSFTDFDGQEFMKQTQNGQAIDKNLILKLAPKIVEGVDKLKKWSTST

SEQ ID NO: 17401 - protein, 273 aa, Zymomonas mobilis subsp. mobilis ZM4
MSAIPSSNKRRTIPELRARKGKSPIVALTAYSALTARFVDPYADFILVGDSLAMVEHGMATTIGASLDMMILHGQSVMRGSEKAAVVIDMPFGSYEASPQEAYHNAVRILSETGCSAVKLEGGSHLAPVIAFLTARGVPVMGHIGLTPQYVQTLGGFKIQGHSSEQQDKIKQDALDFEAAGAFSVVLEGVTEPLAREITDNIAIPTIGIGASSYCDGQVLVLEDMLGFNDKVPRFVKKFAHLGDDIKKAVSDYATAVSNRSFPAEDNIYRPKS

SEQ ID NO: 17402 - protein, 802 aa, Bacillus cereus ATCC 10987
MFTHVESFKSAFLEKLETMYGKSFKESTTRDQYNTLGYMVREYMNSQWIATNESYRSGERKQMYYLSIEFLLGRLLGSNILNLGIKDVCEQGLSELGISLQQLEEVEADAGLGNGGLGRLAACFLDSLASLNLPGHGCGIRYKHGLFDQKIVDGYQVEFPEQWLLHENVWEVRRHDQAVEVSYFGNVEPLYIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAARIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSVAEDIFPAADVSEQISTASKEASGTGNMKFMMNGAITLGTLDGANIEIKDRVGDDNCFIFGLTAEEVLHYYQNGGYRASDYYHHNGHIKKVVDQLTNGFFAQSGAEFEAIYDSLVIQNDEYFVLRDFGPYAEKQEAVGRAYENRTKWLEMSILNIAQSGHFASDRTILQYSNEIWGIGNTVTQI

SEQ ID NO: 17403 - protein, 637 aa, Mycobacterium tuberculosis H37Rv
MLSVGRGIADITGEAADCGMLGYGKSDQRTAGIHQRLRSRAFVFRDDSQDGDARLLLIVAELPLPMQNVNEEVLRRLADLYGDTYSEQNTLITATHTHAGPGGYCGYLLYNLTTSGFRPATFAAIVDGIVESVEHAHADVAPAEVSLSHGELYGASINRSPSAFDRNPPADKAFFPKRVDPHTTLVRIDRGEATVGVIHFFATHGTSMTNRNHLISGDNKGFAAYHWERTVGGADYLAGQPDFIAAFAQTNPGDMSPNVDGPLSPEAPPDREFDNTRRTGLCQFEDAFTQLSGATPIGAGIDARFTYVDLGSVLVRGEYTPDGEERRTGRPMFGAGAMAGTDEGPGFHGFRQGRNPFWDRLSRAMYRLARPTAAAQAPKGIVMPARLPNRIHPFVQEIVPVQLVRIGRLYLIGIPGEPTIVAGLRLRRMVASIVGADLADVLCVGYTNAYIHYVTTPEEYLEQRYEGGSTLFGRWELCALMQTVAELAEAMRDGRPVTLGRRPRPTRELSWVRGAPADAGSFGAVIAEPSATYRPGQAVEAVFVSALPNNDLRRGGTYLEVVRREGASWVRIADDGDWATSFRWQRQGRAGSHVSIRWDVPGDTTPGQYRIVHHGTARDRNGMLTAFSATTREFTVV

SEQ ID NO: 17404 - protein, 157 aa, Staphylococcus aureus
GHSERRELFHETDEEINKKAHAIFKHGMTPIICVGETDEERESGKVNDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGA

SEQ ID NO: 17405 - protein, 588 aa, Hordeum vulgare
MVMGSTDRFDKSPLLDGGSSSQESTTEYTGDGSVCTSGHPASKKHTGNWKASSLTIVCSFCCYLAYSSIGKNLVSYLTKVLHETNLDAARHVATWRGTSYLAPLVGAFVADSYLGKYRTALIACTIFIMGMMMLLLSAALPLISAGPHAWTLWADPVSSRYIMFLVRLYMVGLGYGAQSPCVTSFGADQFDDTDEVEKTRKSSFFNWHYFSINAGSLIAGTVIVWVQEHEGWLWGFTISTLFVTLGISVFSLGSIVYRFQKPGGSPLARIWQVVVAASRNFDKVLPCDSSALYEFSGQGSAIEGSRKLVHTSGLEFFDKAAIVTLPDCESPGQLNEWKICTVTQVEELKILIRMFPIWSAMVLFAAVQEQMFSTFVEQGMTMEKHIGSFEIPAASFQSIDTITVIMLVPIYEKVLVPVIRKFTGRANGITSPQRIGIGLCFSMFSMLLAALVESNRLQIAQAEGLVHSKVVVPMSILWQGPQYFLLGVAEVFSNIGLTEFFYDESPDAMRSLGMAFSLLNISVGNYLSSFILSLVPVFTARGGSPGWIPDNLNEGHLDRFYLMMAGLSLLNIFVFAFYARRYKCKKAS

SEQ ID NO: 17406 - protein, 468 aa, Francisella tularensis subsp. holarctica
MITPIILSGGSGSRLWPLSREASPKQFIGLVDEHSLLENTIKRLDNVKDITSPVVVCNESHRFQVAEVLRKINKKGDILLEPLARNTAPAIALAALHLATNDPNTIMLVLAADHHIENLEIFHQAIEKAQQKVIKDDSLVTFGITPTCPHEGYGYIKQGVQTTVNGVYKVDKFVEKPSAVVAQEYLDSGKYYWNSGMFMFTARAYLEALEKLQPEIYRGCEKTYQKSQQDLDFVRFDKQSFTLVQSQSIDYAVMEKATNVAIVPMQQSGWSDVGSWDSLYDIAAKDSCGNVVIGDVITSNVKNSYLRSHDRLLAAVGVNDLIIVETADAILVADKNKTQDVKKIVEILKIQQRSELLQHKQIYKSWGSATILEDKSGYKIQAIQLEPGKKLSLQQHYHRSEHWIVISGTATVTIGTTKSIVRPNESVYIKIGESHRLENNGKIPVILIEVQVGEYISEDDIVRLYTSS

SEQ ID NO: 17407 - protein, 383 aa, Bacteroides thetaiotaomicron VPI-5482
MKHTNPQVEQMTSFIVMDVLERANELQKQGVDVIHLEVGEPDFDVPACVAEAAKAAYDRHLTHYTHSLGDPELRREIAAFYQREYGVTVDPDCIVVTSGSSPSILLVLMLLCNSDSEVILSNPGYACYRNFVLAAQAKPVLVPLSEENGLQYDIEAIRKCVTPHTAGIFINSPMNPTGMLLDESFLRSVASLGVPIISDEIYHGLVYEGRAHSILEYTDKAFVLNGFSKRFAMTGLRLGYLIAPKSCMRSLQKLQQNLFICASSIAQQAGIAALRQADSDVERMKQIYDERRRYMISRLREMGFEIKVEPQGAFYIFADARKFTTDSYRFAFDVLENAHVGITPGIDFGTGGEGYVRFSYANSLESIREGLDRISQYLSRCGF

SEQ ID NO: 17408 - protein, 523 aa, Candida maltosa
MAIEQIIEEVLPYLTKWYTILFGAAFTYFLSIALRNKYYEYKLKCENPPYFKTAGFVGIPGLIDVIKAKNAGKLADYADQTFDEYPHHSFYMTVAGMLKIVLTVDPENIKAVLATQFNDFALGARHAHFDPLLGDGIFTLDGEGWKHSRAMLRPQFAREQIAHVKALEPHVQVLAKQIKLNKGETFDLQELFFRFTVDTATEFLFGESVHSLYDEKLGVPPPNNIPGRENFAKAFNTSQHYLATRTYSQMFYFLTNPKEFRDCNAKVHKLAQYFVNKALDASEDEVAEKSKGGYVFLYELVKQTRDPKVLQDQLLNIMVAGRDTTAGLLSFAMFELARNPKIWNKLREEIEVNFGLGEEARVDEISFETLKKCEYLKAVLNETLRMYPSVPVNFRTATRDTTLPRGGGKDGTSPIFVPKGSSVVYTVYKTHRLEEYYGKDAYEFRPERWFEPSTRKLGWAYVPFNGGPRICLGQQFALTEASYVITRLAQMFEHLESKDETYPPNKCIHLTMNHNEGVFISAK

SEQ ID NO: 17409 - protein, 388 aa, Anabaena variabilis ATCC 29413
MKLAARVSQVTPSITLAIAAKAKAMKAEGIDVCSFSAGEPDFDTPAHIKAAAAKALDEGKTKYGAAAGEPKLREAIAHKLQKDNHLDYKPENVIVTNGGKHSLYNLIVALIDPGDEVIIPAPYWLSYPEMVTLVGGKSVIVPTDASTGYKITPEQLRKAITPKTKLFVLNSPSNPTGMVYTPEEIKALAQVVVDADIYVVSDEIYEKILYDGAQHISIGSLGKEIFNRTLISNGFAKAYSMTGWRLGYLAGPVDIIKAASSIQGHSTSNVCTFAQYGAIAALEDSQDCVEEMRQAFAKRRQVMLDRLNAIPGLSTAKPDGAFYLFPDISKTGLKSLEFCDALIEEHKVAVIPGIAFGADDNIRLSYATDLATIEKGLDRLEKFVRSRI

SEQ ID NO: 17410 - protein, 245 aa, Nocardia farcinica IFM 10152
MTYTLVLLRHGESEWNALNLFTGWVDVHLTDKGVAEGKRAGELLAEHGILPDIVYTSLLRRAISTANIALDAADRHWIPVVRDWRLNERHYGELQGKNKAQIRDKYGEEQFMLWRRSYDTPPPPIEAGNEYSQEGDARYAGIDIPKTECLLDVVNRMVPYWESTISKDLLAGKTVLIAAHGNSLRALVKHLDQISDEEIAGLNIPTGIPLRYELDENLRPVRPREYLDPEAAAAGAAAVASQGGK

SEQ ID NO: 17411 - protein, 289 aa, Aspergillus nidulans FGSC A4
MGIDIDLTVAVIGCGTLGTAIAAGILDPKDKSGINIKRLIATVGTEPSKQRVRDALSTHESRLTVLTHGGNVRAIQEADVVLLAVKPFKRAEVFCAPGFKEAIRNKLVLSIMAGITTKEFARLAIGDGAAPGILQVVRAMPNMAAKIREAMTLYTPSPGTSPENLSIASWIFGQVGESHQIPEASFDICAVLVGCAGSLLLLAVDGLLDAAVAEGVRRSEVQNLVVNSAIGMLKLVPAGDHPSVLREKIASPGGCSIQALLELERLGARSAFTRAIMAAAEKSKAMSSS

SEQ ID NO: 17412 - protein, 181 aa, Oryza sativa
  misc_feature (141)..(141): Xaa can be any naturally occurring amino acid
  misc_feature (155)..(155): Xaa can be any naturally occurring amino acid
  misc_feature (168)..(168): Xaa can be any naturally occurring amino acid
  unsure (1)..(181): unsure at all Xaa locations
QASNGSLGDGGRRATSVAPFQGLKSTAGLPVNRRSSSSSFGNVSNGGRIRCMQVWPIEGMEKFETLSYLPPLTVEDLLKQIEYLLRSKWVPCLEFSKVGFVYRENHRSPGYYDGRYWTMWKLPMFGCTDATQVLKELEEAXKAYPDAFVRIIGFXDNVRQVQLISFIXAYKPPGCEESGGN

SEQ ID NO: 17413 - protein, 370 aa, Oryza sativa
MRGLARAGKRASEMAFNAGGGAVNWFPGHMAAASRAIRDRLKLADLVLEVRDARIPLSSANEDLQPVLASKRRILALNKKDLANPNIMNRWLHHFESCKQDCISINAHSTSSVSQLLGLVEFKLKEAISKEPTLLVMVVGVPNVGKSALINSIHRIVTSRFPVQDKNKRATVGPLPGVTQDIAGYKISSQPSIYVLDTPGVLVPSIPDMETGLKLALTGAVKDSVVGEERIAKYLLSLLNIRKTPLHWERLVYRREQFNEDAFNSNEKDYRDSPRRRRRPNNSDALYVQDMVMEVQRTLCSTFMDFADNTEDENELESLIDSQLVALRKVFRIPHKPFDETHGPASKKLLALFRSGKLGPFILDDLPDNQ

SEQ ID NO: 17414 - protein, 363 aa, Triticum aestivum
MFVFCLCTRCRICRVSSFPVLLLFMFIHLSYFFLVLLLILGQFFFTRYEKYHGYYGGKEESRKSNYTDMVNKFPPSATSFYEYGWGESFHFAHRWNGESLRESIKRHEHFLALQLELKPGMKVLDVGCGIGGPLREIARFSSTSVTGLNNNDYQITRGKALNRSVGLGATCDFVKADFMKMPFSDNTFDAVYAIEATCHAPDPVGCYKEIYRVLKPGQCFAVYEWCITDHYDPNNATHKRIKDEIELGNGLPDIRSTRQCLQAVKDAGFEVIWDKDLAEDSPLPWYLPLDPSRFSLSSFRLTTVGRIITRNMVKVLEYVGLAPEGSQRVSSFLEKAAEGLVEGGKKEIFTPMYFFVVRKPLSE

SEQ ID NO: 17415 - protein, 434 aa, Corynebacterium efficiens YS-314
MMTVTENAVTENAAQNIQLDTVEEAIAEIAAGRAVVVVDDENRENEGDIIFAAELATPELVAFMVRYSSGYICTPMTSEDADRLDLPPMTAHNQDARGTAYTVTVDANTGSTGISATDRAHTIRLLADPNSDRTDFTRPGHVVPLRAREGGVLVRAGHTEAAVDLARAAGLRPAGVICEVVSEEDPTGMARLPELRRFCDTHGLKLISIEQLIAWRRQNEILVERVVETKLPTEIGEFTAVGYRSKVDGTELMAIVEGDPSSDGGENVLVRVHSECLTGDVFGSRRCDCGQQLNESLRMIHEAGRGVVVYMRGHEGRGIGLLAKLRAYQLQDEGADTVDANLSLGLPADAREFGTGAQILYDLGVRSINLMSNNPTKRMGLEGHGISIAGRTPIPVQVHEDNIRYLRTKRDRMGHILPAIDEWDAAHGNTDKTT

SEQ ID NO: 17416 - protein, 137 aa, Triticum aestivum
  misc_feature (30)..(30): Xaa can be any naturally occurring amino acid
  unsure (1)..(137): unsure at all Xaa locations
MASPMVGTPIRLSSLRYAPPSPAPRGRFVXARVRASAEAMATATEKLGVRVERNPAESRLSELGVRQWPKWGCEKSKFPWTYSAKETCYLLQGKVKVYPDGEEGFVEIAAGDLVVFPKGMSCTWDVAEAVDKHYKFE

SEQ ID NO: 17417 - protein, 169 aa, Borrelia garinii PBi
MSMLLQKTLCIIKPDGVRRGLIGDVVARFERVGLKIVAAKMLIIDESLAKKHYLYDDIVLRHSEAVWKSLIKFISNSPVFAFVVEGVESIEVVRKLCGATEPKLAIPGTIRGDFSYHSFRYSNEKGFSIYNVIHASANEVDAIREIPIWFKDNEILNYKRDDECEHYYC

SEQ ID NO: 17418 - protein, 283 aa, Triticum aestivum
  misc_feature (39)..(39): Xaa can be any naturally occurring amino acid
  misc_feature (78)..(78): Xaa can be any naturally occurring amino acid
  misc_feature (94)..(94): Xaa can be any naturally occurring amino acid
  misc_feature (106)..(106): Xaa can be any naturally occurring amino acid
  misc_feature (127)..(127): Xaa can be any naturally occurring amino acid
  misc_feature (134)..(134): Xaa can be any naturally occurring amino acid
  misc_feature (174)..(174): Xaa can be any naturally occurring amino acid
  misc_feature (179)..(179): Xaa can be any naturally occurring amino acid
  misc_feature (193)..(193): Xaa can be any naturally occurring amino acid
  misc_feature (208)..(208): Xaa can be any naturally occurring amino acid
  misc_feature (247)..(247): Xaa can be any naturally occurring amino acid
  unsure (1)..(283): unsure at all Xaa locations
MGRKFFVGGNWKCNGTVEQVESIVNTLNAGQIASTDVVXEVVVSPPYVFLPTVKAKLRPEIQVAAQNCWVKKGGAFTXGEVSAEMLVNLGVPWXVILGHSERRSLXGENQSEFVGEKVAYALAQGLXKVIACVXGETLEQREAGSTMEVVAEQTKAITGKIKDWTNVVVAYEPXVWAIXGTGKVATPAQAQEXHCNLRELLKDHVKPXEVLHPHRSFIGGSGTGARLQGLGGATPTSMGYYIGGSSXLKPEIIEIIKAANGKVCLRKNFDLWPLWGVDQDTNH

SEQ ID NO: 17419 - protein, 383 aa, Salinibacter ruber DSM 13855
MKENLTRRPHLSRWRRATGPPWIRAEFSVPNLTLLQPMRAAVFHEPGDIRVEDVPDPSIEAPTDAILRITRTAICGSDLWFYRGHRDYEAGWRTGHEPMGVVEDVGSEVRSLEPGDRVLAPFAISDGTCEFCRQGLHTSCVHGNVWAAEHDGAQGEAVRAPQADGTLVKIPERAEGDASLLRALFPLTDVMGTGHHAAVSAGVEAGSTCVVVGDGAVGLCAVLAAQRLGAERIIAMGHHEERLEKARGFGATDIVSSRGEEAVEEVREMTRGGARHVMECVGAASAIETAISVCRPGGTIGYVGVPFGAEDGGLDMFRLFRENITLQGGIAPVRAYIPELMDDVLDGTLDPSPVFDTTIGLEEVPDGYAAMDERESIKVMVEL

SEQ ID NO: 17420 - protein, 163 aa, Arabidopsis thaliana
  misc_feature (106)..(106): Xaa can be any naturally occurring amino acid
  misc_feature (118)..(118): Xaa can be any naturally occurring amino acid
  misc_feature (124)..(124): Xaa can be any naturally occurring amino acid
  misc_feature (131)..(131): Xaa can be any naturally occurring amino acid
  misc_feature (134)..(134): Xaa can be any naturally occurring amino acid
  misc_feature (139)..(139): Xaa can be any naturally occurring amino acid
  misc_feature (144)..(144): Xaa can be any naturally occurring amino acid
  misc_feature (150)..(150): Xaa can be any naturally occurring amino acid
  misc_feature (154)..(154): Xaa can be any naturally occurring amino acid
  misc_feature (159)..(160): Xaa can be any naturally occurring amino acid
  misc_feature (162)..(162): Xaa can be any naturally occurring amino acid
  unsure (1)..(163): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFXYREHGNTSGYYXGRYLTXWKFHLFXLNXSAQVXLKEVXDSKKGXPGGXIRSTXXQXP

SEQ ID NO: 17421 - protein, 145 aa, Glycine max
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKAPKSPRR

SEQ ID NO: 17422 - protein, 254 aa, Oryza sativa
SIIAASDGAMVARGDLGAELPIEEVPLLQEEIVRTCRSMQIPVIVATNMLESMIDHPTPTRAEVSDIAIAVREGSDAIMLSGETAHGKFPLKAVKVMHTAAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 17423 - protein, 148 aa, Codonopsis lanceolata
MEQTFIMIKPDGVQRGLVGEIISRFEKKGFLLKGLKLLNVEQSFAEKHYADLSAKPFFGGLVEYIVSGPVVAMVWEGKGVVKTGRTIIGATNPAASAPGTIRGDFAIDIGRNVIHGSDAVESATKEIALWFPEGVANWQSSLHSWIYE

SEQ ID NO: 17424 - protein, 356 aa, Triticum aestivum
  misc_feature (204)..(204): Xaa can be any naturally occurring amino acid
  misc_feature (242)..(242): Xaa can be any naturally occurring amino acid
  misc_feature (283)..(283): Xaa can be any naturally occurring amino acid
  misc_feature (301)..(301): Xaa can be any naturally occurring amino acid
  misc_feature (320)..(320): Xaa can be any naturally occurring amino acid
  unsure (1)..(356): unsure at all Xaa locations
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAXASFNIIPSSTGAAKAVGKVLPELNGKLTGMSFRVPTVXDVSVVDLTVRTEKAASYDDIKKAIKAASEGKLKGIMGYVEXEDLVSTDFVGDSRSSIFXMPRAGIALNDHFVKLVSWXYDNEWGYSNRVVDLIRHMAKTQVRLISFGQRFPALV

SEQ ID NO: 17425 - protein, 378 aa, Burkholderia pseudomallei K96243
MTLASTPDIIAELKAGRMVILVDEEDRENEGDLVLAAEFVTPEAINFMARYGRGLICLTLTQERCKQLNLPLMTYRNGTQYGTAFTVSIEAAEGVTTGISAADRARTIATAVAHDVRPEHIVQPGHVFPIMAQPGGVLVRAGHTEAGCDLTALAGLTPAAVICEIIKDDGTMARLPDLLEFGKEHGLKIGTIADLIHYRSRTESIVERVAERTMQTAHGPFKTVLYRDHPTGSPHIALVRGTPTPNDETPVRVHEPLSVLDLLETGVSTHSWTLDAAMKEIAARELGVIVLLNCGDTKEHLVDVFLAFDEKEKAAELKRRPVDFKTFGIGAQILRDVGVGRMQVLSNPRKLGSMSGYGLEVTGFAPMPGSATSASGAA

SEQ ID NO: 17426 - protein, 329 aa, Oryza sativa
MREASGMSGGEDVRKVSRQDIQLVQNLIERCLQLYMNQKEVVETLSFQAKIEPSFTELVWQKLEEENREFFKAYYVRLMLKNQIMVFNKLLEDQYRLMCKEQPSGVPSMPPTTNGSNMGTLNQNACFLPDTTPSTAMPDSLLPNGSSSGIVNGTPSSDQFIYAGKVIHGLPSSMDASSSLLAAHNSTAGRFNGDNGTTIKTEASYSGNSDFGFCNESAFLEPCQSIGDASGGSFSSSELNGQPLGDPIMDMDSSSFGFLSQIPRNFSFSDLTEDFSQSAEILENYGRSPFIPSEPNNFSESTPGDHAEIGNRRLDTISEGVSYEDFGSD

SEQ ID NO: 17427 - protein, 820 aa, Arabidopsis thaliana
MGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNVGPTWAFFNNSQDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLTLKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 17428 - protein, 416 aa, Burkholderia pseudomallei K96243
MRARGARPLFAFLPRFDSTMNTAADSLLRLASRVDAIEPFYVMEIVKEAAVLERAGRDIIHMSIGEPDFTAPEPVVDAAAAALRRGVTQYTSALGIAPLREAIAAHYARAHGLSIAPERIVVTAGASAALLLACLALVGRDDEVLMPDPSYPCNRHFVATAEGRAVLVPSGPETRFQLTADDVKTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPDTLAIYEARRAEFRRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 17429 - protein, 396 aa, Bacillus cereus ATCC 10987
MKQFELSRAAESLQPSGIRKFFDLAANMKGVISLGVGEPDFVTPWNVRQACIRSLEQGYTSYTANAGLLELRQEIAKYLKKQFAVSYDPNDEIIVTVGASQALDVAMRAIINPDDEVLIIEPSFVSYAPLVTLAGGVPVPVATTLENEFKVQPEQIEAAITAKTKAILLCSPNNPTGAMLNKSELEEIAVIVEKYNLIVLSDEIYAELVYDEAYTSFASIKNMREHTILISGFSKGFAMTGWRLGMIAAPVHFSELMLKIHQYSMMCAPTMSQFAALEALRAGNDEVIRMRDSYKKRRNFMTTSFNDMGLTCHVPGGAFYVFPSIASTGLSSAEFAEQLLLEEKVAVVPGSVFGESGEGFIRCSYATSLEQLMEAMKRMERFIENKKRTKHNTFCP

SEQ ID NO: 17430 - protein, 228 aa, Zymomonas mobilis
MPTLVLSRHGQSEWNLENRFTGWWDVNLTEQGVQEATAGGKALAEKGFEFDIAFTSVLTRAIKTTNLILEAGKTLWVPTEKDWRLNERHYGGLTGLNKAETAAKHGEEQVHIWRRSYDVPPPPMEKGSKFDLSGDRRYDGVKIPETESLKDTVARVLPYWEERIAPELKAGKRVLIGAHGNSLRALVKHLSKLSDEEIVKFELPTGQPLVYELNDDLTPKDRYFLNER

SEQ ID NO: 17431 - protein, 445 aa, Triticum aestivum
MAMVTAKLSSPATARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWQGQPENIEAAQNALLVRAKAGQMLLGRTLFPVPCRLHSPCLTFLKARKFKPWYQGYQRVWFRGPGPTMNPGAKVLMVWPQGALSTTSRVHASQSGELLLASPVVLLH

SEQ ID NO: 17432 - protein, 433 aa, Legionella pneumophila subsp. pneumophila str. Philadelphia 1
MGFSMSRSSDLFHKAQTIIPGGVNSPVRAFKGVGGEPVFFKSGKGAYLTDVDDKQYIDYVGSWGPLILGHCHPKVIEAVDNVLHRGMSFGAPTELEIQLAEKIASLMPSIEKIRMVNSGTEATMTAIRLARGFTNKNKFIKFNGCYHGHSDSLLVKAGSGLLTLGIPSTPGIPQSITEHTLTADFNNLEQVAQLFEKYPNDIATVILEPIPGNMGFILPKIEFLKGLRELCDQYNALLIFDEVMTGFRVGLHGAQGLFGIKPDITTLGKIIGGGMPVGALGGKREIMSFLAPEGPVYQAGTLSGNPLAMAAGLATLKEIEKINFFEDLSNTTNKLTEALADAAENANIPFFAASLGGMFGFCFTDKNSVENYLDVASSDEVLFKKFFHAMLAQGVYFAPSMYEAGFVSSMHGDLEIQKTYDAAELVLNQLKSA

SEQ ID NO: 17433 - protein, 322 aa, Schizosaccharomyces pombe
MSIDPANDSKLAPEANDATLGDVDRWIEQLKKCEPLSEADVEMLCDKAREVLCQENNVQPVRNPVTVCGDIHGQFHDLMELFKIGGDVPDMNYLFMGDYVDRGYHSVETVSLLVAMKLRYPNRITILRGNHESRQITQVYGFYDECLRKYGSANVWKHFTNLFDYFPLTALIEDRIFCLHGGLSPSIDSLDHVRTLDRVQEVPHEGPMCDLLWSDPDDRCGWGISPRGAGYTFGQDISETFNHANGLSLTARAHQLVMEGFNWAHDGDVVTIFSAPNYCYRCGNQAAILEVDDTMNQVFLQFDPAPREGEPVIARRTPDYFL

SEQ ID NO: 17434 - protein, 349 aa, Bradyrhizobium sp. BTAi1
MAANSKRVFYVKYLAHPIFSERLAARPDVRLDRLDNDTPDPEAAPIMAAAHAYQIGAARDELAPRFHVDADLLRRAPNLLIVSSNGAGYDPVDVDACTRAGVLVVNQSGGNAHSVAEHTLGMMLTLSKRIIQSDRRLRRERDVNRNDLIGNEVQGRTIGIVGLGNVGRRVAELCRGLLGMTVLAYDPYLSPEEIAARGAEKVELADLMRRSDFVSINCPLTRDSRGMIGHREFALMQPHAYFITTARGFIHDEDALLAALRDQRIAGAGLDVWAKEPPPPEHPLLQFDNVLASPHTAGVTREARQNMGQIAAEQLLAALDGRRPPRLINPEAWPRYSDRFRATFGVTPS

SEQ ID NO: 17435 - protein, 475 aa, Rickettsia conorii str. Malish 7
MNLLKNITGKNYINGEFIEFGKQISVINPATLKEIATVPNLGLSEINSAINNTVTSFSLWSQSSFEARIAILRRWYNLVIENIEELSYILTLEQGKVLAESKKEILYGASFIDWYTYAIHNIHSTIKPGNSNTHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDIGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 17436 - protein, 445 aa, Halobacterium sp. NRC-1
MNRETSRELYDRSLDVLVGGVNSTVRAAPQPYPTFVQSGDGGHVIDADGNRYIDWVMGLGPLLLGHDLPQPVTAAIQRRASDGPLFGTPTEIEVEHAEFVARHVPSVELLRFVNSGTEATVSAVRLARGYTGRNKIVVMQGGYHGAQESTLVEGDADHRGPSSAGIPPAFAQHTIPVPFNDADAVTEVFETHGDDIAAVLVEPILANKGIVEPVAGYHETLRDLTHDHGALLIWDEVITGFRVGGLGCAQSEFDITPDVTTFGKIIGGGFPVGAIGGRTDVMEEFTPTGDVFQAGTFSGHPVTMAAGLETLQYAAENDVYEHVNRLGGRLREGLAAVVAEHAPAYTVVGRDSMFKVVFTRDGDAQSGACTDGCRQDPDCERHAACPKTGADVGDAAVQRWNRVFRPQLLDAGVLLSQNQFESQFVSYGHTEADVDETIEAYRSAL

SEQ ID NO: 17437 - protein, 92 aa, Glycine max
GLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 17438 - protein, 256 aa, Kluyveromyces lactis NRRL Y-1140
HTHNSHTIMARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 17439 - protein, 429 aa, Staphylococcus aureus subsp. aureus Mu50
MNFSESERLQQLSNEYILGGVNSPSRSYKAVGGGAPVVMKEGHGAYLYDVDGNKFIDYLQAYGPIIAGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIQQTLKAADYAFSQMK

SEQ ID NO: 17440 - protein, 512 aa, Oryza sativa (japonica cultivar-group)
MLPPASPPAVRQCLSFTSHRIAACRREAPLMKGESEEEETQALTAQSSHIHQEAHTAAAPPHPGLLTPPGGGATARTPAAAASAAAAYKAAAAAAAVGANSAGGVDLTPAAARRNKKRKLPEKQLPDRVAALLPESALYTQLLEFESRVDAALHRKKVDIQEALKSPPALQRTLRIYVFNTFANQAPRTIPPPKNAEPPTWSLKIIGRVLEDGAELDPASVVPKHNPVYPKFSSFFKRVTIALDPSLYPENPLIIWENARSAAPQEGFEVKRKGDKEFSANIRLEMNYNPEKFKLSQPLMEVLGVEVDTRSRVIAALWQYIKAKKLQNPTDPSFFMCDPQLKKVFGEDKLRFAMLSQKISQHLSPPPPINLEHKIKLSGNGAHASACYDVIVDVPFPLQKEMSAFLANTEKHKDIEACDEVISASIKKIHEHRRRRAFFLGFSQSPVEFINALIASQSKDLKLIAGEANRNIERERRADFYNQPWVEDAVIRYLNRKPASGNEGPGGGAGGS

SEQ ID NO: 17441 - protein, 296 aa, Arabidopsis thaliana
MFFCWVLGIVTASADCSILATDVETGAQVAHLENAHEDAVNTLINVTETTIASGDDKGCVKIWDTRQRSCSHEFNAHEDYISGMTFASDSMKLVVTSGDGTLSVCNLRTSKVQSQSEFSEDELLSVVIMKNGRKVICGTQNGTLLLYSWGFFKDCSDRFVDLAPNSVDALLKLDEDRLITGCDNGIISLVGILPNRIIQPIGSHDYPIEDLALSHDKKFLGSTAHDSMLKLWNLEEILEGSNVNSGNASGAAEDSDSDNDGMDLDNDPSKSSKGSKRKTKSKANTLNATNNFFADL

SEQ ID NO: 17442 - protein, 89 aa, Magnetospirillum magnetotacticum MS-1
LDLDLPGGRLCCRSTPRAEHWVVVRGCARVTVDDTVADYRESEHIFIPLGSIHRLENPGNDNVELIEVQLGSYLGEDDIVRLEDAYHRA

SEQ ID NO: 17443 - protein, 108 aa, Brassica napus
  misc_feature (12)..(12): Xaa can be any naturally occurring amino acid
  misc_feature (17)..(17): Xaa can be any naturally occurring amino acid
  misc_feature (24)..(24): Xaa can be any naturally occurring amino acid
  misc_feature (56)..(56): Xaa can be any naturally occurring amino acid
  misc_feature (81)..(81): Xaa can be any naturally occurring amino acid
  misc_feature (88)..(89): Xaa can be any naturally occurring amino acid
  misc_feature (94)..(94): Xaa can be any naturally occurring amino acid
  misc_feature (99)..(99): Xaa can be any naturally occurring amino acid
  unsure (1)..(108): unsure at all Xaa locations
QVEELHSKMQDXLFMEXAQLVDVXEPDEIAKASLPGFQVFPLRQFETWAPEITSKXNPDKDTFVMCKAGGRSLKVANWLQXQGFKSVXXVAGGXQAYSXKVDPSIPTY

SEQ ID NO: 17444 - protein, 269 aa, Oryza sativa
TKPASSSSSSSSPNSVCFARAEAVDATISPTVSALRPSKTMAITDQATALRQAGVPVIGLAAGEPDFDTPHVIAEAGMNAIKDGYTRYTPNAGTLELRKAICNKLQEENGISYSPDQVLVSNGAKQCITQAVLAVCSPGDEVLIPAPYWVSYPEMATLAGATPVILPTSISENFLLRPELLASKINEKSRLLILCSPSNPTGSVYPKELLEEIADIVKKYPRLLVLSDEIYEHIIYQPAKHTSFASLPGMWDRTLTVNGFSKAFAMTGW

SEQ ID NO: 17445 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIGVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNKDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 17446 - protein, 710 aa, Xanthomonas oryzae pv. oryzae KACC10331
MQIAVCALVLTGIGMLLGFAPPVAFVAASGFVLTSTAVVMQLLAERGDVALPPGQKIVAILLFEDLLIVPLLAIVAWMAASCDPQAASQRWQGIGIGLACIVGLLVAGRWLLNRLFRILAASKAREVMTAAALLVVLGAALLMQVAGLSMAMGALLAGVLLSESTFRHQIEADIEPFRGILLGLFFLGVGMSLDLRVVAADWRLIVAGVLALMVGKGACIYAVARLMRSDHRQALDRGMLMAQGGEFACVLFAAASASGVIDAQVTASLTAIVVLSMALTPLFVLLQRRLTPAAAVSLDGVEEASGQTGSDLIIGFGRFGQVASQSLLARDVAVTIIDNDIEKMQSAEELGFKIYYGDGPGWTCCMPPARTAHARCGLRRQPGGGQSHRRTGNARVSACQAAGAFLRSPAFAATGGCGRGLPDPRDLRVGGDLRQSRAGGTGDGRGPSRHDFAPYSSARCRAFRIGDRCRRCTRRSRADVRQHVASRAPAHTVHATASRQPHAQSRCGAVSRASRDSDTRVRAANETTAQAPGRCGRRRWAFTTHPPRLVRAVCTYLTTARYLVAPEKPSQTPNAMFAGHMMLERVEGRARTTCNQARKKAIQRSRHRRLSPAAQPSTCSASPWAPLRWQRFKRQSCFRCPITGSTACRRLIQRHCRRVSVLALPRCRICTPSTSRPRYPKSTIATFGITFTSCSSPRACSSCSANVSPS

SEQ ID NO: 17447 - protein, 275 aa, uncultured bacterium
MSAEQPRLILNSGQSMPQLGLGAYKVNQDITVQLVQHALEIGYRRIDTAAIYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLRELNERHGIRTEAWAPLGRARFMQHPLLIEIAESLGKSVAQVIIRWHLQIGNLVIPKSSNPDRLAENFDVFDFELSHHNMSIIATLNTETRIATNPDDMN

SEQ ID NO: 17448 - protein, 223 aa, Buchnera aphidicola str. APS (Acyrthosiphon pisum)
MNLNKLKKKAAWAALDYIDPGTIIGVGTGTTIFYFIEALGTIKNLIYGAVSSSNSSTVLLKKHGIEVFDLKNFSSLAIYVDSADEINNHMQMIKGGGGALTREKIIASMSKKFVCIIDKSKKVDVLGTFPLPIEIIPMALSYIFREMIKIGGTPKYRKNVITDNGNIIIDVYNLCIKDPISMEKKINSLPGVVTVGLFASRSADIVLIGTQKGIRTINKKENR

SEQ ID NO: 17449 - protein, 797 aa, Escherichia coli K12 [sequence omitted]

SEQ ID NO: 17450 - protein, 158 aa, Legionella pneumophila subsp. pneumophila str. Philadelphia 1
MNSCIIMHFKLISLECMMAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEQHELCNR

SEQ ID NO: 17451 - protein, 441 aa, Arabidopsis thaliana
MEIDSEKIHERKQSDYNSLQDERFEIQKEMYRGQQYSQIYFARLHLMRTLLYSLAPTWKSHLPVCKVLGLEKGKECIIVGTLFKHMKLKPCVLDEYSKERSVTPLVKPHNFMHPDDNLILEDESGRVKLAGSALSPAIYVTGVVVALHGKETNAGEFFVEDVLEAGLPPQIERPIDLQEDKYVVLLSGLCIGSKSANPLQFQLLVDHITGHLGDEEEQGLAAQIVHVVIAGNSFEFPRKLINGQNLASKDQSTLYEPIKELDIMLSQIAAGVSVDIMPGTNDPANFALPQQPLNRCLFPGSSPYNTFRSCTNPHSFDVDNIRFLGTSGQNIDDLGKYSEAKSKLDFVERTLRWRHLAPTAPNTLGCYPFTDRDPFLIETCPHVYFVGNQDKYDNRLIKGSEGQLVRLICIPKFCETGIAVAVNLRNLECHTLSFSTQINQS

SEQ ID NO: 17452 - protein, 395 aa, Thermoanaerobacter tengcongensis MB4
MNLSQNALQITPSMTLEITAKARQLKAEGVDVIDFGVGEPDFDTPDYIKEAAIEAIKKGYTKYTPASGILELKKAICEKLKRENGLFYEPEQIVVSNGAKHSIYNALSAILNPGDEVIIPVPYWLSYPEMVRLAYGKPVFVQTKEENNFKITAEELTAAINPKTKALILNSPNNPTGAVYTRKELQDIAEVVEETGIFVISDEVYEKLIYEGEHVSIASLGEKIKELTIVVNGMSKAYAMTGWRIGYTASSLDVAKVMANIQSHTTSNPNSIAQYASVTALTGDGVAIKRMVEEFNKRRLYAVERISKMKGLKAVRPQGAFYVFVNIEEYVGKKVNGRKIKGSLDFATLLIEEANVAVVPALPFGMDNYIRISYATSMENIEKGLDRIENFLNKI

SEQ ID NO: 17453 - protein, 386 aa, Dechloromonas aromatica RCB
MYRPARRLADIEPFHVVELLTRARQLEAEGRDIIHMEVGEPDFPTPEPIANSAINAIKSGKTLYTQALGLPELREAISQFYGQRYGASVPASRIAVTNGASGALNLAFACLADPGSEWLLTDPGYPCNRHILRAYEGCPQNIPVGPDTNFQPTPELLRRHWKSTTAGLLVASPANPTGTLLTLPEIAGLSEVCREKNGHFLVDEIYHGLTYEIDAPTACAAGEDIWVINSFSKYFQMTGWRLGWMVIPEAYVRDVEKLAQNLTLCPSTPAQHAALAAFEPETIAILESRRSEFRRRRDFLAPALEAIGFRITARPEGAFYLYCDCSALADDSFALAKDLLEKTGVAATPGLDFGSNQPEKHIRFAYTTGVERLAEAVERLSRYFGR

SEQ ID NO: 17454 - protein, 340 aa, Lactococcus lactis subsp. lactis Il1403
MKAAVVRHNPDGYADLVEKELRAIKPNEALLDMEYCGVCHTDLHVAAGDYGNKAGTVLGHEGIGIVKEIGTDVSSLQVGDRVSVAWFFEGCGHCEYCVSGNETFCREVKNAGYSVDGGMAEEAIVVADYAVKVPDGLDPIEASSITCAGVTTYKAIKVSGVKPGDWQVIFGAGGLGNLAIQYAKNVFGAKVIAVDINQDKLNLAKKIGADVIINSGDVNPVDEIKKITGGLGAQSAIVCAVARIAFEQAVASLKPMGKMVAVALPNTEMTLSVPTVVFDGVEVAGSLVGTRLDLAEAFQFGAEGKVKPIVATRKLEEINDIIDEMKAGKIEGRMVIDFTK

SEQ ID NO: 17455 - protein, 475 aa, Mannheimia succiniciproducens MBEL55E
MANPNAIQRVAKLIEDNDVKFVLLRFTDIKGKEHGVSLPVNLVADELEDFFEEGKMFDGSSVEGWKAINKADMLLMPMPETAVIDPFAQITTLSIRCSVYEPNTMQSYDRDPRSIATRAENYLKSTGIADQALFGPEPEFFLFDDVRFSTEMNNVSYKIDDIEAAWNTNRKFEDGNNAYRPLKKGGYCAVAPIDNAHDIRSEMCLILEEMGLVIEAHHHEVATAGQNEIASKFNTLTLKADETQIYKYVVQNVALEYGKTACFMAKPFAGDNGSGMHCNMSLSKDGKNVFQGDKYAGLSETALYYIGGIIKHAKALNAFTNPTTNSYKRLVPGFEAPVLLAYSASNRSASIRIPAVTSPKAIRVEARFPDPLANPYLAFAALLMAGIDGIINKIHPGDAMDKNLYDLPPEELKEIPAVCSSLEEALDSLQADHEFLIQGGVFSKEFIDAFVAIKRKEVERVNMTPHPVEFEMYYA

SEQ ID NO: 17456 - protein, 601 aa, Salmonella typhimurium LT2
MEGADLLTAGVLFLFAAVAAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAVVGGIGLAMSSTAMALQLMREKGMNRSESGQLGFSVLLFQDLAVIPALALVPLLAGSADEHFDWFKVAMKVLAFAVMLIGGRYLLRPVFRFIAASGVREVFTAATLLLVLSAALFMDALGLSMALGTFIAGVLLAESEYRHELENAIDPFKGLLLGLFFISVGMSLNLGVLYTHLLWVAASVVILVVIKMLTLYLLARLYGIRSSERMQFASVLSQGGEFAFVLFSTASSQRLFQGDQMALLLVTVTLSMMTTPLLMKGIDKWLSRRLNGPEENDEKPWVEDDKPQVIVVGFGRFGQVIARLLMANKMRITVLERDIGAVNLMRKYGYKVYYGDATQVELLRSAGAEAAESIVITCNEPEDTMKLVALCQQHFPHLHILARARGRVEAHELLQAGVTQFSRETFSSALELGRKTLVSLGMHPHQAQRAQLHFRRLDMRMLRELIPEHSDMVQISRAREARRELEEIFQREMQQERRQLDGWDEFE

SEQ ID NO: 17457 - protein, 501 aa, Glycine max
MGSAAKYELPFKLNNPDLLHNESFVHGKWVKSKSGKTFEVADPGTGKTWIDCPTNDASDVDEAVKSSHECFLEYKKISPRQRAQMLYKWDALIKENREDIATILVYETGKPRAEAYGEIDYSTGFTWWFAGEAERIQGSVFTPALPNRRIFTIKQPLGVAAALVPWNFPIAMILRKAGAALAAGCTMIVKPSPETPITVLALAYLADKAGFPKGALNVLTTDLDKTPELSEALCRHPLVNKVTFTGSTRVGKLVAKICSDNLKKVTLELGGNCPVLIFDDANIEQAMSQVFALKFRHAGQACITANRIYVQSGIFDKFLERWNAEAQKIVVGHGSDEKTTMGPVTTPRAVDKALSLVEDARKKGAKIHTGGNKVEKNGGYFFEPTVITGVTPDMDIAKEEVFSPISTFIKFETEDEVVKAANDTSMGLASYLFTKNVDRMWRLFENLEAGMIGLNTGNSSAAESPFGGIKQSGYGKESGKDVAVNEYMITKTGTFTLEDQS

SEQ ID NO: 17458 - protein, 207 aa, Triticum aestivum
  misc_feature (165)..(165): Xaa can be any naturally occurring amino acid
  unsure (1)..(207): unsure at all Xaa locations
MVAQAFTVDLDKPLVFQVGHLEEQYQDWVHQPIVSKEGPRFFANDVLEFLTRTKWWAVPLIWLPVVCWCLNTSIQMGHTVPEVALMVVAGIFIWTLVEYVLHRYLFHIDTKSYWTNTAHYLLHGCHHKHPMDGLRLVVPPTAAALLGYPVWKFGKLFTTTTTTPXAVFGGGLLGYVIYDCTHYYLHHAQPSSDPAKYLKKYHLNHHF

SEQ ID NO: 17459 - protein, 264 aa, Synechococcus elongatus PCC 6301
MISSLGIIGGGVMGEALLARLLAQGQVAATAVTVSEPFAARCEFLNDRYGVRCVDDNAEAAQADWVLLAIKPQVFDPAVAGLANLRSDRLILSILAGVPLAKLEAAFPHEAVIRAMPNTPATVGAGVTAIAAGQQVTADQLSQAQEFFAAVGRVVTVPESQLDAVTGLSGSGPGYVALIVEALSDGGVAAGLPRAIATELAIQTVRGTAELLQETGWHPGELKDRVCSPGGTTIAGVATLEQNGLRSALIEAVKAAALRSQQLG

SEQ ID NO: 17460 - protein, 107 aa, Burkholderia pseudomallei K96243
MQILSASALAEWLRDPARPAPIVLDVREPWEIATAKIDGSVSIPMQQIPARSEELDDEAAIVCVCHHGMRSAQVAMFLESRGFTKLYNLQGGIDAWSRDVDPAVPRY

SEQ ID NO: 17461 - protein, 225 aa, Oceanobacter sp. RED65
MNQDQLKQAVGQAAVDYIKPHLQKDSIIGVGTGSTANCFIDALAELKNDFDGAVASSEATAERLKSHGIPVYDLNSSGTLDFYIDGADETNDHLQLIKGGGGALTREKIVAACAKEFICIADESKWVDLLGTFPLPVEVIPMARSYVARELVALGGDPVYRQGFVTDNGNVILDVHNMSIQSATALEERINNIVGVVTNGLFACRPADVLLMGTADGVKTIKAKN

SEQ ID NO: 17462 - protein, 393 aa, Prochlorococcus marinus subsp. pastoris str. CCMP1986
MSEVNLSKRALSIEPSLTLQISAKANQLAKEGKDICNLSAGEPDFDAPNEILKATSEAIFDGYTKYGPASGDLELRKAIAEKLQTQNNLNVEYENVMVTNGAKQSIYNLFQVLLNDGDEVIIPAPYWLSYPQMVRLAGGKPVFLNSSAEDGFKINIQDLKSKISPKTKFIIINSPNNPTGRVMPKEELLQIAELVRENKNINILSDEIYELILKKEFKHLSLASLATDLKERIFIINGFAKGWAMTGWRVGYLVGQKDVIKASSALQSQSTSNVCSFVQRGALEALKINREFFLEINSHYDLRREVLYKGLKNIEGLFISPPNGAFYAFPRLPNNSMTSVEFCKRILNDYGLVVVPGKPFGDDQCIRISCASSKEKILDGLTRLEKGILNYYF

SEQ ID NO: 17463 - protein, 1053 aa, Ustilago maydis 521
MSYHVIHYRRFTIGFADLTHRRSTHDVRQFALELATVTGKGGFDMHIQLAVPERSIILKTASASASPSTSASPSACASSFSSPSPHLTLSSRLDRAPKMSSSSPSSASASSRRPLVGVSFKMYFDIPKTKAYVDETISLLSSTLPSLGQPIDVFVIPDFITLTSVAAQICSSSSTLLLGAQDVHSHDFGAFTGEVSPNVLSQVGVKLVEIGHAERRRYFGETDQDVANKAAAIAKNGMVPLICIGEVSRPKNLDQLSIQDVDLVVNECWRQIQPALDAIESHVDVVLAYEPVWAIGQPQPASPDYVVKITKALRKRYNKEYVDSHKARSDASLRILYGGSAGPGSLINPRLLSIPSRKSPVQTSRLQNTPLVQVRALVPILMLLPQHLERSLSLLGHVFLLAHHHLCTRRLGITIEAIASLTIQTSTSSIGDLERIVKLVLRERKDDTDHREKSSYELLYCTPTELNASVRGGGGANSLSSKGSVWWARCVSIRGQRSRYRQRIPRYSTPSCSGCIIHPTAVNIRSQSKTCHLLATTPPSDKGIEVRLPVITTNMQPSSRNRSTCVETRSKCVSNQAAVAASYASCFPSRRRGWQNEARGSSALSIMFSQIQAPIATLPFGSELHRYPIGLAPSTKPRSGLCPQLGCNNFISIRFARCRFVIRDILRFILDSRKSRRLTAFHPGNLILTTSSKLGGAQEKEKQEQRAPTMMTSRFLVSGNPATDPKAAAQWLAEQRRRPIRAPHKTVQYGELVITRGGLSSVSKEDLWSILEQVAIAAIEVARFDLAELCISRLSSRFANSQRVTSLQGMLLEGQAKSRDAIRLYESVLETEQTSLILSRRRIGAIKSTGDIKQTLHALNSHLDIFYNDPEAWQELAEVYATQSMYAQSAFALEELLLQVPQNGFFQLKYAETLYTAAELTKSYKAYLRVLEMCQSDAATTQPVAPNTTAAHGAWLRALWGTKMVSTQLHYFRTLQTETDPNPDDLICIDLAKVTTALIATPPRASSTDDAIDQAKVLKIDELVTKLLLTNVYTPQAVACKHLRDVARAVLAA

SEQ ID NO: 17464 - protein, 142 aa, Zea mays
  misc_feature (61)..(61): Xaa can be any naturally occurring amino acid
  misc_feature (114)..(114): Xaa can be any naturally occurring amino acid
  unsure (1)..(142): unsure at all Xaa locations
MPISTMGVSLLVTNEKMHVTRERVFWDDHVVQGDKYYDPDIQIICDDCNIFMRNAPIDGDXDAPYDGGAHQLDCNIPEHDALLPHHVLFVTHILHPTVHLQTRELCLDILKNAXSPAWTLQSDCIARTAMMGHPEAHTPLNW

SEQ ID NO: 17465 - protein, 91 aa, Triticum aestivum
  misc_feature (65)..(65): Xaa can be any naturally occurring amino acid
  unsure (1)..(91): unsure at all Xaa locations
MAGAAKASWMVAMSVGVVEALKDQVGLCRWNYALKSIHRAAKARAHVRGSVSQGARQLPASAAGXWPEKQRAEKAEEGLRTVMYLSCWGPN

SEQ ID NO: 17466 - protein, 478 aa, Arthrobacter sp. BP2
MVPAAGLDYYVIHHRGEPPMGVYTTIDPATGDATAQYPEISDAELDTLIKNSAAAYRSWRTTTLEQRRAVLTRTAEIHREQAEELAKLLTLEMGKPIAQARGEVELVASIYQHYADNLEEYLADESLTFRGSGTAVVRTEPIGPLVGVMPWNYPYYQVARFAAPNIALGNTIILKHARNCPQSALAIERVLTEAGLPAGVYANAFISSAQVAAAVADRRVQGVSLTGSEKAGAAVGEVAGRNLKKCVLELGGSDPFIVLDDADIDAAAAAAVIGRLSNGGQACTASKRFIVADSVYEEFLQKFLDAMASWQTGDPTDSGTKLGPLASAAGVEELDELVQDAVSHGAKLLLGGERPDGPGAYYPATVLAGVTPAMRAFTEELFGPVAVVYRVGSLQEAIDLANNSPFGLSSSVFTSDARNAERLAEELEVGMVWINSTSKSSPDLPFGGVKGSGFGRELAGYGFNEFANKKLVRNPGAR

SEQ ID NO: 17467 - protein, 557 aa, Zea mays
  misc_feature (132)..(132): Xaa can be any naturally occurring amino acid
  unsure (1)..(557): unsure at all Xaa locations
RVQQDTLRKILELNGDAEYLNRFNLGRRTDSKSFKSCIPLCVHSDIESYIQRIADGDDSPVLTGEAHHFPLLKGKPKFLPFNDELLESTFQIFRTSYAFRNREYPIVNGQALQFVYGSKQVFTQGGILAATXTTNLYMSQRFKEAMKDVMTQCCSPDEVIFGPDFHQSLYCHLLCGLIYSDEIQFVFSPFAHSLVHAFHSLEEVWEDLCADIRDGVLSKRVTAPSIRQAVSKILRPNPELASSIYIKCQSLSNWYGVIPTLWPNVKYIYGIMTGSMEPYLKKLRHYAGHLPLLSADYGASEGWVGSNVNPTLPPEEVTYAVLPNIAYFEFIPLEKPKWEETEICSSVHYIESEPVGLTEVEVGKIYEVVITNFAGLYRYRLGDIVKIAGFRNATPELQFICRRSLVLSVNIDKNTEKDLQLAVEAAEKLLAAEKLEVVDFTSLVDRSSEPGHYVVFWELSSDDGASEDVLSGCASCMDLAFADAGYVGSRKTQTIGALELRVLRKGAFAQVMNHYLSLGGAVSQFKTPRFVSQSNSKVLQILSRNVTRSYFSTAYGL

SEQ ID NO: 17468 - protein, 738 aa, Arabidopsis thaliana
  misc_feature (219)..(219): Xaa can be any naturally occurring amino acid
  misc_feature (418)..(418): Xaa can be any naturally occurring amino acid
  unsure (1)..(738): unsure at all Xaa locations
MKVQRLFLVAIFCLSYMQLVKGQTLPRCPEKCGNVTLEYPFGFSPGCWRAEDPSFNLSCVNENLFYKGLEVVEISHSSQLRVLYPASYICYNSKGKFAKGTYYWSNLGNLTLSGNNTITALGCNSYAFVSSNGTRRNSVGCISACDALSHEANGECNGEGCCQNPVPAGNNWLIVRSYRFDNDTSVQPISEGQCIYAFLVENGKFKYNASDKYSYLQNXNVGFPVVLDWSIRGETCGQVGEKKCGVNGICSNSASGIGYTCKCKGGFQGNPYLQNGCQDINECTTANPIHKHNCSGDSTCENKLGHFRCNCRSRYELNTTTNTCKPKGNPEYVEWTTIVLGTTIGFLVILLAISCIEHKMKNTKDTELRQQFFEQNGGGMLMQRLSGAGPSNVDVKIFTEEGMKEATDGYDENRILGXGGQGTVYKGILPDNSIVAIKKARLGDNSQVEQFINEVLVLSQINHRNVVKLLGCCLETEVPLLVYEFISSGTLFDHLHGSMFDSSLTWEHRLRMAVEIAGTLAYLHSSASIPIIHRDIKTANILLDENLTAKVADFGASRLIPMDKEDLATMVQGTLGYLDPEYYNTGLLNEKSDVYSFGVVLMELLSGQKALCFERPQTSKHIVSYFASATKENRLHEIIDGQVMNENNQREIQKAARIAVECTRLTGEERPGMKEVAAELEALRVTKTKHKWSDEYPEQEDTEHLVGVQKLSAQGETSSSIGYDSIRNVAILDIEAGR

SEQ ID NO: 17469 - protein, 975 aa, Xanthomonas campestris pv. campestris str. ATCC 33913
MSQTPSSLRDLEHHSAFVERHIGPNDAEIAQMLGVVGHDSLDAMTDAIVPSNIKSPAALALPDAITEEEALARIRAIASKNQVQRTFIGQGYYGTHTPKVILRNILENPAWYTAYTPYQAEISQGRMEALINFQTMCADLTGMQIANASLLDEATAAAEAMTLAKRSAKSKSDTFFVHDAVHPQTQELLRTRAEPLGIVLRVGTPDEAMQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPEGLTRIARRTHRLAAILAAALRSAGVTVGEHFFDTLHVKAIDADAIHAKAHAAGINLRAIDSEAVGISLDETSTRADVVALAQLFGAQADIDALDAATADALPQGMRRTSAFLQHPVFNTHHSEHELLRYMRSLADKDLAMDRTMIPLGSCTMKLNATAEMIPVTWPEFGAIHPLAPPEQSAGYAQLIEELEAMLVECTGYDAVSLQPNSGAQGEYAGLLAIRAYHRSRNEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPFLPKTLPNAGIRAGENQKAAIHGSGSNFGEGEVGMVSAASYGSASILPISWMYVTMMGSAGLRKATQVALLNANYIAKRLSAHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVGRVDNVYGDKNVMCACIPVDAYKDDVVA

SEQ ID NO: 17470 - protein, 143 aa, Petunia axillaris subsp. axillaris
NFTIHGLWPDNVKTMMNNCDPSTKFNKIAVAEQKNELEKRWPELTSLAHIALTSQSFWKYEYEKHGTCCFPAYSQSAYFDFAIKLKDKTDLLTILRSQGVTPGSTYTGERINSSIASVTRVKPNLKCLYYQGKLELKEIGICF

SEQ ID NO: 17471 - protein, 422 aa, Legionella pneumophila subsp. pneumophila str. Philadelphia 1
MKVAKMIELKNYTLNFGPQHPAAHGVLRLVLELEGETIVRADPHIGLLHRATEKLAETKPYIQSIGYMDRLDYVSMMCNEHAYVMAIEKLLGIEPPLRAKYIRTMFDEVTRILNHLLWLGATALDIGAMTVFLYCFREREDLFDCYEAVSGARMHATYYRPGGVARDLPDTMPQYKPSRWHSEREIEKKNHNRQGSLLDFLWDFTERFPHCVDEYETLLTDNRIWKQRTVDIGVVSPENALQWGFTGPMLRGSGIAWDLRKKQSYAAYDRVEFDIPVGKTGDCYDRYLVRVEELRQSNRIIRQCIEWLRKHPGPVKVDDYKVSPPRRVVMKHDMEALIHHFKLFTEGFCLPRGEVYSSVEAPKGEFGIYMVSDGANKPYRLKIRAPGFAHLSSFDDMVRGHMLADGVAILASQDIVFGEIDR

SEQ ID NO: 17472 - protein, 159 aa, Triticum aestivum
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGQAPKSPKKAAKSPKKAATPKKA

SEQ ID NO: 17473 - protein, 449 aa, Flavobacteria bacterium BBFL7
MREIAQVPALTFLAKSRQIYKDPLPFHRENFEKYGNTFKISPKPGLMIHFTCDEKITQHILQKNQKNYHKSSLQTEDLGKYIGHGLLTENGEKWRANRKLIQPAFYKKSINNFMATMDVVVKEELDRIQLDEITDVYAIFNDLAFKVVARSLFDFADIENLEQKISRLQEITEQAQNMLIKELRIPWMKWYFDREWLSGTNSVPYALKMVDEARDILYAIISNRRRSKNEPGDLLDMLLHSTYEDGSYMDDDQLVDEILVLFIAGHETTANALSFAVQLLAHHPETIEKAREDVSKANLDETLMNQLMAMPYLKQCVEETLRLYPPAYVTDREALEADECDDIFIEKGSIWLVSFYEMHRRKDLWENPESFDPSRFEPSKAKSYREFYFPFGAGPRMCVGNNFAMMEMMLVIRRMVERFEITTVQDHIDYHPLITLKPKNANLVFKPRV

SEQ ID NO: 17474 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIDSGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 17475 - protein, 343 aa, Vibrio cholerae O1 biovar eltor str. N16961
MKIKALSKLKPEQGIWMNEVDMPELGHNDLLIKIKKTAICGTDVHIYNWDEWSQKTIPVPMVVGHEYVGEVVGIGQEVRGFQIGDRVSGEGHITCGHCRNCRGGRTHLCRNTIGVGVNRTGCFSEYLVIPAFNAFKIPDGISDDLASIFDPFGNAVHTALSFDLVGEDVLITGAGPIGIMAAAVAKHVGARHVVITDVNEYRLDLARKMGVTRAVNVAEQNLEDVMKELGMTEGFDVGLEMSGVPSAFSAMLKTMNHGGRIALLGIPPSSMAIDWNQVIFKGLVIKGIYGREMFETWYKMASLIQSGLDISPIITHHFKVDDFQKGFDIMRSGASGKVILDWQ

SEQ ID NO: 17476 - protein, 2340 aa, uncultured bacterium
MKWGFFMHLIRKKHPIFKVIVSLIILCFSFSTVMPAGLSYAQIAPVLNLPVPGAMVNPSIAFVPPLLKGMTIYPDEPLRFDFIIDSGNSKFDEEEVKTESEKLVKYFLAALTVPKNDLWVNLSPQEKDRIIPDYLGKTTLGRDMLAQDYLLKQLSASLIHPETELGAKFWDRIKELTFIRYGTTDLPMNTFNKVWVLPEKANVYEYNNTVYITHSRLKVMTDSDYLATKEDTRHKTQDTSIEQRATSHEQQNLESEILREIIIPEIEREVNEGKNFAPLRQMYHSLILAKWYKETIKDSLLSQIYVDQNKTAGVEVDDVTIKEQIYEQYIEAYQKGVFNYIREDYDRLAQDIIPRKYFSGGVVGDVEIDRDTALFSDRSVGQRFMVQMEASPQRSSIDGAMMTKEDARVRLREFLPPATDIPQESVEYTRIYNGDLQKALEALETKLANLSVDDFSDSAFRDGGFIEASVYYEGAQDELREAISVLRMALDSERRAKEAQAMEAALKEGEADTMIKERLDPKHHHLIGRRHKLKAIDLKGKFIVVYHEEAVTGEFSGELIVEGERIEIVSIEEFKNSFFEKVGDGYAAFALIKPDALRLGMAEEIISALEERGFMVIRGETIRFNEEQAREHYVVHKGKPFFEDLVAYMASSESIPLFLLTQEVGAVEKLRSALPEIREEFGAGPTENRIHASDSVRNTLVEAALAFKISDQAMAGLSMSEMAWVAAVDPKLAEPGALDRLFRDEERLEGLRKDLRELPPADKGSRDRAKVDLAIVKAQLETVRVKIRAFSDGAMLGDFTNLVVLDAAPRATAAEFTAPKRLEEIDEAMLGGPETLEDARAVLDGFSFNYENNKKAERIIIEEGDKSDIDRLLKMLRLSDEDIVQEIEDKLVSLGATKEQIVDAFIFRLDYQNHSTSTERNNKTIEKLVELGHARAIHILVRLLGTSSHEEASAALERLGATEKQLVDELVEYSRLSPGSSLEILEMIEGDYALAFKKVANKLRASIPKGKHYDADFKFMGHLNDVWELYKKGYDFDVRYVPEHDPVWITDLKQTGNIMRHGARITLSNGEVYEHPDVFWSDFQINPKNQIESIPNWLWEQIRFDMNVGQCVKGSFDSIEIIHGEPLEKSDGAILSGLVVFDPDPRATAAEFTAPERLEEIDEAMLGGTFKTARALALAAGLCIGAGCSDSSTGPPVDVTAPEISERITSSITENSFTLGVTTNEESTVVVEYGEDTSYGNRVEGNVLSVTHTISISGLKSGTTYHYRIIVKDASNNERASIDYTITTIDITAPEISEMAIRDITGNSFILEITTNEESTVVVEYGEEASYGNRVEGNVLGTSHTISISGLEPITTYHYRITVIDKSGNERSSADRRVTTAADLTSWSIEELIQGLDSELWNIRKAAAQELFKRDHVEGIALAQEKLVWPLFSPWNLIPGKTGILIELGRISIDPIKQFIFDSGTSNILVIGPLMDVLRNLYTFDEYFEFLVHLHQTMGQHRVTNYLLGEKLTALMSSGSTPMEKLVEIGSTHSIDRFRVAAISAIGRRGDVSYIDFLVGLANDQSNTTNVRNSAWGAANAIFLREDISDLAPDSVILMLYSGNFDVQKKATQELFQRGHQAGMAKARELVIVPRIDQLPSATARDQLIAIGEIVIELVRQNIFNSTTAPESISASIEVLEAFYTFDETIDLFVSLYQSIGNHSFTEEMIVDEAGKLINMQAAPLTSAVDLTSHKSDIIRVAAVTYLGDQGDPSHIDLLVGIENNDSSAKVRIAAQEAFYKIMVKEDPSSLSSDALITLLDIGMFDVQVEAAKELFNRGHTEGIDLAREKLVWPRILSLRSSTGPGGTLFIQIEQLGLITVEPLIDNLLNNPRGANTDSRKWSARLLGRIGLFDDVVDVLTYVIDHEYNLYSWWHVTEAKRGLSDLMSRQTLDRLIEVLDYDNGRHYEVRLRSAIELGKRGGLPAVNALIKALKDPHSSVRIHTIRALKAIGDPSAIPALEYVRDNDPDEQVRAEAAAAINAILNSSSSTSQSPDAAMVGEENFVVLDANPAATAAEFTAPERLEAIDEAILGAGEIVLIAAGATAITVGITLWKSWYAANIIAEAKRKTVEAAKGRPFYYLVTKLVLREGYSKTDVGGVYADPFTGLMGGAPQYEYRDRFGHRVSPEEALVSVKEIVTWGTENRSNDEYEKAIFEIVELLLRSEIGFGYYDYNSFIAKAQKALEEMIGTNSELQFRVGKECLKSLWKPIQEWAQEMIDRSGHDSAMITTPGGIDMNEIDVDRTGEGVQIRFDQESLQPLLNMPIDGFAPVIINIIPLQSILPLLGLEPTKEPDLVARLD

SEQ ID NO: 17477 - protein, 423 aa, Zea mays
MGKHEFLTPKAIANRIKAKGLQKLRWYCQMCQKQCRDENGFKCHCMSESHQRQMQVFGMAPDRVVEGFSEEFLESFLSLIRRAHRHSRVAATVVYNEYIADRHHVHMNSTRWATLTEFVKLLGREGYCKVEDTPKGWFMTYIDRDSEQAVKDRLKRKRIKSDMAEDERQERMIARQIERAHKSLAKPNDGGAAEGEPESGGEEEYSGSDDDGEELEDVSKEANKATGKIAIALQTAVRGPKVNPFEDKPEVKFRFDEEGDLGTGEEKDELAKKKGKDVKAAEARRSALEELMKEEEMAKERSNRKDYWLCPGIVVKVMSKSLAEKGYYKQKGVVRKVMDKYVGEIEMLESKHVLRVDQDELETVIPQIGGLLRILNGAYRGSNARLLSVDTEKFCAKVQVEKGLYDGKVLRAVEYEDICKISS

SEQ ID NO: 17478 - protein, 466 aa, Triticum aestivum
IARRHSPAGSVRGSGSGPAGRRRGAAMEDAAEGKTNVLQGRYELGRVLGHGNFGRVHAARDLRTGRGVAVKVVAKDKVERAGMVEQIKREIAVMKMVSHPNIVELHEVLATRTKIYLALELVRGGELFARISRAGRLREDVARRYFRQLISAVDFCHGRGVYHRDLKPENLLLDEAGNLKVADFGLSALAGHARPDGLLHTACGTPAYVAPEVLGGNGYDGAKADIWSCGVILYVLLVGALPFQDENLMSMYRKMQRGGFLCPSWVSKDARKLIGRLLDPNPSSRITIASLVESPWFKKTSPIPSPLLEPVPPAAARGNGEDKDEPPEALNAFHLISLSAGFDLSPLFDQEPATGRGTRGGVMRFATREPASGVISRLEGLATGGAMRVTKSGARGGRLEGAERGRKGRLGVAAEFFSVAPSVLVVDVKKDGGDTMEYRSFCSDELRPALKDIVWAAAAAAAAFPR

SEQ ID NO: 17479 - protein, 372 aa, Idiomarina loihiensis L2TR
METIKSRAMVAWGPGEPLKEEIIDVAPPKKGEVRVRIIATGVCHTDAYTLSGKDPEGIFPSVLGHEGGGIVESVGEGVTSVEVGDHVIPLYTAECGECKFCTSGKTNLCQAVRATQGKGLMPDGTSRFSKDGETIYHYMGTSTFSEYTVLPEISLAKIPKDAPLEKVCLLGCGVTTGMGAVKNTAKVQEGDTVAVFGLGGIGLAVIIGAVQAKASRIIAIDVNDDKQTIAKELGATDFVNPTKYDKPIQEVIVDMTDGGVDFSFECIGNVDVMRAALECCHKGWGESVIIGVAGAGEEISTRPFQLVTGRVWRGSAFGGVKGRTELPDYVKQYMDGKFDLDTFITHTMPLEEINEAFDLMHEGKSIRSVIHY

SEQ ID NO: 17480 - protein, 257 aa, Bacteroides thetaiotaomicron VPI-5482
MKIAIIGAGNMGGSIARGLAKGSLIADSDIIVSNPSAGKLEKLKEEFPGISTTLSNTEAATGADVVILAVKPWFVESVMRELKLKSKQTLVSVAAGISFEELAHFVIAPEMPMFRLIPNTAISELESMTLIAARNTNDEQNLFMLRLFNEMGMAMLIPEDKIAATTALTSCGIAYVLKYIQAAMQAGIEMGIRPKDAMEMVAQSVKGAAALILNNDTHPSVEIDKVTTPGGITIKGINELEHNGFTSAVIKAMKASK

SEQ ID NO: 17481 - protein, 953 aa, Synechococcus elongatus PCC 6301
MSASPHNFAQRHLGPRPADVEQMLQKLGCESLEDLLAAVVPADIRLPRSLNLPEPCSEAEALAELRAIAHQNQILRSYLGQGYANCLTPPVIQRNILENPGWYTAYTPYQAEIAQGRLEALLNFQTMVSDLTGLEIANASLLDEATAAAEAMTLSLAVAKSKSQTYFVAHNCHPQTIAVVQTRAAALGIEVLVADLLQFDFQTPIFGLLLQYPATDGTIADYRSVIEQAHAQGAIATVACDLLALTLLTPPGEFGADIAVGNSQRFGVPLGYGGPHAAFFATKEAYKRQIPGRIVGVSKDAQGQPALRLALQTREQHIRRDKATSNICTAQVLLAVVAGFYAVYHGAEGLTAIARQVRRQTQILAEELQSLGFKIPQQPGFDTLIVEVEDPKVWQSRTEAAGFNLRCLSDRQLGISLDETTTDSDLLDLLTVFAQGRSLPAWEDLQAAVTDEVDPAFARQTPFLTHPVFQQYHSETELLRYIHRLQSRDLSLTTAMIPLGSCTMKLNATAEMLPISWPEFNQIHPFAPLSQTQGYQQLFQQLESWLAEITGFAAVSLQPNAGSQGEYAGLLVIQRYHQSRGEDHRQICLIPQSAHGTNPASAVMAGMKVVPIACDDRGNIDVSDLQQKAAQYADQLAALMVTYPSTHGVFEEAIAEICAIVHQQGGQVYLDGANLNAQVGLCQPAQFGADVCHLNLHKTFCIPHGGGGPGVGPIGVAAHLAPFLPSHPLVPEANADPQALGPIAAAPWGSASILPISWMYIRMMGAAGLTQASAIAILNANYIATRLAPYYPILYRGDRGFVAHECILDLRPLKRTAGIEVEDVAKRLMDYGFHAPTMSWPVLGTLMVEPTESESLAELDRFCEAMIGIYHEVDAIASGDLDPLDNPLKHAPHPADVLLQSDWNRAYSREQAAYPAPWTREHKFWPVVSRIDNAYGDRNLVCSCLPMSAYSDR

SEQ ID NO: 17482 - protein, 575 aa, Rickettsia prowazekii
MNDHILINVIILLGTAVFIVAILKRFRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIDENRSQSTQIGRISLAILLLQDLAVVPLLVIVPLLASNNKASLAVALGIAFLKAVTALLTIFIVGRVLLRPVFSFISSESNNTSELPISMTLLIVLSAAWATETFGLSLALGAFVAGVLVAETEFRLQAEESIYPFKSLFLGLFFMTVGMNIDALEMYEKISHILTLSIALICIKTLIITAFCILFGFNKGVAFYSGLLLSQGGEFGFILFSLGKDSGVLEESTADILLLVVTFTMALTPLLAALGKKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISSNYQDIPVVVKLKNLKNAREFYDLGATTIIPESYETGLQIGGTVLKNIGISEQEINRIKVQFRLGNYIIAKKEDALSEVEDND

SEQ ID NO: 17483 - protein, 442 aa, Glycine max
  misc_feature (403)..(403): Xaa can be any naturally occurring amino acid
  unsure (1)..(442): unsure at all Xaa locations
MANALHNAAISRVMFGDQYSISRCVVPSLSTLPLRAMHKGKHVELNRTVMVVKAKTNSDFDDSDVDISLSHRVNAVKLSKTLSICDHATALLQAGVPVIRLFFGESDFDTPGAIAEAGMNAIREGYTRYTPNAGTLELRQAICHKLKEENGITYSPDQIVVSNGAKQSIVQAVLAVCSPGDEVIIPAPFYVSYPEMARLAHATPVILPSHISRSVYSKKLLEEIAQIVAKHPRLLVLSDENYEHIIYAPATHTSFASLPGMWDRTLIVNGLSKTFAMTGWRLGYIAGPKHFVAACEKIQSQFTSGASSISQKAGVAALGLGYAGGEAVSTMVKAFRERRDFLVESFREMDGVKICEPQGGFYVFLDFSSYYGREAEGFGVIENSDSLCRYLLDKGLVALVPGXAFGDDTCIRISFAESLTTLKTAVERIKKALIPLSSSALV

SEQ ID NO: 17484 - protein, 462 aa, Blastopirellula marina DSM 3645
MPKCDVPETPLSELLPADVLADNPPALPELAEPEVVRHYTNLSTLNMSVDTHYYPLGSCTMKYNPKRNERLASLPGIVDLHPYQPEDSLQGMLQLLYELQQFLTEISGLPAISLQPAAGAHGEWTALMSAAAYFRSIGQEQRKLVLSPDSSHGTNPASAQMAGFTAVTVRTVDGAVDMDDLRSKLNDQVAVFMITNPSTLGLFETQMAEIADAVHAAGGLIYLDGANMNAVLGISRPGDVGADMMHYNPHKTFSGPHGGGGPGAGPICVAEKIAPFLPSPIVVKEGDKYRLDYDRPESIGRVRTFFGNVGVLVRAYCYILSYGPDGLKAVSENAVLNANYLLSKIKHFLPVPHGLRCMHEFVASAAKLKQEKGVTAMDIAKRLLDYGFHAPTVYFPLTVPEAMMVEPTETESKEMLDAFVEILFRITEEPAELLHEAPHTTPISRPNEVQAARQPCLRAVCG

SEQ ID NO: 17485 - protein, 455 aa, Blastopirellula marina DSM 3645
MAYLFNTPQEQQEMLASIGAASIEELFEQIPASLRLGRPLDLPPAMGELELTQHLATLAAKNQGPGDKICFLGGGSYDHFIPAAVDALASRGEFYTSYTPYQPEVSQGNLQAMFEYQTLICELTGLDVSNASLYDGGSAIAEAVIMSMNTVRRHDKIVVLGSVHPEYRQILDTYFGPLGTQIVVVPTPNGTVDPAEVAAVVDDQTACVVVQSPNFFGSPEQVQALADIAHAKDALLVQSFDPLSLGVIKRPGDLGADIAVAEGHSLGSPMQYGGPYLGIMACREQFVRRMPGRICGETVDRRGKRCWVLTLQTREQHIRREKATSNICTNQGLFALRASIYLALMGPHGLQDVGELCARKSHYAATQIASQERFELAFSTPFFKEFVVRDLQNDVATVLADASEAGFFAGVALGTWFPELADCFLVTVTEKRTRVEIDGLVKTLALTTNRTTIHA

SEQ ID NO: 17486 - protein, 141 aa, Glycine max
DLVPFSNKIYSGDLQKRLGITAGLCVLIQHELEKKGDRYEAIYSFYFGDYGHISVQGAYLTYQDTYLAVSGGSGIFEGVYGQVKLHQLVFPFKLFYTFYLKGVPDLPPELLGKPVEPSPSVEPSPAAMATEPHACLPNFTN

SEQ ID NO: 17487 - protein, 605 aa, Triticum aestivum
  misc_feature (136)..(136): Xaa can be any naturally occurring amino acid
  misc_feature (362)..(362): Xaa can be any naturally occurring amino acid
  misc_feature (429)..(429): Xaa can be any naturally occurring amino acid
  misc_feature (464)..(464): Xaa can be any naturally occurring amino acid
  misc_feature (509)..(510): Xaa can be any naturally occurring amino acid
  misc_feature (517)..(517): Xaa can be any naturally occurring amino acid
  misc_feature (537)..(537): Xaa can be any naturally occurring amino acid
  misc_feature (561)..(561): Xaa can be any naturally occurring amino acid
  misc_feature (595)..(595): Xaa can be any naturally occurring amino acid
  unsure (1)..(605): unsure at all Xaa locations
MAGGGGGKKDRGEGLGRALVRQRNKQALAAKARGQQLVISRRAQQALPLESVIEVSDFDAVLQRAAEEELLHGDDAEGAAALTAALRSGLIDLDGTGDTQEERRLLREEQQALHADSLRVPRRPPWTAQMTTEELXDTNEKRAFLEWRRNLARLQENEELVLTPFEKNLDIWRQLWRVLERSDLLVMVVDSRNPLFYRCPDLEEYAQEIDEHKRTLLLINKADLLPLSVRRKWADYFKEHDILYLFWSAKAATAVLEGKKLSSQTMEESDTDLDTKIYGREELLVRLQGEAEYIVSQKATSAVGEEPESSSESALVQPKRVVVGFVGYPNVGKSSTINALVGEKKTGVTSTPGKTKHFQTLXISEELMLCDCPGLVFPSFSSSRHEMVACGVLPIDRMTKHRGAFQVVANRVPRNILEQVYKITLPKPXKAYEEASRPPTAAELLMAYCTSRGHVSHAGLPDEXRAARQILKDYIDGKIPHFELPPGEIDDETDAEDNSDLEGSSTAAXXQSDDGAXDEDDEEINRAEPNISHALNXLASFDMNGQMTKGSPKKKKKEASXKHHRKPQRKKDRSWRVGNDGADGSGVIRVVQKPXVNLAASTLAS

SEQ ID NO: 17488 - protein, 405 aa, Desulfitobacterium hafniense Y51
MINMEFRFNTIEEAIEDIRQGKMIVVVDDEERENEGDLLMAAEKSTPEAINFMATYGRGLICVPMTAERIQALNLEPMVTHNTDPHGTAFTVSVDGCDCTTGISAFERANTVKVLLDPHSRPENLRRPGHIFPLKAREGGVLVRAGHTEGAVDLARLAGFQPAGVICEILKDDGTMARVPDLMEFVKKHDLKIVTIKDLIHFRRQKEKLVERVVGIELPTDFGDFKAVGYRSLLDGQEHIALVKGDVDDGEPVLVRVHSECLTGDVFHSRRCDCGEQLSAALESIQKEGRGVLLYMRQEGRGIGLLNKLKAYKLQEEGKDTVEANLALGFPADLRDYGVGAQILVDLGIRKVRLMTNNPRKIVGLEGYGLEIQERVSMEMPVKPENEHYLHTKKIKLGHYLPGVR

SEQ ID NO: 17489 - protein, 388 aa, Roseovarius nubinhibens ISM
MSDTVPFEKPGPVEAGLRDAIATTEEIIEEARAGRMYILVDHEDRENEGDLVIPAEHADAAAINFMATHGRGLICLPMTAERVETLGLPMMAVNNSSRHETAFTVSIEAREGVSTGISAADRALTIATAINEQKSAADIATPGHVFPLRARKGGVLVRAGHTEAAVDISRLAGLHPSGVICEIMKDDGTMARLPDLVEFAQKHEMKIGTISDLIAYRHKHDNLIHEVRREKVTSSHGGAWDMAIYADQITGTEHVVLSKGDITDGAPVLARTHALDALEDVLGIGLEATGSGPTGKLPRAMEIIAAEGRGAVFLFRQPRPRLASEMEDDDTPRTIKHTGLGAQIMSYMGLHELILLTDSPDTRYLGLDAYGISIVGTRPISGAKAETN

SEQ ID NO: 17490 - protein, 569 aa, Escherichia coli O157:H7 EDL933
  misc_feature (8)..(8): Xaa can be any naturally occurring amino acid
  unsure (1)..(569): unsure at all Xaa locations
MSEEKLGXHYLAALNEAFPGVVLDHAWQTKDQLTVTVKVNYLPEVVEFLYYKQGGWLSVLFGNDERKLNGHYAVYYVLSMEKGTKCWVTVRVEVDANKPEYPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHSHLLNLGLACHFTGFDSGFMQFFRVRETSMKMAEILTGARKTYGLNLIGGIRRDLLKDDMIQTRQLAQQMRREVQELVDVLLSTPNMEQRTVGIGRLDPEIARDFSNVGPMVRASGHARDTRADHPFVGYGLLPMEVHSEQGCDVISRLKVRINEVYTALNMIDYGLDNLPGGPLMVEGFTYIPHRFALGFAEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 17491 - protein, 266 aa, Pseudomonas fluorescens
MPDITLTTLQSLKLKGEKITMLTCYDATFAHASCQAGIEVLLVGDSLGMVLQGNDSTLPVTTDELAYHTASVKRGNDGAFIIADLPFMGYATLEQTFQNAGKLMQAGAHMIKVEGAVWLAESIRLLAERGVPVCAHMGLTPQSVNLLGGYKVQGRNEAQARQMRADAIALEQAGAAMILLECVPSELAAEITQAVKVPVIGIGAGSATDGQVLVLHDMLGLSITGRVPKFVKNFMTGQASIHDALSAYVAEVKGVTFPGAEHGFSA

SEQ ID NO: 17492 - protein, 140 aa, Zea mays
  misc_feature (18)..(18): Xaa can be any naturally occurring amino acid
  misc_feature (20)..(20): Xaa can be any naturally occurring amino acid
  misc_feature (35)..(35): Xaa can be any naturally occurring amino acid
  misc_feature (72)..(72): Xaa can be any naturally occurring amino acid
  misc_feature (99)..(99): Xaa can be any naturally occurring amino acid
  unsure (1)..(140): unsure at all Xaa locations
GTRAFWLKNKNKSKSVQXDXRALDQGGQAKPGSTXTGGKKNKGGENAREKELNGLVKGGGRQAKGPGGGGPXAILGGVFKGGQGQKGFKGKFSHDLDGXREGGKVGIYTDKGGGETMEGWDQETLEKGGGSKKRGDQENK

SEQ ID NO: 17493 - protein, 233 aa, Chlamydophila caviae
MKEDPYLEVKRHLAREAAALVTSGMLLGLGSGSTSREFIKAVAERKKQENLDIRAVASSKESYSLASSLGIPLIDDEEFINTDLAVDGADEIDPQLRMIKGGGGAIFREKILLQSSQRRLILADESKSVKVLGKFGLPVEISPFGRSSIIATLENFGYLGNLRKNPRGGFFITNNGNYIYDIHTPNVYPHPEEDLLKLLQIHGIIEAGFVIENVEVWLGYTNGQIGKKNTGGL

SEQ ID NO: 17494 - protein, 487 aa, Bacillus cereus ATCC 10987
MGVLLPVNAGQISKLRLEGDVQELEKNLKKDLKIRHITMISIGGVIGAGLFVGSGAVVHSAGPGSIISYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGVPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLKIRKKMGKVEQQNLKVKMWFFPYVTYVTIAAIIAVLVAMLAIESLRSQALLTMLVTVLIILSYFIFNRNKNSTVSNTTSKNEESVRF

SEQ ID NO: 17495 - protein, 426 aa, Spinacia oleracea
MAIEHEDDLKDEKNPRPLDEDDIALLKTYGLGPYSASIKKVEKEIKDMSKKVNDLIGIKESDTGLAAPSQWDLVSDKQMMQEEQPLQVARCTKIINPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 17496 - protein, 583 aa, Oryza sativa (japonica cultivar-group)
MEEERSRAGGAAVAVDGESLRRPEEEGGRRKKGGWITFPFMAVSLLAFGLSSAGAMGNLVVYLVKEYHVPSVDAAQISTIVSGCISVAPVAGAIVADAFFGCFPVVAVAMVFSVLALVVFTLTASVRGLRPAACVPGATACEAATAGQMAVLYAGVFLLCVSSAGARFNQATMGADQFDAAADRDVFFNWYFIFFYGSAVLGSTVLVYVQDAVSWELGFGLAATIAAAGLAALLLGARYYRRPAARGSPFTGIARVVVAAARKRKIDVAAAAAASGDLKFYYGPRSGDGDDDGGKPSDDNNFAPSDSFSFLNRAAVITDGDVDAADAAAPLRPWRVCTVRQVEDLKAVLRILPLWSSSIFLSISIGVQLNFTVLQALAMDRAIGRFHVPAASMVVSSFVAVVVSLGLIDRALLPLWRALTGGRRAPTPLQRIGVGHVLTVLSMAASAAVERRRLATVRAHGEAARDDPAWVSPLPAAWLVLPFALSGAGEAFHFPAQVTLYYQEFPPSLKNTASGMVAMIVALGFYLSTALVDAVRRATAWLPDNMNASRLENLYWLLAVLVAINFGYYLACAKLYKYQNFGK

SEQ ID NO: 17497 - protein, 393 aa, Lactococcus lactis subsp. lactis Il1403
MKKNSDFVLKMDESVTLAAANRAKALKAQGRDIIDLTLGQPDFPTPKIIGQAAIEAIDNGKASFYTQAGGLPELKNAVQHYWTRFYNYEIQPNEILITAGAKFALYAYFMATVDPDDEVIIPAPYWVSYVDQVKMAGGNPVIVEAKQENNFKVTVEQLEEARTSKSKILLLNSPSNPTGMIYSKEELTAIGEWALAHDLLILADDIYHRLVYNGAEFTAISSLSDEIRKRTTVINGVSKTFAMTGWRIGLAVGDPEIISAMTKIASQTTSNPTAVAQYAAIEAFEERDNSFEIMHAAFEERLNIIYGQLSEVPGFELVKPNGAFYLFPKVTKAMAMKGYSDVTDFTTAILEEAGVALVTGAGFGSPENVRLSYATSLKNLEVAVARLKDWMNE

SEQ ID NO: 17498 - protein, 273 aa, Aspergillus oryzae
MTSETFLARLCEQAERYDDRFPRTPFLALLTPHQIGGELTVDERNLLSVAYKNVVGTRRASWRIISSIEQKEESKGSEQHVSIIRDYRQKIETELEKVCQDVLDVLDESLIPKAETGESKVFYYKMKGDYHRYLAEFASGNKRKVAATAAHEAYKNATDVAQTDLTPTHPIRLGLALNFSVFYYEILNSPDRACHLAKQAFDDAIAELDSLSEESYRDSTLIMQLLRDNLTLWTSSDGQEPEGAASKEDKPEEESAPAPEDKGEESKPAAPES

SEQ ID NO: 17499 - protein, 259 aa, Arabidopsis thaliana
MARDGGVSCLRRSEMMSVGGIGGIESAPLDLDEVHVLAVDDSLVDRIVIERLLRITSCKVTAVDSGWRALEFLGLDNEKASAEFDRLKVDLIITDYCMPGMTGYELLKKIKESSNFREVPVVIMSSENVLTRIDRCLEEGAQDFLLKPVKLADVKRLRSHLTKDVKLSNGNKRKLPEDSSSVNSSLPPPSPPLTISPESSPPLTVSTESSDSSPPLSPVEIFSTSPLSSPIDDEDDDVLTSSSEESPIRRQKMRSPGLD

SEQ ID NO: 17500 - protein, 692 aa, Saccharomyces cerevisiae
MGNSSSKSSKKDSHSNSSSRNPRPQVSRTETSHSVKSAKSNKSSRSRRSLPSSSTTNTNSNVPDPSTPSKPNLEVNHQRHSSHTNRYHFPSSSHSHSNSQNELLTTPSSSSTKRPSTSRRSSYNTKAAADLPPSMIQMEPKSPILKTNNSSTHVSKHKSSYSSTYYENALTDDDNDDKDNDISHTKRFSRSSNSRPSSIRSGSVSRRKSDVTHEEPNNGSYSSNNQENYLVQALTRSNSHASSLHSRKSSFGSDGNTAYSTPLNSPGLSKLTDHSGEYFTSNSTSSLNHHSSRDIYPSKHISNDDDIENSSQLSNIHASMENVNDKNNNITDSKKDPNEGFNDIMQSSGNKNAPKKFKKPIDIDETIQKLLDAGYAAKRTKNVCLKNNEILQICIKAREIFLSQPSLLELSPPVKIVGDVHGQYGDLLRLFTKCGFPPSSNYLFLGDYVDRGKQSLETILLLFCYKIKYPENFFLLRGNHECANVTRVYGFYDECKRRCNIKIWKTFIDTFNTLPLAAIVAGKIFCVHGGLSPVLNSMDEIRHVVRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLDPLDSAALKQVMKKGRQERKLANQQQQMMETSITNDNESQQ

SEQ ID NO: 17501 - protein, 472 aa, Triticum aestivum
MAGAAAAAAAVASGISVRPVAAPKISRAPRSRSVVRAAVSIGEKAYTVQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSDTAKFGRFHRGMLEEGVYLAPSQFEAGFTSLAHTTLDIEKTVEAAEKVLRRI

SEQ ID NO: 17502 - protein, 241 aa, Anaplasma phagocytophilum HZ
MKPFVIHRRSISQSTNLDAMELAEQGADSGTVIVADEQSSGVGRRGRQWYSPKGNLYFSIVLKEHLHVPTLSFACALSVGISLEQIFSQHIENSKIPTLKYKWPNDVFVDNKKISGVLLQSKVQGHSIPWIVCGVGVNILHHPEYATSISSYIPDLKLTNIELLDVVLENLAKLLDIYSASGFAPLRSLWLKKAHALNSHVCITTSDGITHEGTFTDIGLDGSIVLKSGEDTLKLDYGSML

SEQ ID NO: 17503 - protein, 407 aa, Thermoplasma acidophilum
MKLKFLGGAEEVGRLGVKITDKDTSVIVDYGVIPEKPPQYPLPPEPVDAMFITHSHLDHIGAVPVYYHKGEPDLYATQMTLNTMKPLLRDALKVTNIEGYPAMFNEDDINSALANMRPARYFESIEVGNMVATPYPAGHIPGSTMWKFEDGISVTVTGDVNTIDTYLINGAKPIKTDVLIIESTYAGKNHESREDVRKRFRDSVKEVIDSGGKVIMPAFAVGRTQELIMTIADMGYDVAVDGMGNDISTIYLNTPGFLRSKKEFLRALSKVRIIKGRNMRENAIRSDIIISTSGMLDGGPVLGYIQKLLEDEKSAIFVTGYQVEGTNGRSLLETGTLTIAGVTVKPKMRVEFFDMSAHAGHDELVNFIKAIDPKKIVLCHGDHRENLLPDLEGYDVLLPYNGKEYEI

SEQ ID NO: 17504 - protein, 487 aa, Rubrivivax gelatinosus PM1
MREPNEADDAAVARARAADAAPLRSVAALPGPRGWPLIGNLLQFDLPRLHRQFEDWADRHGPTYRLRLGRREVLVISDAETIAALLRDRPDTWRRMRPIEAVIREAGGHGVFSAEGDDWRRQRRLVMSAFDPGHLKRFYPSLQRVTERLMASWREAARRGEAIDLQASLMRYTVDVTTGLAFGVDLNTIDAPHPLQEHLDKLFPMLFRRVNLPFPYWHYLRLPIDREYDRHLRRVHEAVRGFVQAARQRLQDEPTRRERPTDLLEAMLAARDADGSALTEEEVAGNVLTVLLAGEDTTANTLGWAIWLLHEHPDDWQALVAEVDAALGDARLPPSFDAARGLASIEASVGEAMRLKPVAPLLFMEANRETALAGFRLPPGAVVFCLMRRAALDARLAEDVADFRPGRWQDGADRAVQKASMPFGAGPRLCPGRYLALLEMKMVLGMLARNFELLEVGPEGGGAPGERMAFTMFPVGLKMRLAERARR

SEQ ID NO: 17505 - protein, 281 aa, Gibberella zeae PH-1
MSSSANLVESAKKLAAYQAVNDHLDASYKFVGIGSGSTVVYVVDAIVSKGPEFYKGMTFIPTGSQSKGLIRAAGLNLVNLDERPMVDGLPVPLDVAFDGADEVDEDLNLIKGGGACLFQEKLVAIAAKKFIAVADYRKQSPKLCTTWKTIPIEVLPLSAPDVLVRLRAMGSPKPAIRSGLPAKAGECVTDNGMWLIDAPFSPLLLPKDINSENKGRGENGAWEVNALAEELVRTPGIVEIGLFHGFNGNEAVKLGKESQAQKPIAAYFGLANGEVQVQNAA

SEQ ID NO: 17506 - protein, 537 aa, Medicago truncatula
MGFFSTIFGFFGFGVGISIGLVVGYFLFIYFQPTDVEDPKITPIVDQDDETLQKMLPEIPNWIKNPDFDRVDWLNKFIELMWPYLDKAICKTAKNIAKPIIEEQIPKYKIDSVEFQTLTLGTLPPTFQGMKVYVTDEKELIMEPSIKWAGNPNVTIAVKAFGLKATVQVVDLQVFLLPRITLKPLVPSFPCFANIYVALMEKPHVDFGLKLLGADLMSIPGVYRIVQELIKDQVANMYLWPKNLEVQILDMAKAMRRPVGILHVKVLHAMKLKKKDLLGASDPYVKLKLTDDKMPSKKTTVKHKNLNPEWNEEFNLVVKDPETQVLQLNVYDWEQVGKHDKMGMNVITLKEVSPEEPKRFTLDLLKTMDPNDAQNEKSRGQIVVEVTYKPLNEEEMGKGFDETQTIPKAPEGTPAGGGQLVVIVHEAQDVEGKHHTNPQARLIFRGEEKKTKRIKKNRDPRWEDEFQFIAEEPPTNDKLHVEVVSSSSRTLLHQKESLGYVDINLGDVVSNKRINEKYHLIDSKNGRIQVELQWRTA

SEQ ID NO: 17507 - protein, 366 aa, Vitis vinifera
MGKGGNSEDAVSSKEHGEENMAAWLLGIKTLKIQPYILPSLGPHDVKVRIKAVGICGSDVHHFKTMRCANFIVKKPMVIGHECAGIIEEVGSEVKNLVVGDRVALEPGISCNRCSLCRNGQYNLCREMKFFGSPPTNGSLANQVVHPSNLCFKLPDNVSLEEGAMCEPLSVGIHACRRANVGPETNVLIMGSGPIGLVTMLAARAFGAPRIVLVDVDDQRLAIAKDLGADDIIRVSTNIQDLDEEVAKIQSTMVTGVDVSLDCVGFNKTMSTALNATRAGGKVCLVGLAQSEMTVPLTPAAAREVDIVGIFRYRNTWPLCLEFLRSGKIDVKPLITHRFTFSQKDVEEAFETSARGGNAIKVMFNL

SEQ ID NO: 17508 - protein, 322 aa, Oceanobacter sp. RED65
MQTVQTILEKHRVSDSLAQAIHCVLDCSKEISVLLQKGAMAGVLGSAENENVQGETQKKLDVISNDLLKERLAECPVVAGIASEEEDLPVAANEDGQYLVIYDPLDGSSNIDINVTVGTIFSILPSRGEDPSKEATYLQNGRQQVAAGYVLYGPATMLVMSTGKGVDIFTLDPTSNEFVLTQEQVQITPSTKEFAINMSNQRFWAEPVQTYVSDLLAGEEGPLAKRYNMRWIAAMVAEVHRILNRGGIFMYPWDNREPNKPGKLRLMYEGNPMSMLVEQAGGLSVNGEINIMDIEPEKIHQRVPVFLGSKEEVEKALSYHKA

SEQ ID NO: 17509 - protein, 594 aa, Synechococcus elongatus PCC 6301
MQPNDFQRRTKIVATIGPATSKPEVLRALIEAGASTLRLNFSHGTHDDHQRSIRLIRQISFELNRPVGILQDLQGPKIRLGRFADGPITVQKGDSFILTSRSVPGSQTISSVTYEPLADEVPEGATILLDDGRVEMTVVKVDRQTRELHCEVVVGGILSNNKGVNFPGVYLSVKALTDKDREDLIFGLDQGVDWVALSFVRNPQDVLEIKELISRAGKSVPVIAKIEKHEAIEQMEAVLSLCDGVMVARGDLGVELPAEEVPILQKRLIRTANRLGIPVITATQMLDSMVSNPRPTRAEISDVANAILDGTDAVMLSNETAVGKFPIEAVSTMATIAHRIEAEQQYITLNPTPTSSIPNAISQAVGHIAEQLDAAAIMTLTQSGATARNVSKFRPTTPILAVTPNIDVARQLQLVWGVQPLLVVDLPSTSQTFRAALNVAQERTLLKEGDLVVMTAGTLPGVSGSTDLVKVEIVTAVIARGIGVGQGSVSGKARVIHNAAEAATLAQGEILIATQTSADYIEAIRKASGIVTEEEGLTSHAAVIGLRLGIPVIVGVKNATSVVRDGSILTLDVKRGLLYSGAVGAVAAEQPISV

SEQ ID NO: 17510 - protein, 283 aa, Francisella tularensis subsp. holarctica
MMFLEQLLINFQTRRKDEMKSVLGFKKAKVTQEKISMVTCYDYTLAKIINSTDIDCILVGDSGGMVLLGKKNTTYTTLDDMQFMTQAVANGATDKFIVADLPFMSYRQSLETTMQAVMALIQSGAHAIKLEGSSGNLDIIKHIVDSGVPIMGHIGMTPQFINSFGGFKVQGRTEEAAKHLLEEAKLLEQAGCFGIVLECIPANIAKDITQNLDIPTIGIGAGSNTDGQILVLQDMLGMNTDFQPKFVKKYIDGSKLFSDAINTYVKETKANTFPTKEHCYDYC

SEQ ID NO: 17511 - protein, 456 aa, Salmonella enterica subsp. enterica serovar Typhi
MDSQQHGEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 17512 - protein, 496 aa, Burkholderia xenovorans LB400
MTNHPTAMPSLQEPSLFRQECYIAGEWIESDPMARIDVVNPANGLKIGTVPRATLADVRTCIDAAERALPAWSGKTGKERAAILRRWYELMLQHQEDLAVIMTCEQGKPLAESRGEIVYAASFLEWFAEEAKRVYGDTIPTPASDRRIVVLKQPIGVCAAITPWNFPAAMLTRKIGPALAAGCTMVLKPASQTPFSALALCVLAERAGVPAGVLSCVTGKASMIGDEFCRNPAVRKLSFTGSTEIGKLLLQQCASTVKKTSMELGGNAPFIVFDDADLDAAVVGAIAAKFRNAGQTCVCVNRFLVQDTVHDAFVEKLSTAIAALKVGDGLDAGTRIGPLIDSKAVEKAREHVDDAIARGATVVTGGSGHALGGNYFEPTLLTGASKDMKIFREETFGPVAPVFRFRTEEEAIQLANDTEFGLASYFYGRDIGRVWRVAEALEYGMVGINEGLISTEVAPFGGVKESGLGREGSKYGIEDYLEVKYLCMGGLAARPV

SEQ ID NO: 17513 - protein, 466 aa, Zea mays
MQGGSSGIVYGGLKYQARCIADVRADASSTTFLAGTLSLKEENEVHLIRLSPAESELVCDGVFYHPNEIWDLKSCPFDHRVFSTVYTSGERGLFRLGGGRERSAASPGGSKAREKMQGGSSGIVYGGLKYQARCIADIRADAGSTTFLAGTLSLKEENEVHLIRFSPAESELVCDGLFYHPNEIWDLKSCPFDHRVFSTVYTSGEGYGASVWKIPELNGQSNSPQLEQLFELSGHTGKIRRVIWWPLGKHDKLISIDDRNIFLWNIDTSKKIAKVISQGSTDMLPNLRGGAWDPHNHNLVAAISDSSLQLWDLRSMEKSTAIEHAHIRDVDYNPKKQNIVATAEEEFGIRLWDLRMLKYPLKDLPGHSHWTWAVRHNPAYDELLLSAGTDSTVNLWLAKVSSDDPESDSPSALSNRQEVPLLNSYTDYEDSIYGIAWSSHDPSLFASLSYDGRVVLESVKPYLQRK

SEQ ID NO: 17514 - protein, 575 aa, Bradyrhizobium sp. BTAi1
MHELIGDITLCILFAWVLGLAAHYWRQPSILAYLVAGFAIGPFGTGWVKSQESISVISELGLIFMLFMIGLEIDLKKIIRAGPVILIAGGVQLLGGAALGILFFVAIGMRMGAESYDALYLCVACALSSTVIIVKVLYEKRELDTLPGRITLGVLVLQDVFAILFLAVQPSLDDLHFGVILLSFARAGALVAIALLLSRYVLPPVFHRIARTPELILLGALAWCFLIGEIAERLHLSREMGSLIAGVSLSTFPYALDVTAKVTTLRDFFITLFFVALGMTIPIPTMSVVGLALVIALFTVASRLLTTFTPLYMMRQGLRASLLPALNLAQISEFSLVVIQTGAAAGHLKTGTSSAASFAFVLLAVLSTFVIVRSDPIVRRGIPLLKRLGLRDLDATKDGEAGHDGGHGATRPIVLLGFFRTASALLSEIERNQPELLERIGVVDFNPVVFRTLSDRGIQVTYGDISNVDTLVHAGVGQAELIILSIPDSLLKGANNEKLVRHVRSINATAKIVATADLLADVNDLYNAGADYVTVPRLSDAQVLLNLIQDASAGLLSDRRQEVEALLADRREVLP

SEQ ID NO: 17515 - protein, 152 aa, Prochlorococcus marinus subsp. pastoris str. CCMP1986
MIKERTFLAIKPDGVQRGYVSDIIGRFEKKGFKLVGLKQLIPTKQLAQDHYGVHRERPFFKDLVEFISSGPVVAMIWEGEGVILSARKLIGATKPLEAEPGTIRGDLAIDIGRNIIHGSDGEETAKFEINLWFNQDEICDWETSDSEWRAEN

SEQ ID NO: 17516 - protein, 268 aa, Anaplasma phagocytophilum HZ
MVERLTCNQDVVGSSPAVGSLCVIIMDDMSFLVVANWKANGNARLAESFLDVLSSQNSLSGGSTCSVVLCPPYTAMPSLRGRSCVVRLGGQDCFAGVSRGCTGEITAKMLRECGCEYVILGHSDRRTLLNESDSLIKLKAESAIGECLIPIICVGENREERESGATGRVLLEQCRSCLPEEGEFFVAYEPIWAIGGSVIPDIAMIEEAFSIIKSHNPGLRIIYGGSVNESNIRSLKTGVSGIAGVLVGSASLDADGFARMLDNVMECL

SEQ ID NO: 17517 - protein, 367 aa, Salinibacter ruber DSM 13855
MGIDPRGVGGGGAVHRAGHPRPGADRGGLVRGPEVHAVCDDHPRARVGPVQHHRGSAHGRLSRVGPRGVASAWGRAGTHLCPCGRDGLCDRVELGHHGHPDAAGGSTGVGGSRPERDGRPVALSHSVLVGVVRAGRIGVGGPLFAHFGYDDSLVNGQRLRPRGARAHAVAVRAQRGDRGHRVWHTARRLRHAVVGRALGRGGAPVRPAEGGRHARRYGRGPCGGPGVSQWQPPRRRGARLSPFLFVHQSTSLSMFLDADDRPWGRWEEYLNEPGYRVKRIIVHPGQRLSLQKHEQRQEHWVVVRGTGVFTRNEEEIAVSEGDTCFIDEGDVHRIENTGDGPLVFIETQMGRCVEDDIIRLEDDYGRE

SEQ ID NO: 17518 - protein, 377 aa, Xylella fastidiosa Ann-1
MNSFAAVPVLIEEVRAGRMVVIVDDEDRENEGDLIMAAELVAPKDINFMVTHARGLVCLSLTRERCAQIGLSPMVQRNTTRFQTNFTVSIEAAEGLTTGISAYDRAHTIRTAVRPNAKPSDLHQPGHIFPLIAQPGGVLTRAGHTEAASDLPMLAGLEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGMAASDALRMIAAAERGVMVMLAAPRDSDVLLARLRSEPEVVSNVKDVGQWRRNGAGGQILADLGLAKLRVLGTPRRQIALAGFGLEVLEYLECRGGVPFASQGVD

SEQ ID NO: 17519 - protein, 260 aa, Salinibacter ruber DSM 13855
MLVAGNWKMNTDVPEGRALADAIAEGLSSTAADRGDVDFLVCPPYVHLPAVREALADVPVAVGAQDMHAQDEGAYTGDVSAPMLSSIGCDAVILGHSERRTYYDETDAEVNAKAQQARAHDLVPIVCVGETLEQRKAGEADTVVRSQVDGALSDVSIDGADELIVAYEPIWAIGTGESAAAEQAQAMHAVIRDDLRERYGGDVADEVPLLYGGSMKPHNAYGLLSQPDIDGGLIGSASLEAESFLGIAEKAAEVLETSGH

SEQ ID NO: 17520 - protein, 128 aa, Arabidopsis thaliana
AMLQQRRDNALRRESNNSISQAFSHQVRRTRGSYSTGDEYEEERPKWLDRWMASKPWDKRASTDQRVPPVYKTVEIDTSQPYLTRGNSRTGASPSRSQRPSSPSRTSHHYQQHNFSSATPSPAKSRPI

SEQ ID NO: 17521 - protein, 408 aa, Bordetella bronchiseptica RB50
MSSNEQTRRGFLADRVLGAKPSATKEMTRLANQLRQEGRDVIALSQGEPDFPTPEHVREAAKAAIDQGESRYTEVAGTLALREAVARKFERDNGLAYSPEQIQVGCGAKQILYNALQATINPGDEVVVPTPAWVSYPEMVLLAGGQPVIVRCGASSGFKLSPRQLEESITPRTKWLMLNSPSNPSGAVYSAEELAALAEVLARHPQVWVMADDIYEKIRYDDTPFATPAAIAPELAARTLTINGVSKAYAMTGWRVGFGAGPAALIKAMNLVQSQSTSHTSSISQAASIAALDGPMDFLPAFVAAFRRRRDSVVARLNAIEGLACDLPPGAFYAFPGCQALLGRRDPSGTLVSTDLDFALYLLREAGVAIVPGSAFGLSGHFRVSYAASDEQLAQAMARIAAACARLS

SEQ ID NO: 17522 - protein, 113 aa, Bacillus anthracis str. A2012
MPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAASHI

SEQ ID NO: 17523 - protein, 360 aa, Kluyveromyces lactis NRRL Y-1140
MDVDTDVPMHDAVEDQLDSTLDEEAPGFDNGLASSSPGTSGIADNKATKPVELTGSSIGQLDAWLEKLSQCQCLSEEDVAKLCKMAVDVLQFEDNVQPVSVPVTICGDVHGQFHDLIELFKIGGPCPDTNYLFMGDYVDRGYYSVETVSYLVALKVRYPSRITILRGNHESRQITQVYGFYDECLRKYGSANVWKMFTDLFDYFPITALVDNKIFCLHGGLSPMIETVDQVRELNRIQEVPHEGPMCDLLWSDPDDRGGWGISPRGAGFTFGQDISEQFNHTNDLSLIARAHQLVMEGYAWSHQQSVVTIFSAPNYCYRCGNQAAIMEVDDTMNRQFLQYNPSVRPGEPTVSRKTPDYFL

SEQ ID NO: 17524 - protein, 465 aa, Yersinia pseudotuberculosis IP 32953
MSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKATK

SEQ ID NO: 17525 - protein, 203 aa, Brassica napus
SIRLIEGTINFIFDYLVGAFRLQILNTLHKWGRSNRDKVQQFGAITGAGGKNAFKTFKASDWQFEAAFDGFYSQPQPKSNADVRPLGELYNRYKDQYSDMILADGISVLCTDLQVEPQDIVTLGLSRDIKAVTQREIFTEENVGGVHTAGVDITIKMLEKMLFFLPQRKDEQKFHEIYNFAFGWAKEKGQKSLALDTAIGMWQ

SEQ ID NO: 17526 - protein, 827 aa, Oryza sativa (indica cultivar-group)
MEAATANIFHLSLTFFFMVLLTLGTSAAGVASDTLSNGRNLTDGNTLVSAGGSFTLGFFSLGLPSRRYLAIWFSESADAVWVANRDSPLNDTAGVLVNNGAGGLVLLDGSGRAAWSSNTTGKSSSATAAQLLESGNLVVRERDQLNTGVFIWQSFDHPSNTLIAGMRLGNNRQTGDAWFLSSWRAHDDPATGDCRRVLDTRGLPDCVTWCGGAKKYRTGPWNGQWFSGVPEMASYESIFSSQVVVTPDEIAYVFTAAAAAGSPFSRLVLDEAGVTERLVWDPSSKVWIPYMKAPRGVCDDYAKCGAFGLCNEDTASTLFCSCMAGFSPVSPSRWSMRDTSGGCRRNAPLECGNGSTTDGFVTVRGVKLPDTDNATVDTGATLDECRARCLANCSCVAYAAADISGRGCVMWIGDMVDVRYVDKGQDLHVRLAKSELVNNKKRTVVKIMLPLTAACLLLLMSIFLVWLYKCRVLSGKRHQNKVVQKRGILGYLSASNELGDENLELPFVSFGEIAAATNNFSDDNMLGQGGFGKVYKGMLDDGKEVAIKRLSKGSGQGAEEFRNEAVLIAKLQHRNLVRLLGYCIYGDEKLLIYEYLPNKSLDAFIFDHANKYVLDWPTRFKIIKGVARGLLYLHQDSRLTVIHRDLKPSNILLDVDMSPKISDFGMARIFGGNQHEANTNRVVGTYGYMSPEYAMDGAFSVKSDTYSFGVILLEIVSCLKISLPRLTDFPNLLAYAWNLWKNDRAMDLMDSSISKSCSPTEVLLCIQIGLLCVQDNPNNRPLMSSVVSMLENETTTLSAPIQPVYFAHRAFEGRQTGENSISLLEGR

SEQ ID NO: 17527 - protein, 468 aa, Candida albicans SC5314
MATASTTTVYGGDEINAIVLDPGSYTTRIGYAGDDFPKVITSSYYGQVKNDKKKIFGESINVPRANYDIKPILKESIIVDWDAAIEQYQYYFDQQLKVVGPEQPILITEPIWTETSYRQQLVETFFENFEFSGIYLAKSPTCVSFQQGRSNCLVVDLGHDSVSVTPVIDGICLLKSSMKTNYGGKFLSNEIQDYLIDTKKVVMEPSFKIKSKIPTTYPDPPKYELKNNNTIPTSSSSSLSQSFLEFQNEKIYHNFKEILEVPEKNSSSGTTTTTTTTNKDSSRLFELPTGQSIVIDRFKIAESIFDPTIYKFTNSKLSFPPNNGEISITQANEYRPLKRVRKNDDEEEDSNQSTPKPEVNIRGISQLISHTLSNIDIDLRASLANNIIVTGGVSLISQLTERLYLELSNNNPGLKIRLHAVGNSTERINQAWIGGSVLASLGTFHQMWVTKEEYNEVGVDRILNQRFR

SEQ ID NO: 17528 - protein, 130 aa, Glycine max
  misc_feature (93)..(93): Xaa can be any naturally occurring amino acid
  misc_feature (102)..(102): Xaa can be any naturally occurring amino acid
  unsure (1)..(130): unsure at all Xaa locations
IADADATIDYRAGALVHTSFTGLKAMAGFPTMRTNNDITSIASNRGRVQCMQDWPPFGKKMSVTLSYLPDLDDAQLAKEVQYLLMNGWILWLXEFGAEHGFXYRERNRSPGIYHGRYWTMCTLTMTGCTD

SEQ ID NO: 17529 - protein, 814 aa, Oryza sativa (indica cultivar-group)
MAYLPVLIYLLLISFCKCDDQLTQVNRLISPSGKLVSKSGVFALGFFSPATSNQSLFLGIWYNNIPERTYVWVANRDNPITTPSSAMLAISNSSDLVLSDSKGRTVWTTMANVTGGDGAYAVLLDSGNLVLRLSNNATIWQSFDHPTDTILSNMKILLRYKEQVGMRLVAWKGLDDPTTGDFSCSGDPSSDLQVFVWHGTKPYYRSIVLDSVWVSGKAYGSSTSFMYQTYVNTQDEFYVIYTTSDGSPYMRIMLDYTGTFRLLSWNVNSSSWAIYSQRPAAIGDCDPYGSCGPFGYCDFTSVIPRCQCPDGFEPNGSNSSSGCRRKQQLRCGEGNHFMTMPGMKLPDKFFYVQDRSFEECAAECSRNCSCTAYAYTNLTITGSPGTTASQSRCLLWVGELVDMARNNLGDNLYLRLADSPGHKKSRYVVKVVVPIIACVLMLTCIYLVWKWISKGEKRNNENQNRAMLGNFRASHEVYEQNQEFPCINFEDVVTATNNFSDSNMLGEGGFGKVYKGKLGGGKEVAVKRLSTGSTQGLEHFTNEVVLIAKLQHKNLVRLLGCCIHGDDKLLIYEYLPNKSLDHFLFDPASKFILDWPTRFKIIKGVARGLLYLHQDSRLTIIHRDLKTSNILLDADMSPKISDFGMARIFGGNQQEANTNRVVGTYGYMSPEYAMDGVFSVKSDIYSFGVILLEIVSGLKISLPQLMDFPNLLAYAWRLWKDDKTMDLVDSSIAESCSKNEVLLCIHIGLLCVQDNPNSRPLMSSVVFMLENEQAALPAPIQPVYFAHRASETKQTGENTSSSNNNMSLTVLEGR

SEQ ID NO: 17530 - protein, 561 aa, uncultured Acidobacteria bacterium
MSDIDQTVNIPPLYCQHSTNSRRKVFMSATPTRIFVADDISDSGLQPLRAAGFVVEKRTGLKGPELLEALSGCAGLVVRSETKVTADLLDGAPALRVVGRAGVGVDNIDVPAATERGIVVMNAPDGNTITTAEHTIALLIALARRIPQANSSLKSGRWERKTFIGVELQGKTLGVVGLGRIGRTVAARARAFGMKIVAFDPFIAPEQARDAEIELAPLDELFSSADFITVHTPLTAETRGVIGREAFAKMKPGARIINCARGGLVDEGALYDAIKSGTVAGAALDVFVEEPPAKDHPLLLLDEVIATPHLGASTAEAQEGVAFTVAEQMRDYLLTGALRGAVNVPSLGTKELAVLRPYIELAEKLGHFQAQLVDSAVREVKLEFAGEIVELNAAPVTRSFLAGLLRDVSARVNAINAFLIAEERGINVTTSYFRAGADSASSIRTQVVAAGGEQAVAGTIFGFGEQAREGRITEIDGFHIEALPHGHMLVMRNRDVPGVIGRVGTILGERGVNISHFHLGRRERGGEAMAVIEVDAAADAETLDALRSLQDILSVCVIELV

SEQ ID NO: 17531 - protein, 255 aa, Erwinia carotovora subsp. atroseptica SCRI1043
MRHPLVMGNWKLNGSTNLVNELIAGLRKELSTVDGCGVAIAPPAIYLDQANHQLAGSRIALGAQNVDVNLSGAFTGETSAEMLKDIGAKYIIIGHSERRTYHKESDEFIAKKFGVLKDAGLIPVLCIGETEAENEAGQTEAVCARQLDAVLNTLGAKAFENTVVAYEPVWAIGTGKSATPAQAQAVHKFIRDHIAKQDAAVAEQVIIQYGGSVNAANAAELFTQPDIDGALVGGASLKADAFAVIVKAAADAKRG

SEQ ID NO: 17532 - protein, 244 aa, Oryza sativa
MKTVSLGAARPSSVKFRMPTRDNLVPIRVDVEVDGQRYRDAFTWNPCDPDSEIISFAKRTAKDLKLPANFVPQMLHSIQGQLTEFRSYEGEEMQIREKIVPLKIDLRINNTVIRDQFLWDIGNLDSDPEEFARTLCDDLNITDPEVGPAIAVSIREQLYEIASQSVSAMREAARVSKKGRRAPEFASNSKAMNNSLDLFKYFGSKGSVVRKRKEWYLYEPVVDVITNEEVGVTDATEEINSRNA

SEQ ID NO: 17533 - protein, 393 aa, Arabidopsis thaliana
MRKKKTRFQFLLNPNSKFVFFPRAISSSSSSSSDNNNDGSVSSSRQNNRQMGYDPSEELFGVDFKPRFISGDSREPRSWFGPNGQYIRELPCPTCRGRGYTSCSNCGIERSRLDCPQCKGKGIMTCLRCLGDCVIWEESIDERPWEKARSSSPFRVKEDDEVDNLEIKFSKRRKSKRIYQSPTPEVGQKISRSLKSLNAKTGLFSKRMKIIHRDPVLHAQRVAAIKKAKGTPAARKHASESMKAFFSNPVNREQRSLSMKGTKFYCKNCGQEGHRRHYCPELGTNADRKFRCRGCGGKGHNRRTCPKSKSIVTKGISTRYHKCGICGERGHNSRTCRKPTGVNPSCSGENSGEDGVGKITYACGFCKKMGHNVRTCPSKQVSDSDSCLEQEGS

SEQ ID NO: 17534 - protein, 320 aa, Glycine max
MEAKKIPEVILNSGKKMPVIGLGTASIPLPSHEALTSILIDAFEVGYRHFDTASLYESEESLGKAVAKALELGLINSREELFITSKLWSTDAHPDLVVPALKTSLQKLGLEYVDLYLIHWPVRLKPEAKGYHNILKENVLPSFDMKGIWEAMEECYRLGLAKSIGVSNFGIKKLSQLLENATIPPAVNQVEMSPAWQQGKLKEFCKQKGIHVSAWSPLGAYKSAQGTNAVMESPILKEIACERQKSMAQIALRWIYEQGAIAIVKSFNKERMKQNLDIFDWELSQEESQKFSQIPQRRMYRGITFVSENGPYKTLEELWD

SEQ ID NO: 17535 - protein, 154 aa, Arabidopsis thaliana
MGNHCTRIPCCKKVCSCICCCNRRNKTQARSQKGSYFIKGKVHPVSRMEKWEEKITEANSHGKILVVNFKASWCLPSKTILPIYQELASTYTSMIFVTIDVEELAEFSHEWNVDATPTVVFLKDGRQMDKLVGGDAAELQKKTAAAANLLLRQS

SEQ ID NO: 17536 - protein, 458 aa, Xanthomonas oryzae pv. oryzae KACC10331
MSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAVLCVLLLLSLNLVKVKLFGEMEFWFALIKIIAIAALIMTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPNGFAKLSRASVPARGLLFSCLCLLLGAMLVYLIPNLVTAFTLVTTLSAVLFMFVWSLILCAYIAYRRKCPEQHAVSAFKMPGGVLMCYVCLSFFAFVIVLLMLQDDTRQALLASPVWFLLLAIGYAVKRRQNRQR

SEQ ID NO: 17537 - protein, 266 aa, Mycobacterium bovis AF2122/97
MTDRDRLRPPLDERSLRDQLIGAGSGWRQLDVVAQTGSTNADLLARAASGADIDGVVLIAEHQTAGRGRHGRGWAATARAQIILSVGVRVVDVPVQAWGWLSLAAGLAVLDSVAPLIAVPPAETGLKWPNDVLARGGKLAGILAEVAQPFVVLGVGLNVTQAPEEVDPDATSLLDLGVAAPDRNRIASRLLRELEARIIQWRNANPQLAANYRARSLTIGSRVRVELPGGQDVVGIARDIDDQGRLCLDVGGRTVVVSAGDVVHLR

SEQ ID NO: 17538 - protein, 376 aa, Photobacterium sp. SKA34
MTDKFIKSKAAIAWGPNQPLSVEEVDVMLPRAGEVLVRIVATGVCHTDAFTLSGDDPEGIFPAILGHEGGGIVEMIGEGVTDLQVGDHVIPLYTAECGKCKYCLSGKTNLCQAVRETQGKGLMPDGTTRFYKDGQPIFHYMGCSTFSEYTVLPEISLAKISKEAPLEEVCLLGCGVTTGMGAVLNTAKVEEGSTVAVFGLGGIGLAAIIGATMAKASRIIAVDINEEKFELARKLGATDCINPMKFDKPIQEVIVEMTDGGVDYSFECIGNVNVMRSALECCHKGWGESVIIGVAGAGQEISTRPFQLVTGRVWRGSAFGGVKGRSELPGIVDRYMAGEFQLDDFISFNMGLDKINEAFDLLHEGKSIRTIIHFDK

SEQ ID NO: 17539 - protein, 392 aa, Corynebacterium efficiens YS-314
MKALTWQGKRKVSVETVPDPILKAENDAIIQVTSTGICGSDLHLYEVLAPFMDEGDIIGHEPMGRVVEAGPASNLKEGDRVVIPFNISCGHCWMCKRGLFSQCEVTQVREYGSGASLLGYSRLYGSVPGGQAEYLRVPHADFGPIKVGDELPDHRYLFLSDVLPTAWQAVKYADVGEGDTLAVYGLGPIGQMCARIGRHLGARVFGIEPVPERRAMAARHGIEVFDLGDDTHDHIRDLTDGRGPDAVVDAVGMEAHGSPVGKLAHNAMSLLPDAAARKMMEHGGLDRLGALHGSIDLVRRGGTVSLSGVYGGEASPMPMLTLFDKQIQMRMGQCNVKSWIDDLLPLVEDPADPLGVDDLTTHRVSLDEAPAHYEKFQKKEDGCIKVVLDPTL

SEQ ID NO: 17540 - protein, 473 aa, Clostridium acetobutylicum
MQKTKMIFTVGPASETEEIVTAFIKAGMNASRHNFSHGDHAEHGGRIALVKKVRAKLNKPVAICLDTKGPEIRTGDFNPSKLELQKGSKFTIVCGEEIVGDATKCSISYKDLYKDVKPGNTILIDDGLVGLTVEAIEGTNVICTVANTGLVGSHKGVNVPNVSIQLPAMTEKDKSDLIFGCKEEIDMVSASFIRKPEDVLAIRKVLNENGGENIQIFSKIENQEGVDNIDAIIEVSDGIMVARGDMGVEIPIQRVPLIQKMIIKKCNAVGKPVITATQMLDSMMRNPRPTRAEASDIANAIFDGTDAIMLSGESANGSYPIEAVTTMAKIAQEAENEINYDKFLAERKGNEKKNTSDVISLGTCTAAADLEASAIITATQTGSTARTVSKYRPKAPVIAVTPSEKVARKLAMSWGVHPIISDKFGSTDELISTSVDKALEAGYVQKGDLVVVAAGVPTNVSGTTNMLKVQVVE

SEQ ID NO: 17541 - protein, 399 aa, Leuconostoc mesenteroides subsp. mesenteroides ATCC 8293
MKGTPLMTKNINKNVHNTGLSGIRLVSNFIKKPVNEVIQLTVGEIDLPTPFATKQAGIKAIEQDHTKYTDNMGILALRRIITEYAQEFYSEPYNPVTEVLVTVGASEGIDLAIRALVNPGDEVILVSPGYTAYTQAVTLAGGVPVVVDTRSSNFRLLPNQLEEVISEKSKLVILNYPNNPSGVVLSSQELVELANVIKRHDLYVLTDDVYNRLVYDQDFAPSIASVPDMKERTLVLNGLSKSHSMTGWRIGYLLGPECLIHELYKIHQTDVGCASSISQEAAMTALTVDRDNPSEIVPIFRERRDYVLKRLDEIGISYIKPEGTFYVFANIEKFGMTSLDFVKFLIETVDLAVVHGSAFTEFGEGFIRISYAMDLSILKEALDRFQAAVAKLNNQKSLS

SEQ ID NO: 17542 - protein, 143 aa, Arabidopsis thaliana
  misc_feature (68)..(68): Xaa can be any naturally occurring amino acid
  misc_feature (81)..(81): Xaa can be any naturally occurring amino acid
  misc_feature (107)..(107): Xaa can be any naturally occurring amino acid
  misc_feature (114)..(115): Xaa can be any naturally occurring amino acid
  misc_feature (117)..(118): Xaa can be any naturally occurring amino acid
  misc_feature (121)..(121): Xaa can be any naturally occurring amino acid
  misc_feature (128)..(128): Xaa can be any naturally occurring amino acid
  misc_feature (130)..(130): Xaa can be any naturally occurring amino acid
  misc_feature (132)..(132): Xaa can be any naturally occurring amino acid
  misc_feature (135)..(135): Xaa can be any naturally occurring amino acid
  misc_feature (137)..(138): Xaa can be any naturally occurring amino acid
  misc_feature (140)..(141): Xaa can be any naturally occurring amino acid
  unsure (1)..(143): unsure at all Xaa locations
MASSMLSSTAVVTSPAQATMVAPFTGLKSSASFPVTRKANNDITSITSNGGRVSCMKVWPPIGKKKFXTLSYLPDLSDVEXAKEVDYLLRNKWIPCVEFEFGARDFXYREHGNXXRXXIIXRYLANWXKXSXFGXTXXLXXFK

SEQ ID NO: 17543 - protein, 276 aa, Rhodopirellula baltica SH 1
MNLEMQLTGLTVIGGGQMARALVGGMLESGCLKASELTIVHKTKSTGEWWSSKYSECTTTTDTVEAVAGAKVVMLAVKPHIIAEVLAVKNSAGKSADWSGKLIVSIAAGIGLDKLIDGVGHDRVVRVMPNTPSLVGEGASGFCVSGGVSDDDVQLIETMLNSVGIAAQVTEPQMNGVTGVSGSGPAYVFLIIEALADGGVAAGLPRATALQLATQTVLGAAKMVRETGEHPGFLKDNVCSPGGTTIAAMSVLEQNAVRGAMIQAVQASANRSRELA

SEQ ID NO: 17544 - protein, 79 aa, Glycine max
DIALRIVAPGKGILAADESVGSMAKRLSQIGVENTEENRRLYRQVLFSADDRVKKCIGGVIFFHETLYQKDDNGVPFVR

SEQ ID NO: 17545 - protein, 303 aa, Mycobacterium tuberculosis H37Rv
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTEVVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 17546 - protein, 531 aa, Candidatus Kuenenia stuttgartiensis
MMSTNRQLHIDKLSGQFKGNITISRSFLENEIYVSTKKENLLNVCLYIKDIFNAVLSSMICNDERTLDKHFKIYYVFSLQREDTFLIVTIPVSEQQPEFPSITPQIPAAHWYEREIKDMFGLIPVGHPRPETLVLHGNFPENTYPLRKDFDIQTRIPHLESKLPFFRVEGEGVFEIPVGPIHAGVIEPGHFRFSAVGDSIFYLDAKLFFTHKGTEKIFETMPYTKALFLAERICGVCAASHATGYCQAIEKVAEIEIPPRARFIRTIVMELERIYNHIGDVGNICAGTAFLLGIAHGFRIREYLQQLNETITGNRYLRGMLAIGGVRFDINDDLEKHILSLLNHVKKDFKDLTKMMFKSSSLLDRLETTGRLSEEIARGLGVVGVAARASGIVQDTRVNHPYAAYEEVDFDIPVFHYEGDVLARIRVRVDEVYQSIYIIEQCFEKMRPGPLKTPIKELPPYKQALSYVESPRGENIYWIMTAPGNKLFRYKVRSPSFCNWPAIPFAVPGNIVPDFPLINKSFELCYSCTDL

SEQ ID NO: 17547 - protein, 834 aa, Oryza sativa (indica cultivar-group)
MSSMFLIILSCMLLLSNSGRTTTGAELGDTLGKGRNITDGERLVSAGGSFTLGFFSPASSSSSSTSRRYLGIWFSVSDDVVCWVANRDRPLTDTSGVLVITDAGSLLLLDGSGHVVWSSNTTTGGGASMAAQLLESGNLVVSDRGNGGAGAVVVWQSFDHPCDTLLPGMKIGKNLWTGAEWYLSSWRSSGDPSPGNYRYRTDTKGVPENVLWDGDGEVYRTGPWNGLWFSGIPEMGTYSDMFSYQLTVSPGEITFGYSANAGAPFSRLVVTGVGEVQRLVWEPSSRAWKNFFQGPRDLCDDYGKCGAFGLCDAGAASTSFCSCVEGFTPASPSPWKKMRDTSAGCRRDAALGCATDGFLAVRGVKLPDAHNATVDKRVTVEECRARCLANCSCVAYAPADIEGGGGGGAGSGCIIWADDLVDLRYVDGGQDLYVRLAKSELGKDGIRQRRPPAAVVIGASIASVVGVLLIILLVLLYVIRRRQRPRVSDDDAGVPAATAAVHARPNPALAAPSINLSSVKEATGNFYESNIIGRGGFGIVYQGKLPSGRKVAVKRLTQSLVTDKRKEDFIREVEMMSNTRHAYLVELLCYCQEGGEMILVYEYMENMSLDLYIFGEDRRLRASLNWVQRLDIIRGIAIGVEYLHNVKVIHRDLKPSNILLDDNWRPKVADFGTAKLFINDQTDPTLVLSAGYIAPEYAAQGNLTLKCDVYSFGVVLLEIISGKRNRTLPTFLRDTWESWKQHEIEDILDLGLIKPEPDLLLGLDRCIQIGLLCVQQSPDDRPTMNQVVSMLTKYSSQIAMPKNPMINSRCEPSVSQVVSDTEPASHDRPGPSLN

SEQ ID NO: 17548 - protein, 823 aa, Oryza sativa (indica cultivar-group)
MAKATTGICLVDVILFSFFLVAPRAFAAAAAVTDTLRGGRNITDGETLVSADGTFTLGFFSPGVSAKRYLGIWFTVSPDAVCWVANRDSPLNVTSGVLAISDAGSLVLLDGSGGGHVAWSSNSPYAASVEARLSNSGNLVVRDASGSTTTLWQSFDHPSNTLLPGMKMGKNLWTGAEWDLTSWRSPDDPSPGAYRRVLDTSGIPDVVLWQDGVERYRSGPWNGRWFSGNPEAATYTTNLITFQVTVSPGEISYGYVSKPGAPLTRSVVLDTGVVKRLVWEATSRTWQTYFQGPRDVCDAYAKCGAFGLCDANAPSTSFCGCLRGFSPTSPAAWAMKDASGGCRRNVPLRCGNTTTTDGFALVQGVKLPDTHNASVDTGITVEECRARCVANCSCLAYAAADIRGGGGGSGCVIWTGGIVDLRYVDQGQGLFLRLAESELDEGRSRKFMLWKTVIAAPISATIIMLVLLLAIWCRRKHKISEGIPHNPATTVPSVDLQKVKAATGNFSQSHVIGQGGFGIVYKGQLPDGRMIAVKRLHQSTLTKKGKKDFTREVEVMARLRHGNLLRLLAYCSEGSERVLIYDYMSNRSLDLYIFGDSGLRLMLNWRKRLGIIHGIANGVAYLHEGSGECVIHRDLKPPNVLLDDSFRPKIADFGTAKLFTADQPEPSNLTVVVSPGYASPEYAWRGEMTLKCDVYSFGVVLLETLSGQRNGPMYSLLPHAWELWEQGRVMSLLDATIGLPLSVSGPDHTEMEDELARCVQIGLLCVQDAPEERPAMSAVVAMLTSKSSRVDRPKRPGVHGGRSRPPLRESELLGATDIDDDLT

SEQ ID NO: 17549 - protein, 821 aa, Oryza sativa (indica cultivar-group)
MRSTRQSSNLLRLVAFFFLLSGQTSAAAAAGVADKLDKGQNLTDGQTLVSSGGGSYTLGFFSPGKSTKRYLGIWFTVSGDTVYWVANRDRPLDGKSGVLLLNDDGSQLVLLDGGSRRTVWSASFLAASAAVVQLLDSGNLVVRNGSGGDAYLWQSFDQPSDTLLPGMKMGKSLWSGQEWFITAWRSADDPSPGDYRRTLATDGLPELVLWRGGGGGGATKVYRTGPWNGRFFNGVPEASNYSDKFPLQVTSSAREVTYGYGSVATAGAAPLTRVVVNYTGVVERLVWDASSRAWQRFFQGPRDPCDSYARCGPFGLCDADAAATSFCGCVDGFTAASPSAWALRNTSGGCRRGVALDCAGGGGGSRTTDKFKVVRGVKLPDTRNASVDMGATAAECERRCLGNCSCVAYAAADINGGGCVIWTDDIVDLRYVDRGQDLYLRLAKSEFVETKRSLIVLVVPPVAATIAILLIAFGVWAIWCKKNHGILDVIPDNPSMGVASVNLATIKSITENFSENCLIGEGGFSTVYKGVQSDGRMVAVKRLKKSALTNKGKKDFAREVAVMAGLHHGSLLRLLAYCNEGNERILVYAYMKNKSLDNHIFGPLPRRANLHWRRRLDIIQAIAKGVAYLHEGPDGSVIHRDLKLSNILLDDELKPKIADFGTAKLFVADQSGQTLVVSQGYASPEYALRDEMTLKCDVYSFGVVLLETLSGVRNGSMQTLLPQAWRLWEQGNLMDLLDPAMARPAPDDAELLYDLERCIHIGLLCIQDMADDRPTMSEIVAMLTSRTSQMEQPKRPTLDSRAAMRPLRQSDVQGSTTTDLT

SEQ ID NO: 17550 - protein, 366 aa, Bacillus cereus ATCC 14579
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSAEEAISYSLSGANLRCTGVNWDLRKDEPYSIYDRFDFDIPVGSVGDAWDRYVCRMQEIEESLKIVEQAVQQFPKDGAVLAKVPKIIKAPKGEAFVRIESPRGEIGCYIASDGKKEPYRLKFRRPSFYNLQILPKLLKGENIANLITILGGVDIVLGEVDG

SEQ ID NO: 17551 - protein, 438 aa, Bacillus subtilis subsp. subtilis str. 168
MHTEDNGLKKEIGLLFALTLVIGTIIGSGVFMKPGAVLAYSGDSKMALFAWLLGGILTLAGGLTIAEIGTQIPKTGGLYTYLEEVYGEFWGFLCGWVQIIIYGPAIIGALGLYFGSLMANLFGWGSGLSKVIGIIAVLFLCVINIIGTKYGGFVQTLTTIGKLIPIACIIVFGLWKGDQHIFTAVNESISDMNFGAAILATLFAYDGWILLAALGGEMKNPEKLLPRAMTGGLLIVTAIYIFINFALLHILSANEIVTLGENATSTAATMLFGSIGGKLISVGIIVSIFGCLNGKVLSFPRVSFAMAERKQLPFAEKLSHVHPSFRTPWIAISFQIALALIMMLISNPDKLSEISIFMIYIFYVMAFFAVFILRKRAKGEKRAYSVPLYPFMPILAIAGSFFVLGSTLITDTMSCGLSILIGLAGLPVYYGMKKRKAS

SEQ ID NO: 17552 - protein, 412 aa, Glycine max
MELFATTMVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 17553 - protein, 572 aa, Wolbachia endosymbiont of Drosophila melanogaster
MHSGSQHLFDIIILLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMENNEIFISTTLLIVLGAAFITEQFHLSLALGAFVAGLLVAETEYRHSVEHAVLPFKDLFLGLFFMTVGMSINTELLLNKLPLITLLSIILTVLKTSIIYILCRFFGFKSAPAIQAGLLLSQGGEFAFILFRLADELNVLPSEIAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNHSLLKDLGSDKDE

SEQ ID NO: 17554 - protein, 315 aa, Brassica napus
  misc_feature (156)..(156): Xaa can be any naturally occurring amino acid
  misc_feature (196)..(196): Xaa can be any naturally occurring amino acid
  misc_feature (200)..(200): Xaa can be any naturally occurring amino acid
  misc_feature (237)..(237): Xaa can be any naturally occurring amino acid
  unsure (1)..(315): unsure at all Xaa locations
MTNKEKARERREKRMQEISLLRTIPYSGHQRWWSSENVVAVVTGSNRGIGLEIARQLASHGLTVVLTARNVDAGLEAVTSLRHQEGLKVDFHQLDVTDASSIKEFGRWIKQTFGGLDILVNNAGVNYNLGSDNSVEFAETVVSTNYHGTKNMIKAXIPLMRPSPQGARIVNVSSRLGRVYGRRNRLANVELRDQLXNPDXLTEDFIDRTVSTFINQVKDGTWESGGWPQTFTDYSIXKLAVNAYTRMIAKELLTRQEGEKIYVNSFCPGWVKTAMTGFAGNTSPEDAADTGVWLSLALSQEAVTGKFFAERREIN

SEQ ID NO: 17555 - protein, 135 aa, Zea mays
  misc_feature (122)..(122): Xaa can be any naturally occurring amino acid
  unsure (1)..(135): unsure at all Xaa locations
RGLWCPPRAGSTHPAGSYSAPFPFPAYHAGWRFAAARGPPDTMATEKLRIKAESNPTETRLSYVAVRQWPKCGCYNSKFPWTYSSKDTCYLLQAKVKVDPEGRGIVRSWISGATELVVFPKXGMRCTCDDTEGVD

SEQ ID NO: 17556 - protein, 148 aa, Brassica napus
  misc_feature (20)..(20): Xaa can be any naturally occurring amino acid
  unsure (1)..(148): unsure at all Xaa locations
MNTNSSYNFTFNNVLFSSSXSTSDPVGTRRLFLLKNVQVLELLIALFAFVAIHSLRQKKHYGLPVWPFLGMLPSLAFALKGNVYEWLSDVLCRQNGTFRFRGPWLSSLNSTITCDPRNIEHLLKNRFSVFPKGSYFRDNLRDLLGDGI

SEQ ID NO: 17557 - protein, 319 aa, Shewanella sp. ANA-3
MSDNWVRKREILGLLSSEHFVSGEELATQLGVSRAAVSKHVDALEDYGVAIYSVKGRGYKLANPISLIDSARLIQSIDNRCFYFDEIPSTNGFMLSHTGELKSGDLCVAEYQSAGRGRRGRTWVSPYGHHLYFSQFWSFPQGMAQAMGLSLVVACSLVEVLKSFGVDNIGVKWPNDIYLNYKKLAGILIEMSGQADSECQLIIGIGVNMAMSEDQGKGIDQPWSDLSALATMPNKTDLVIALQKQLKKDIQLFEREGLAAFKLRWQAADLFYGKEIRLLMGENHVEGICRGVDEQGAVLLETADGTQAYIGGEISLRPR

SEQ ID NO: 17558 - protein, 991 aa, Arabidopsis thaliana
MKLLLLLLLLLLLHISHSFTVAKPITELHALLSLKSSFTIDEHSPLLTSWNLSTTFCSWTGVTCDVSLRHVTSLDLSGLNLSGTLSSDVAHLPLLQNLSLAANQISGPIPPQISNLYELRHLNLSNNVFNGSFPDELSSGLVNLRVLDLYNNNLTGDLPVSLTNLTQLRHLHLGGNYFSGKIPATYGTWPVLEYLAVSGNELTGKIPPEIGNLTTLRELYIGYYNAFENGLPPEIGNLSELVRFDAANCGLTGEIPPEIGKLQKLDTLFLQVNAFTGTITQELGLISSLKSMDLSNNMFTGEIPTSFSQLKNLTLLNLFRNKLYGAIPEFIGEMPELEVLQLWENNFTGSIPQKLGENGRLVILDLSSNKLTGTLPPNMCSGNRLMTLITLGNFLFGSIPDSLGKCESLTRIRMGENFLNGSIPKELFGLPKLSQVELQDNYLTGELPISGGGVSGDLGQISLSNNQLSGSLPAAIGNLSGVQKLLLDGNKFSGSIPPEIGRLQQLSKLDFSHNLFSGRIAPEISRCKLLTFVDLSRNELSGDIPNELTGMKILNYLNLSRNHLVGSIPVTIASMQSLTSVDFSYNNLSGLVPSTGQFSYFNYTSFVGNSHLCGPYLGPCGKGTHQSHVKPLSATTKLLLVLGLLFCSMVFAIVAIIKARSLRNASEAKAWRLTAFQRLDFTCDDVLDSLKEDNIIGKGGAGIVYKGTMPKGDLVAVKRLATMSHGSSHDHGFNAEIQTLGRIRHRHIVRLLGFCSNHETNLLVYEYMPNGSLGEVLHGKKGGHLHWNTRYKIALEAAKGLCYLHHDCSPLIVHRDVKSNNILLDSNFEAHVADFGLAKFLQDSGTSECMSAIAGSYGYIAPAEYAYTLKVDEKSDVYSFGVVLLELITGKKPVGEFGDGVDIVQWVRSMTDSNKDCVLKVIDLRLSSVPVHEVTHVFYVALLCVEEQAVERPTMREVVQILTEIPKIPLSKQQAAESDVTEKAPAINESP

SEQ ID NO: 17559 - protein, 819 aa, Haemophilus influenzae R2866
MDNFDSPFQYNRPEMTVEAIKKSIVYKLIFLIGRSPREASQRDWLNATLHAVRDLVTEGWITTARQTRAEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHDSLENLADKVAIHLNDTHPALAIPELMRILVDDEGFEWKKAWEMTRNIFSYTCHTLMSEALETWPVEMMAKILPRHLQMIFEINDHFLEYVRTYVTTDNDFIRRVSLIEEGYQRKVRMGWLSVVGSHKINGVAEIHSDLMVTSTFADFARIFPERFTNVTNGITPRRWLAVANSQLAALFDKYIGSEWRCDLSQIEKLKPFAQEKAFKEAVADIKFANKVKLAEYVKRELGGELDPHALFDVQVKRIHEYKRQMLNVLHIIARYNEMLVNPEKDWQPRVFILAGKAASAYYAAKQTIHLINDVANVINNDERLKGRLKVVFIPNYSVSLAQLIIPAADISEQISLAGTEASGTSNMKFALNGALTLGTLDGANVEILENVGEDNIFIFGNTVEQVEQLRREGYRSFEYYQNDAQLRTVVDQIIEGKFSPEDPQRYHQLLQGLQYHDYYQAFADFRSYVETQKAVDEKYKQRDQWIESTIQNIVNMGFFSSDRTIKEYAERIWKVEPVQLGD

SEQ ID NO: 17560 - protein, 449 aa, Bacillus anthracis str. A2012
MISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 17561 - protein, 830 aa, Kluyveromyces lactis NRRL Y-1140
MPEEHKKLLDSSGTAADADDATATAILRRKKKQNMLLVDDAVNDDNSIIAINSNTMDLLQLFRGDTVLVKGKKRKDTVLIVMIDDELEDGVCRVNRVIRNNLRIRLGDLVTIHPCTDIKYASRISVLPIADTIEGLTGNLFDVYLKPYFVEAYRPVRKGDHFIVRGGMRQVEFKVVDVEPEEYGVVAQDTVIHSEGEPINREDEENNINEVGYDDIGGCRKQMAQIRELVELPLRHPQLFKAIGIKPPKGILMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNIVVIAATNRPNSIDPALRRFGRFDREVDIGVPDVTGRLEVLRIHTKNMKLADDVDLEKLAAETHGYVGADIASLCSEAAMQQIREKMDLIDLDEDEIDAEVLDSLGVTMDNFRFALGNSNPSALRETVVESVNVTWDDIGGLDEIKDELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDETGRLSILSAQLRNTPLEPGLDLKTIAQATQGFSGADLLYIVQRAAKFAIKDSIEAQKRAEVVKKEEGAEETEKVKTEEDVEMSDVQQEDPVPFITKEHFTEAMKTAKRSVTDTELRRYEAYAQQMKASRGQFGNFSFGDDSGAAATQAGAEGSGAAFGDAAGEDDDDLYS

SEQ ID NO: 17562 - protein, 226 aa, Candidatus Protochlamydia amoebophila UWE25
MVKLILMRHGQSQWNLANLFTGWVDIPLSFKGIEEAIEAGKQIKNYPIDLIFTSSLIRAQMTAMLAMSVHTSGKVPVILHTGEGRLEEWASIYSSESQSQTIPVIRAWELNERMYGELQGINKEEMAKKYGAEQVHIWRRSFDVPPPNGESLQMTAARTIPYFENTIVPHLKEKKNIFIAAHGNSLRSIIMKLDGLTTDQVVKLELATGVPVIYDFNHDEYIKQQK

SEQ ID NO: 17563 - protein, 515 aa, Yersinia pseudotuberculosis IP 32953
MSSTKKPLVLTILDGYGHREEQQDNAILNAKTPVMDVLWQQQPHTLIAASGLDVGLPDGQMGNSEVGHVNLGAGRIVYQDLTRLDKEIKEGDFFTNPTLTAAVDNAVKTGKAVHIMGLLSAGGVHSHEDHIMAMVELAAKRGATAIYLHAFLDGRDTPPRSAESSLKRFTAKFAELGNGRIASIIGRYYAMDRDNRWDRVQLAYDLLTQAKGEFTADNAVAGLQAAYARGENDEFVKPTVIQATGEADAAMNEGDTLIFMNFRADRARQITRTFVNADFDGFKRDKVVNFGDFIMLTEYAADIKVACAYPPASLTNTFGEWLMKHDKTQLRISETEKYAHVTFFYNGGVEEPFKGEDRILINSPKVATYDLQPEMSSAELTEKLVSAIGSGKYDVIICNYPNGDMVGHTGDYDAAVKAVETLDNCIEQVVAAVKAADGQLLITADHGNAEQMRDPATGQAHTAHTSLPVPLIYVGNKAVKAVEGGKLSDIAPTMLSLMEMEIPQEMTGKPLFIVE

SEQ ID NO: 17564 - protein, 248 aa, Nostoc punctiforme PCC 73102
MTKLPVRKIVIAGNWKMFKTQAETQEFLQGFLPHLEETPQGREVILCPPFTDLSVLSKTLHGSLIQLGAQNIHWEEFGAYTGEISGPMLTESGVRFVIVGHSERRQYFGETDATVNLRLRTAQRFGLTPILCVGETKQQRDAGETESLIALQLDKGLVDIDQNNLVIAYEPIWAIGTGETCEAVEANRIIGLIRSQLSNPNVSIQYGGSVKPNNIDEIMAQPEIDGVLVGGASLEPESFARIVNFHLV

SEQ ID NO: 17565 - protein, 306 aa, Arabidopsis thaliana
MIGIGRTLTSSSPSKIILEDLPPGIYRYGTEIFTSVPRKTFHHIKFLRLDSAQSSRILKPVPLRSSSIKDSQVNVEDEEIEASNKTVRVRFQLRKECVFGEHFFIVGDDPVFGGLWDPETALPLNWSDGNVWTVDLDLPVGRLVEFKLLLKAQTGEILWQPGPNRALETWETNKTIRICEDWDNADLQMMIEEDFVPYTNISSIGSEDEDEVLGSVQQNSSVVAVENAGYVSDESAQNSSFSIQSEKTMEPSNGALTAREVIKEAMFTEEESPVLVPGLIPLSDLDNEQVEVINEGKAETFPEVIT

SEQ ID NO: 17566 - protein, 276 aa, Clostridium acetobutylicum
MKNTTETFKNSKFKKEKLVMLTAYDYSTAKIIDSCDINGILVGDSLGMVCLGYENTLSVTMEDMIHHTKAVVRGAKSTLIVADLPFMSYQTSVYDAVFNAGRLVKEAGATAIKLEGGALVCDRIKAIVDAQIPVMGHIGLTPQSVNAFGGFKIQGKNISKAKELIEDAKKIEAAGAFAITLEGIPEKLAKIITESITIPTIGIGAGKHCDGQILVYQDMLGMFSDLAPKFVKRYGNIGDDMKEAFNSYAKEVREGTFPDEAHSFKIDQSIIDEITK

SEQ ID NO: 17567 - protein, 266 aa, Yersinia pseudotuberculosis IP 32953
MMKTTTMSQLRQWKQEKRKFATLTAYDASFAQLFAEQGIQVLLVGDSLGMTLQGFDSTLPVTVADVAYHTRAVRRGAPHCLLLADMPFMSYATPELAFTHAAELMRAGANMVKLEGGSWLCDTIRMLAERAVPVCGHLGLTPQSVNIFGGYKVQGREEVAANQLLQDAIALEQAGAQLLVLECVPVELAQRVTEELTIPVIGIGAGNVTDGQILVMHDALGITGGHTPKFSKNFLAHSAGDIRAAIKLYIEEVEGGIYPAEEHTFQ

SEQ ID NO: 17568 - protein, 413 aa, Ralstonia solanacearum
MKTIQKSAKLNNVCYDIRGPVLEKAKQMEEEGHQIIKLNIGNLAPFGFDAPEEIQQDMIRNLPNSAGYSDSKGIFAARKAVMHYTQQQGIKNVTLDDIYLGNGASELIALATNALLDAGDELLLPAPDYPLWTAMTSLSGGTPVHYLCDESNGWMPDLDDIRAKITPNTKGIVVINPNNPTGALYSDALLHDIIAIAREHGLVIFADEVYDKVLFDDNRHTAMASLSEDVLTVTFNSLSKSYRSCGYRAGWMVVSGDKRPAKDYIEGLNMLSSMRLCANVPGQWAIQTALGGYQSINDLVAPGGRMRRQRDLAYELITAIPGVSCVKPKAALYMFPRLDPSVYPIDDDQTFIRQLLEEERVLLVQGTGFNWHSPDHFRIVFLPHEDDLREAIGRIARFLERYRQRHGTGIRAA

SEQ ID NO: 17569 - protein, 797 aa, Salmonella typhimurium LT2
MSQPTFNKDQFQAALTRQWQRFGLLSASDMTPRQWWQAVSGALAELLSAQPVAQPTKGQRHVNYISMEFLIGRLTGNNLLNLGWYQDVSDVLKAHDINLTDLLEEEVDPALGNGGLGRLAACFLDSMATVGQSATGYGLNYQYGLFRQSFVEGKQMEAPDDWHRGSYPWFRHNEALDVQVGIGGKVTKEGRWEPGFVITGQAWDLPVLGYRNGVAQPLRLWQATHAHPFDLTKFNDGAFLRAEQQGIDAEKLTKVLYPNDNHTAGKKLRLMQQYFQCACSVADILRRHHLAGRKLHELADYEVIQLNDTHPTIAIPELLRVLIDEHQLSWDDAWAITSKTFAYTNHTLMPEALECWDEKLVKALLPRHMQIIKQINDRFKTLVDNTWPGDKQVWAKLAVVHDRQVRMANMCVVSGFAVNGVAALHSDLVVKDLFPEYHQLWPNKFHNVTNGITPRRWIKQCNPQLAALLDKTLKKEWANDLDQLINLEKYADDAKFRQQYRDIKRANKERLVKFIKARTGIEISSNAIFDIQIKRLHEYKRQHLNLLHILALYKEIRENPQADRVPRVFLFGAKAAPGYYLAKNIIFAINKVAEAINNDPAVGDKLKVVFLPDYCVSAAEMLIPAADISEQISTAGKEASGTGNMKLALNGALTVGTLDGANVEIAEKVGEENIFIFGHTVEEVKALKAKGYDPVKWRKKDKVLDAVLKELESGQYSDGDKHAFDQMLHSLGKQGGDPYLVMADFAAYVEAQKQVDALYRDQEAWTRAAILNTARCGMFSSDRSIRDYQARIWQAKR

SEQ ID NO: 17570 - protein, 264 aa, Salmonella enterica subsp. enterica serovar Typhi
MSKPTTIAVLQKCKQEKKRFATITAYDYSFAKLFADEGINVMLVGDSLGMTIQGHDSTLPVTVEDIAYHTRAVRRGAPNCLLLSDLPFMAYATPEQAFENAAIVMRAGANMVKIEGGAWLVDTVKMLTERAVPVCGHLGLTPQSVNIFGGYKIQGRGDAGQILLDDALALEAAGAQLLVLECVPVELAKRVTEALSIPVIGIGAGNVTDGQILVMHDAFGITGGHIPKFAKNFLAEAGDMRAAVRQYMAEVESGVYPGEEHSFH

SEQ ID NO: 17571 - protein, 477 aa, Glycine max
WSPIQCSVTNVSEEVEQSQSVSSSERHLEPNRLEAKPKLKALHWDKVRATSDRATVWDQIKSSSFQLNEDMMESLFGCKATNFTPKEPPRKKSVLPSVDQENRVLDPKKSQNIAILLRALNVTRDEVSEALLDGNPEGLGTELLETLVKMAPTKEEEIKLKNYDGDLSKLGAAERFLKAVLDIPFAFKRVEAMLYRANFDAEVNYLRKSFQTMEAASEEIKNSRLFLKLLEAVLRTGNRMNVGTNRGDAKAFKLDTLLKLVDIKGTDGKTTLLHFVVQEIIRSEGAGAESANDNVKMDSKFNEDEFKKQGLRVVAGLSRDLSDVKKAAGMDSDVLSSYLSKLETGLDKVRLVLQYEKPDMQGNFFNSTKLFLKYAEDEIVRIKADERKALYLVKEVTEYFHGNATKEEAHPLRIFMIVRDFLNILDLVCKEVEKMHDRIVGGSGRSFRIPPNASLPVLNRYNHPKQDRSSDEESSSP

SEQ ID NO: 17572 - protein, 170 aa, Arabidopsis thaliana
  misc_feature (102)..(102): Xaa can be any naturally occurring amino acid
  misc_feature (106)..(106): Xaa can be any naturally occurring amino acid
  misc_feature (113)..(113): Xaa can be any naturally occurring amino acid
  misc_feature (116)..(116): Xaa can be any naturally occurring amino acid
  misc_feature (119)..(120): Xaa can be any naturally occurring amino acid
  misc_feature (128)..(128): Xaa can be any naturally occurring amino acid
  misc_feature (134)..(134): Xaa can be any naturally occurring amino acid
  misc_feature (140)..(140): Xaa can be any naturally occurring amino acid
  misc_feature (146)..(147): Xaa can be any naturally occurring amino acid
  misc_feature (151)..(151): Xaa can be any naturally occurring amino acid
  misc_feature (154)..(155): Xaa can be any naturally occurring amino acid
  misc_feature (158)..(158): Xaa can be any naturally occurring amino acid
  misc_feature (160)..(161): Xaa can be any naturally occurring amino acid
  misc_feature (163)..(163): Xaa can be any naturally occurring amino acid
  misc_feature (166)..(166): Xaa can be any naturally occurring amino acid
  unsure (1)..(170): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELXHGFXYREHGNXSRXTMXXRYWTILGXSIFSGXTDSVKXLRKFKXXKRGXPGXXIRXIXXEXTRXGHDF

SEQ ID NO: 17573 - protein, 86 aa, Oryza sativa (indica cultivar-group)
MAGAAKASWMVAMSVGAVEALKDQGGLCRWNYALRSIHKAAKANAAGVSQGKKLPASAAAVAERRRAEKAEEGLRTIMYLSCWGPN

SEQ ID NO: 17574 - protein, 131 aa, Brassica napus
PARPQRQILSVLHSDNPTVLNVLVDVSNVERQVLAENYEVGKAVAFGQRLSNLKDVFTLDGYRMFFRGPVQTTLPPIPRKPTRLCASFDDQIKDLEIEASRGKSEINQCMRRKTGAEENLEELESKIRTLK

SEQ ID NO: 17575 - protein, 367 aa, Photobacterium sp. SKA34
MALSSAKEIIDDIRQGKMVILMDDEDRENEGDLIIASEKITPEAINFMATYGRGLICLTLSKARCQKLNLPLMVQENTEQFGTPFTVSIEAAEGVTTGISAADRSRTVQAAVAANATAADIVMPGHIFPLMAQEGGVLTRAGHTEAGCDVARLAGLEPSSVIVEILNEDGTMARRPQLEVFAEKHGLKLGTIADLIEYRNNNETTIERVAECRLPTEFGEFDMITYRDKIDNEVHYALRKGDIKAGEETLVRVHLQDTFKDILQSGATQWTLPAAMKRISEENGVLVILSKQEPTDAMIHKVKNIAAEEAGQPKVKVTQKDPSRQVGVGSQILSDLGVSKMRLLSSSTQRYHSLSGFGLEVVEYICD

SEQ ID NO: 17576 - protein, 648 aa, Shewanella sp. ANA-3
MEHGFLIQVLLMLLIAIVAIALLRRIGLPAILAYLLTGVVSGPSGFHWFTQQQMQSVAELGVVLLMFTLGLEFSVPRLWAMRRTVFGLGSAQVIVTTVLTMLVALACGLNGIESLVIGAAIALSSTAIVLKLLNEQGWLRRRHGELSVSVLLFQDLAVVPLLILLPLLGQNDEPLMLATITLALLKGILAFFLLMALGKWALPRLFDEVARSRSNELFVLSTLVVALVTGAFTQWLGLSMALGAFMAGMLLGESQYRRQLEADIRPFRDLLMGLFFISIGMMLDFALVMQFWWQILLILLAVVVGKALIVHGLLRLVGEPFRIAISTALSLAQVGEFSFVVLALAVSYGLLSNQLSTMLVMVAVLSMSIAPWLVRHSVDIAKWLLGIRQSGHVDEVVPIITEDHDLVVILGYGRVGQTIARFLKTEAVPYLVLDLDPTRVSEARRAGEPIYFGDVCKRAILKQVGIKHAKMIVITFCETRSLEEALPLCKQLAPDAKILVRTRDDSELDMLQKAGANQVIPETLEGSLMLVSQVLHQCGVPLARILKRLESERRNHYQFLHGFFSGTETDFTLESLHAVLLHRGADAVGKQVADIDWELLRVELRAIRRSGAEVEHPAQDWVFRAGDILLIVGKPRRLEKAEAKLLHG

SEQ ID NO: 17577 - protein, 115 aa, Wolbachia endosymbiont of Drosophila ananassae
MIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 17578 - protein, 376 aa, Glycine max
  misc_feature (252)..(252): Xaa can be any naturally occurring amino acid
  misc_feature (334)..(334): Xaa can be any naturally occurring amino acid
  unsure (1)..(376): unsure at all Xaa locations
MTTAEDRFVFLVEWYDAAASLVRTYNLTYYPKDKTIEMFDLKNKKLFLKRCEYPGVSLNDLYLGSIVTVYSRQLKIVDYADTFTRKNFETTRERTFGMIKPDCYQHIGKIIDIIEHSGFVIGNIKMARMTLNDAEEFYAEHKGKPFYPELTNFICSDFVVGMELVAEGAIAKWRKLIGPTNCQVARVEAPGSLRALFGTEGVRNACHGSDAPTSAQRELDFFFGDKCKLKPTAFLNNCTCCVIKPHIVSEAXCGKVIDHILSEGFEVSALQMFFIDKATSEEFLEIYKGVLPEFSGIANHLTTGPCIALEVRQENAVESFREICGPHDPEVARXLRKNSIRAIYGFDRIKNAVHCTDLSEDGPLEVEYFFTILNHK

SEQ ID NO: 17579 - protein, 226 aa, Candidatus Protochlamydia amoebophila UWE25
MDQIDPEGVTLISASEQTLGRGRFKRRWQSPINLNIYATFCFYIDSNRSDFGHLPQLLALAAIQVLEDLNFHPALKWPNDILLNGKKVAGILCETMMLEQKRYMINGIGLNVNMPTELLNKIDRPATSLFKERGHEFDLNILLKQLDVKFTSYLSHFLKHGFDAFFPSFQLRSTFKQGQFIQFNHNQTLLEGIFESLHPDGSVQIKLLDGTSKKFYSGEFMFEDFI

SEQ ID NO: 17580 - protein, 348 aa, Zea mays
MEVAAVACRAGLLARARPSSRARTWAVAVGPAPSAARRRLLVASLGVGEPLPAQSLGEEAVALEVGEDEDDLNSIVSVENLPPAAAHVPEARRTVRVRFVLRKQCAFGQQFLVAGDDAALGLWDPAKAISLVWSEGHVWTANTDLPANRSIEFKFLLQDASGHAHWQHGANRTLRITTETPNTVVVHEDWDHGNKQKVSEEEELSIGEDVMFPEDLAGTDGANAMPADNPEKHQNVETDSDRSAAVVADAPPQQEMVAANGTGQPQLVVDEHKTILEEVPGEENGTLSAADYAGNGSIDDDDDTPLYQGGDVLPNRPTSIFENDLAWAGKAMQQLLRVLGFQIGTTRT

SEQ ID NO: 17581 - protein, 293 aa, Deinococcus radiodurans
MQPESASPQLASPARVKRSLPDLTHPELTSSGAPLVMVTAYDYPGARHAEAAGVDLILVGDSLGNVVLGYDSTAPVTLADMIHHGKAVRRGAPNTFLVVDLPFGTYHAGVTDAMRHAVRVIQETGADAVKMEGSTPEVLDVVRVLSRNGVPVMGHVGLMPQTAAAQGGLRVQGKDDDSARRTLEGAVALQEAGAFAVVLEAIPARLARLISERLSVATIGIGAGVHCDGQVLVYHDLLGLYEGEEKKIAKRYADLGREAREAIAHYAAEVRAREFPSKDNSFVMKDEVLDKLY

SEQ ID NO: 17582 - protein, 178 aa, Glycine max
  misc_feature (53)..(53): Xaa can be any naturally occurring amino acid
  misc_feature (101)..(101): Xaa can be any naturally occurring amino acid
  misc_feature (125)..(125): Xaa can be any naturally occurring amino acid
  unsure (1)..(178): unsure at all Xaa locations
MASSTISSPTVTTVNRAGAGMDAPFTGLKAMAGFLTTKTNNDITSIASTGGRXHCMQVWPPPGNKNIETLSYLPHLDDAQLAKEGQHLLKKGWIPCLELQXEHSCRYREHNRSPRYYDGRYCTMXNLPMFGCTDAYHALNELRDADTAYPNGFIRIIRCNIVEQVQCINFIAYKPPDF

SEQ ID NO: 17583 - protein, 518 aa, Magnetococcus sp. MC-1
MTELESAPVKLFRDPVHDMIELRLHSGPMEESPPWAWGDTLLLALIDTPPLQRLRRIRQLGPAAKVYPSAEHSRFSHALGTMHLATRMIAEVAQGHPGVISPLLGLQIRVAALIHDLGHGPYSHVFEHVSPTPIAHELRGIALLEHDSPVRRAIHHFCEKHHLDHARFTHELALILGSGEATGLLGLARQFISSQLDADRMDYLQRDAHFTGVRYGRFDAAWLMRSLRLKQTASGPLLCVEIAKGPAALESYIAARDDMYRQVYDHKAVRAFEALLIHIIRTLLALLDAHQPLPSGTPMELVRYLQQERQAEAQEPALFQALDDAVLDYAIGYWSRLTLTQQDTPLLWELRRKSGMFQHRLAPYKRLLWHMDPEQRLWEEGDEGVQDQDGATDVILDADAAQALQHFLHSHGDHPLEIVEPESGRQWNVPLSLLVHVDSLHRAPYAHMQYAVGSRGSIPVLEGNGRLRWAEQASERINFLGHCRRKQARVFVDRRALAGVMALIHQHFQHPLLKLWER

SEQ ID NO: 17584 - protein, 255 aa, Klebsiella pneumoniae
MRHPLVMGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAVFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 17585 - protein, 400 aa, Oryza sativa (japonica cultivar-group)
MEQQLLLPTDMEQQLFPTDGVSFCITGASFRRSCLNFSNGGWLSLALFAMVGAICFYTGNLIDRCMCADRCVRSYPDIGYLAFGAYGWTTIGLVMYVELYLVAISFLILEGDNLDKLLPSTVVEILGYQVHGKQLFVLATAAVILPMTWLKNLSMLTYVSVVGLISGADGVWAGVPDKGFHMAGNNLLNLSGLPTALTLYFVCFAGHGVFPTVYSSMKSKKDFPKVLLISSVLCSLNYAVTVVLRYLIYGEDVQSQVTQNLPTGKLYTRFAILTTLITPLANYTLVIQPVTTAIEEKLSATTDVENNWLTRVLTSIAVVISTVVLACTVPFFGYLMLFIGSSLNVTVAVLVPCLSYLKIYMSRGGVGCFERTMIVGILVIGVCVNVVGTYTSLHQIIGTF

SEQ ID NO: 17586 - protein, 426 aa, Yersinia pseudotuberculosis IP 32953
MSKSENLYAQAQQLIPGGVNSPVRAFTGVGGIPLFIERADGAYLFDVDGKAYIDYVGSWGPMILGHNHPAIRQAVIEAVERGLSFGAPTEMEVKMAQLVTDLVPTMDMVRMVNSGTEATMSAIRLARGYTGRDKIIKFEGCYHGHADCLLVKAGSGALTLGQPNSPGVPADFAKHTLTCTYNDLASVRQAFEQYPQEVACIIVEPVAGNMNCIPPLPEFLPGLRALCDEFGALLIIDEVMTGFRVALAGAQDYYHVIPDLTCLGKIIGGGMPVGAFGGRREVMNALAPTGPVYQAGTLSGNPIAMAAGFACLTEISQVGVYETLTELTDSLATGLRHAAKEENIPLVVNHVGGMFGLFFTNADTVTCYQDVMNCDVERFKRFFHLMLEEGVYLAPSAFEAGFMSLAHSNEDIQKTVNAARRCFAKL

SEQ ID NO: 17587 - protein, 265 aa, Klebsiella pneumoniae
  misc_feature (219)..(219): Xaa can be any naturally occurring amino acid
  unsure (1)..(265): unsure at all Xaa locations
MMTPIWLGTSWKMNKPLSQAMAWCETLAARMPEGCHPAIQPFVIPSFTAIQPVSHFLQTHQLPLLTGAQNMHEADQGAWTGEISAAMLAETGATLVELGHSERRAAFNESDAAINRKVHSALGHGLRPLICIGDSAEEKRWQVSRESVVRQMKIALYGLSHQQALRTLIAYEPVWAIGEHGTPASPQEAGVIHQALRQALCERFGHETGTRIPLLYGGXVTLQNAVELLRQQEINGLFIGRAAWDAQGYCDIVQRVTQEFILQAQ

SEQ ID NO: 17588 - protein, 94 aa, Zea mays
MAAAAAATKASSWMVAMSVGAVEALKDQGGLCRWNYALRSVYRTAKANVRSGSRSFAAQRDKDLAPAAEKGRQDKAAAEEGLRTVMYLSCWGPN

SEQ ID NO: 17589 - protein, 928 aa, Cryptococcus neoformans var. neoformans JEC21
MPVRPSRSNSDSSIPYVTNSSLASSYRPTSIRERETSPINTFNQLSLERSLTPPKAPRLAPQVTHDPKYTRHKRTQVLRNTSGTPSAASTDDEDDQDERGRGGIDEEVKSWLELRDGQGWKRIGKYKSVNKRGEIKNDLTNQLPPEILIQIFRYLPGNKDLLSVLLVSRFWCLCAFSLLWYKPTLPTITQLASIVRVIHSPTRSLPYANAIRRLPLIQLGPTLTDELFTSLLVCSRLERLNISGADKLTSGALRNVIACMPNLVSLDLTGVINTDDAVLVIVGETCQKLQAINLSECRLVGDEGVLALAKESRALRRIKFEKCHRITQKSLIPLIRACPLVLEYDFQDVISLSSSVLHTVFLHASHLREIRVNGCVSLNENCIPNLLDLSEMQDDGVAKVSEDVGIKIEPAEGVTMWRPVTTTFEYLRVVDMTGCTDLGDKAVDNLITNAPKLRQLTLNKCPALTDKSLESIGKLGKHLHNLHLGHVSLITDDGVINLARSCTRLRYLDLACCTLLTDACVAEIGENMPKLKRFGLVKVTNITDEAIYSLVRKHTSLERVHLSYCDQLSVKAIAYLLNKLAHIKHLSLTGVSSFKVPELQEFCRPPPDFFNDHQRAAFCVFSGSRVVDLRDYLNNHYLPSMEVDTSEDSGHDGAASSTSSLTIPRAAPTPDHSSISNSVAQHSNLVYRQSLSNLNDVWEDAPSPISPTPMSRPQPPHILTASIQYQSVQPGEGAPFPIASTSTSPPTFTSSSSARLTPNPTSAAPSYFNISSSPSLHNRFAYGGTTLPTHLDYLVPPSQESSRSSSMSSNGDRFPFIPHQVLSERSRGPDAPSRRDRPSGPRVPSDSYNVSPSYANEFASYWSREGRLPPASDAEVGMARTHIAEEPMTQVPNLSHRPGANGSSSSSAGAQREGGRGSRWLQRFGNGR

SEQ ID NO: 17590 - protein, 637 aa, Musa balbisiana
MSSPPPSPSATPPSTSPPPPSSLSPPPASNSPPPAPNAPPPPTPPSPPPASSPPPTPPPPADVPPPPVVTSPPPPDPPPPSVSPPPPALSPPPASTPPPPPSASPPPAAAPPPPPFATPPPTNSPPPPPSATPPPTISPPPPGSQSPPARAPSNSTGGTPPAPPKPPSPPSPSPSASHRAPADPISPSSNGSGIPTSDVGQKSGQSSGDGGMKAGPAVAVALVTAVVLLGLVGAITWIVRRKRRKPPANYESGFAMSSPYQSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDNQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDRRLEDAYDDTEMFRMIEAAAACTRHSAAMRPRMGKVVRVLDSLSDVDLHNGVKPGQSEVFNVGQTADIRLFQRLAFGSQEFSSEYSQSNWSRQSDL

SEQ ID NO: 17591 - protein, 541 aa, Campylobacter jejuni subsp. jejuni NCTC 11168
MDNFLEIFLITVAIAIVLNVIFKKFEIPTIIGYIAAGEIISEIYHLSGKGEITHIAEFGIVFLMFTIGLEFSFKHLMAMKQEVFLNGSLQMLTCGFVFMLLAIGILGLGDKSATIVGFALALSSTAVVLKILNDNGDINEQYGRKALGILLFQDIAVIPLLLLVDIFSSNNQNIEKLLFTSLISALILITLLFFIGKYLVDRIFRLIIHTSSQEIFISTVLFMVIGASFLANYFGFSYSLGAFIAGALIAETKYKHKIEADLIPFRDLLLGLFFITVGMQIQLDVVAQNWFLIIVLTLLVMALKFGIVFGFLFLYTKKRVALKTAFAIAQIGEFALAIFSLLQAKNMLDIKTSQILIVVSILTMIITPFILNNIRKITNVVEDIALNTNAVQNIDSNIKLKNHLVVFGYGRLGQEVVQKIKNTGVPYLVLESDLNLVELGVSRGENVVFANAAQEETLKIANIEECAVAIITVTNEAKLEILCQVLANYPKPIDTIIHVNGTLKKMLFSSIDENIRIIRSEKVIARNLVQEALECRIHKNT

SEQ ID NO: 17592 - protein, 468 aa, Desulfovibrio vulgaris subsp. vulgaris str. Hildenborough
METFANGMTLDVTVDALAPGGKAVCRHEGRVIFVDRGLPGQQLHVRLTTVRKRFAEAECLAVVTHTADECDPFCPHFGDCGGCTWQNLPYPAQLAWKERFVRDSLQRIGRIEAPNVLPTLPSPLQQGFRNKMEFAFTTDDREMLHLGLRRRGGHEVVDVTSCGLQTATTCRVVTTARDIARASGLPGWDDAAHRGFWRFLVVREPARGGQCLVQCITAPHPEAEHVARAFFTALRQAVPEVTGCVHSIRSQNSQVAYGDATVFTEGEIVLTEKLGAIELDFGHDTFLQTNTRATELLYGEVERMAGLSGREHVWDLYCGVGSIALWLAEHAATICGMEATPASVEAAQRNAQAAGCTHCDFVAGDVRALLRSRSKGKAQEPIPDVVVTDPPRAGMHPDVIDALLQTAPARIVYVSCDPATMARDVGLLMQRYTLHEARPVDLFPHTPHVETVVLLSNKEVDDTISTTV

SEQ ID NO: 17593 - protein, 480 aa, Photobacterium profundum SS9
MTESVVRENQLIKRTLDDLPQPKGWPLLGNFLQLQSKNLHQVLEQWCLEYGDTYKVDIAGLLFVVIADPVVVKDILRRRPKSFNRTASLERVFKELGIHGVLSANGESWKRQRRLIMPAFSKKSLASFFPLLEQTTERLRLRLVKKRGQDTLAIHDDLRRFTVDITTSLVFGHDTRLLEHDGDGLQKHLEVIFPQLNSRTRMPFPYWQYIKFKKDRKLDQALIEVEKYALKIVEQTRDELQFNPQLADAPETILQAMVAASDDDNRLTNEELFANILTLLLAGEDTTSNLIAWMLYFISQRPDIQCKINEEAEQIRLKHKGQINVQGLDELTYLEAVARETLRLKSTAPMISAETADQVTLLDGTELPAGTGLFLMTRLGGLNKEHFKDAEQFRPERWQEEAVAAEACPHKATSHFPFGGGARHCPGETLAFMETKMVIAMLCQQFDISQPESPPVVEEYAITMRPKNLQICLRLKPVGR

SEQ ID NO: 17594 - protein, 408 aa, Rubrivivax gelatinosus PM1
MQDQVIAASLGAPTLLLEPVGRNTAAALTLAALQAGSDGSDPVLVVSPADQTVTDPGAFASALRRAVEWAARGVIVVIGVKPQRPETGFGYIRLDTSDAHSRVAEFVEKPDAETATRYVDSGDYFWNAGLFVVRASDWLRAIESFRPDIAAATHAAWAARRVDGPFIRPDRALFEVIPAESVDYAVMEKCPKSDIDIRMVGLDAGWSDLGAWDAVWQLGHKDGAGNVSDGDAIIEDCRDTLVHATSRLVSVVGVDNVVVVETPDAILVADRGRSQDVRKIVSRLEGGGRSEHILHRRVHRPWGWYDSVDAGPRFQVKRILVKPGATLSLQMHHHRAEHWIVVSGTAEVTCGDSKRLLTENQSTYIPLGETHRLANPGSIPLEIIEVQSGSYLGEDDIVRFEDSYGRAK

SEQ ID NO: 17595 - protein, 390 aa, Pseudomonas aeruginosa PAO1
MATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPTAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLPRLQEAVERIARGLKNWRP

SEQ ID NO: 17596 - protein, 536 aa, Magnaporthe grisea 70-15
MSAIRMHRNACSASRLVARTSAPRRTVPFLSPSYARLASTQVPKLKDPSLFKQNVCYVNGAFVPAKSGATFAVADPTTGEHIGDAPEFDAADTEAAIAAAENAFKTYRLTTGRERSKLLRRWYDLMIANADDIATLITWENGKTIADAKGEVTYAANFFEWFSEEAPRVYGDTIQPTLAANRVVTRKEPVGVCSLITPWNFPAAMGTRKIGPALAAGCTVVCKAPAETPFTSLALAELAHRAGVPAGVVNFVTSHSNTKTVGEVLCTHQAVRKISFTGSTGVGKTLMQQAAGTLKKCSFELGGNAPFIVFDDADLDAAVDGAIACKFRSSGQTCVCANRIYVQRGIYDAFAERLAKRVKETFKIGSGFDPETTHGPLIHDRAVSKVASQVEDAVGKGAKLLAGGKRLPDLGPHFFAPTVLGDMTPEMSIAREETFGPIAGLFKFDTEAEVVKMANDTEVGLAGYFFSKDIHRAYRVAEALEVGMVGVNTGIISDVASPFGGVKESGFGREGSMYGIHEYQVTKTITFGGMGKELQG

SEQ ID NO: 17597 - protein, 465 aa, Salinibacter ruber DSM 13855
MRAGPPSFFVPTNQSFRRSMPTKTDVLEQIEAKGVDFLRLQFIDILGTVKNVSVPAHQAEKAFEEGIYFDGSSIEGFVRIQESDMRLDPDPDTFAVLPWRSQRGDDTVSARLICNIIDTSTGEPFVGDPRYVLQRAIDRAADMGFELNAGPEPEFFVFEKDENGRATTETHDAGGYFDLAPKDLAQEIRAEVIYTLEAMDFEVEASHHEVAQGQHEIDFKYDDALTTADNIATFRSVVRAIAELHDVHATFMPKPIAGINGSGMHTHLSLFEDGENVFHDGDDEFSLSDTAYDFLGGILEHAPALTAICNPTVNSYKRLVPGYEAPIYVAWSDVNRSALVRKPAARVPAASRIELRSPDPSSNPYLALATMLHAGLDGIEKGRSAPDPVRENIYEFTEADREARGIETLPSTLGQAVTALQKDDVVLDALGPHVSEKFTQAKTQEYTEFLASVSQWELDRYLETF

SEQ ID NO: 17598 - protein, 289 aa, Zea mays
TTFRQVLGQHAKRINLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 17599 - protein, 724 aa, Glycine max
  misc_feature (309)..(309): Xaa can be any naturally occurring amino acid
  unsure (1)..(724): unsure at all Xaa locations
MSGAVLVAVAAAIGNLLQGWDNATIAGSILYIKREFNLQSEPTIEGLIVAMSLIGATVVTTCSGPLSDLLGRRPMLIISSILYFVGSLVMLWSPNVYILLFARLLDGLGIGLAVTLVPLYISETAPPEIRGLLNTLPQFTGSAGMFFSYCMVFAISLTKAPNWRLMLGVLSIPSLIYFALTLFFLPESPRWLVSKGRMLEAKKVLQRLRGRQDVAGEMALLVEGLGVGGDTVIEEYIISPANEFSDAEQIKLYGTAEGQSWIAKPVTGQSSIGLVSRKGSMANQSALVDPLVKLFGSVHEKLPETGSRXSALFPHFGSMFSVGGNQPRNEDWDEESIAREGDDYVSDAADTDDSDDNLQSPLISRQATSAERDMPAPAQGSMRQGSLLQGEPAGNSGIGGGWQLAWKWSETEGVFKRIYLHQEGGPGSRRGSIISLPGCDAPTLTDGEIVQAAALVSQSALYNKELMHQQPVGPAMIHPSQTAAKGPSWSDLLEPGVKHALIVGVGIQILQQFSGINGVLYYTPQILEQAGVGYLLSNLGLGSTSASFLISSVTTLLMLPCIAVAMRLMDISGRRTLLLTTIPVLIVSLLILVIGSLVELDSTINAFISTSSVIVYFCCFVMGFGPIPNILCSEIFPTRVRGLCIAICALTFWICDIIVTYSLPVMLNSVGLGGVFGMYAVVCIIAWVFVFLKVPETKGMPLEVIIEFFSVGAKQAQVANNINT

SEQ ID NO: 17600 - protein, 443 aa, Leuconostoc mesenteroides subsp. mesenteroides ATCC 8293
MGNNEQKLNRGFGLTASLALVVGTIIGSGIFFKQGSVLESAGSTNAAMLAWIAGGLLTLASGISVAEIGSQMDKTGGIYIYIEKIYGKVWGFLAGWMQVVFYGPAMMGSIAAYFGILFVDLFGLSKSLAIPSAIIALSFVGLINSIPNRFSAGFQIITTTVKMLPIIALIIFGLFFGQHDAIGQTVAQVSQSGQGGFGVAVLATLFAYDGWVTLANISGEIKNPQKVLPKAIIFGILIVLVAYVGVSFGVYQSLPANTIVKLGQNTTLYMATNAFGIIGGRLLSIAVLISLLGTLNGKIVSFPRVLFAMANDGLFPFAKQFAKINMRSRTPNKSIWFMIFLGILMIVFTNPDRLTDIAIFTTFLFYILVFAGVFKLRKKDPFGEKRSFSMPLYPWIPIVAICGSLYVEISEIMHDLSGVIISIAIVAAGYPVYIFLSRRTNKE

SEQ ID NO: 17601 - protein, 815 aa, Salmonella typhimurium LT2
MNAPFTYASPTLSVEALKHSIAYKLMFTIGKDPVIANKHEWLNATLFAVRDRLVERWLRSNRAQLSQETRQVYYLSMEFLIGRTLSNALLSLGIYDDVKGALEAMGLDLEELIDEENDPGLGNGGLGRLAACFLDSLATLGLPGRGYGIRYDYGMFKQNIVDGRQKESPDYWLEYGNPWEFKRHNTRYKVLFGGRIQQEGKKARWIETEEILAVAYDQIIPGYDTDATNTLRLWNAQASSEINLGKFNQGDYFAAVEDKNHSENVSRVLYPDDSTYSGRELRLRQEYFLVSATVQDILHRHYQLHKTYENLADKIAIHLNDTHPVLSIPELMRLLIDEHKFSWDDAFEVCCQVFSYTNHTLMSEALETWPVDMLGKILPRHLQIIFEINDYFLKTVQEQYPNDTSLLGRASIIDESNGRRVRMAWLAVVVSHKVNGVSELHSNLMVQSLFADFAKIFPTRFCNVTNGVTPRRWLALANPPLSDVLDENIGRTWRTDLSQLSELKQHCDYPLVNHAVRQAKLENKKRLAVVIAQQLNVVVNPKALFDVQIKRIHEYKRQLMNVLHVITRYNRIKENPEADWVPRVNIFAGKAASAYYMAKHIIHLINDVAKVINNDPQIGDKLKVVFIPNYSVSLAQVIIPAADLSEQISLAGTEASGTSNMKFALNGALTIGTLDGANVEMQEHIGEENIFIFGNTAEEVEALRRQGYKPRDYYEKDEELHQVLTQIGSGVFNPEEPGRYRDLVDSLINFGDHYQVLADYRSYVDCQDKVDELYRRPEEWTTKAMLNIANMGYFSSDRTIKEYAENIWHIDPVRL

SEQ ID NO: 17602 - protein, 426 aa, Salmonella enterica subsp. enterica serovar Typhi
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLLEAAEEANIPLVVNHVGGMFGIFFTDAESVTCYQDVMACDVERFKRFFHLMLEEGVYLAPSAFEAGFMSVAHSMDDINNTIDAARRVFAKL

SEQ ID NO: 17603 - protein, 110 aa, Ralstonia solanacearum
MQQLVPTALAQWLADASRAQPVLLDVRETGEVQICALPGITHIPMGEIPHRAAELDAEQDIVCICHHGGRSMQVAQFLIMRAGFDPARVYNLQGGVDAWARQVDPQMATY

SEQ ID NO: 17604 - protein, 372 aa, Yersinia pestis biovar Medievalis str. 91001
MELPMNQSYLWATLLTLAVLCINKSIFNRRFRDCVMKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 17605 - protein, 329 aa, Bacteroides fragilis YCH46
MDKIIGLGNALVDVLATLKDDTLLDEMGLPKGSMQLIDDAKLQQINERFSQMKTHLATGGAAANTILGLACLGAGTGFIGKIGNDAYGNFFRANLQRNGIEDKLLVSDLPSGVASTFISPDGERTFGTYLGAASTLKAEDLTLDMFKGYAYLLIEGYLVQDHDMILHAIELAKEAGLQVCLDMASYNIVAGDLEFFTLLINKYVDIVFANEEEAKAFTGKEDPKEALELISKKCSIAIVKVGGNGSYIRKGTEEIKVEAIPVKKVIDTTGAGDYFASGFLYGLTCGYSLEKCAKIGSILSGNVIQIVGTTIPGERWDEIKLNINEVLSE

SEQ ID NO: 17606 - protein, 489 aa, Mycobacterium bovis AF2122/97
MSAASQRVDAFGEEAGYHKGLKPRQLQMIGIGGAIGTGLFLGASGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 17607 - protein, 558 aa, Escherichia coli K12
MHHATPLITTIVGGLVLAFILGMLANKLRISPLVGYLLAGVLAGPFTPGFVADTKLAPELAELGVILLMFGVGLHFSLKDLMAVKAIAIPGAIAQIAVATLLGMALSAVLGWSLMTGIVFGLCLSTASTVVLLRALEERQLIDSQRGQIAIGWLIVEDLVMVLTLVLLPAVAGMMEQGDVGFATLAVDMGITIGKVIAFIAIMMLVGRRLVPWIMARSAATGSRELFTLSVLALALGVAFGAVELFDVSFALGAFFAGMVLNESELSHRAAHDTLPLRDAFAVLFFVSVGMLFDPLILIQQPLAVLATLAIILFGKSLAAFFLVRLFGHSQRTALTIAASLAQIGEFAFILAGLGMALNLLPQAGQNLVLAGAILSIMLNPVLFALLEKYLAKTETLEEQTLEEAIEEEKQIPVDICNHALLVGYGRVGSLLGEKLLASDIPLVVIETSRTRVDELRERGVRAVLGNAANEEIMQLAHLECAKWLILTIPNGYEAGEIVASARAKNPDIEIIARAHYDDEVAYITERGANQVVMGEREIARTMLELLETPPAGEVVTG

SEQ ID NO: 17608 - protein, 266 aa, Pseudomonas aeruginosa PAO1
MPDVTLTTLQGLKQSGEKIAMLTCYDATFAHTASQAGVDVLLVGDSLGMVLQGHDSTLPVSNEEMAYHTACVKRGNKGSLIVTDLAFESSHSVAQTLADAVRLMQAGAHMVKLEGGVWLAEPIARLAQMGVPVCAHLGLTPQAVNLFGGFKVQGRQETQARQLRADAIALEQAGAAMLLLECVPSVLAEEITQAVKIPVIGIGAGAATDGQVLVMHDMLGLSLTGRSPKFVKDFMQGQESIPAAIAAYVRAVKDVSFPAAEHGFNA

SEQ ID NO: 17609 - protein, 319 aa, Desulfitobacterium hafniense DCB-2
MNIVVLDGYTLNPGDLSWQELERLGDLTVYDRTPEELIYERAKDAEVLLTNKTPLRENVLTKLEKLKYISVTATGYDIVDIKYAYDNNILVTNIPTYGTASVAQAVFALLLEMCNNVQKHNDLVKGGAWSESLDWCFWKYPLMELANKKMGIIGFGRIGQQTAKVANALGMEVLAYDRFKLENLPIDFKYVELDQLFAQADVISLHCPLTPENAGIINKDTIAQMKRNVILINTSRGKLVVEDDLYEALSTGRIAGACLDVLAVEPPSRDNPLLKAKNCIITPHISWATKEARARIMALTIENLKAYLDNKPINRIKLS

SEQ ID NO: 17610 - protein, 397 aa, Trifolium pratense
MASASASLFKSSLVLDKSEWVKGQTLRQPMSVVRCSPAAPSSLTIRAGAYTDELVKTAKTIASPGRGILAMDESNATCGKRLASIGLENTEVNRQAWRTLLVTVPSLGEYISGAILFEETLYQSTVDGRKIVDVLVEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRIENVKAAQEALLHRAKSNSLAQLGKYAGDGESEEAKKELFVKGYVY

SEQ ID NO: 17611 - protein, 317 aa, Yarrowia lipolytica CLIB122
MSRWYFTELRQAVRNLWTPQPHYTESEYPDLTSKTFVITGGHSGVGLAATQLLIDKGAKVVLVGRSREQAKHVLDELPEGTYDFAEADLADLSTIRSAGDYIVNQYPEIHGVILNAGIAFKPYSLTPQGHEYQWGTNVVGHHALMKCLDPAVIKTAHSSAPGSVRIVWVSSSAVIISNVPGGINFDDMSYKESQPSALQLYSQSKIGNAYQAYLWSKNHPDSGVVSVSVDPGNLKSNIGRHTPKTMTRAFEYLLYPSKYGAYTELAALLAPGVEDGDHLIPWGLKGHLRNDVDEGRRGDKGEELWKILEENVKQVGM

SEQ ID NO: 17612 - protein, 335 aa, Agrobacterium rhizogenes
MTITPDIELGAYLLQRKIDPALASLIESIAASATVVADHLKEAAFQNHIGSAGTTNVQGEDQKLLDVLADRVFRETCGEAVSLAAYVSEEAEDVTWLKAPAAGDLILYVDPLDGSSNLEVNLSVGSIFAVSQVQADGDTNVLRKGRDYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADDSNRRAGGKLRLMYEANPMAFLIEAAGGAASTGTEDILRIQPQAHHQRVSVLLGSSNEIQRLVQFHQIHHSQEEIGS

SEQ ID NO: 17613 - protein, 250 aa, Agrobacterium rhizogenes
MINTPRRLIVGNWKMNGLTADLAEIEKLAWNIGDLSADVAICPPATLLQSAVRITAGSRLLLGAQDCSAQEAGAYTGDISARMIADCRARVVILGHSERRQYQGETDAIVRRKAEIALSAGLTPVICVGETEAEHLRQETLAVLKNQLQGCLPAEMNEIALVIAYEPVWSIGTGRLPDQGEILAAHACIRSSLIDAYGPVGAQMRILYGGSVKPENSIEILALENVDGVLVGGASLRAESFLQICEATRT

SEQ ID NO: 17614 - protein, 495 aa, Rhodospirillum rubrum ATCC 11170
MPEGTTRIAALDIVREAGLLKDKAYIDGAWVGADDGGDFPVLDPATGREIGRVPNMGAAETRRAIDAAAAAWPAWRARTAKDRAAVLRRWYGLIMDNQEALAVLMTAEQGKPLGEARGEIAYGASFVEWFAEEGKRLYGEVVPAHGTDKRILTLREPIGVVAAITPWNFPSAMITRKVAPALAAGCPVVLKPAEDTPLSALALVELAERAGLPKGLINVVTTHEAKAVGGEMTANPIVRKLSFTGSTEVGKILMAQCAGTVKKVSLELGGNAPFIVFDDADLEAAVAGAIASKYRNAGQTCVCANRLYVQEGIYEAFTEKLKAKVEAMRVGPALEGDVQQGPLINKKGLDKVDGLVRDALDKGATAVLGGKVHALGGTFYEPTILTGVTAAMRMATEEIFGPVAPLYRFSTEAEAIALANATRFGLAAYFYTRDIGRVWRVAEGLEYGIVGINEGIISTESAPFGGVKESGIGREGSRHGIDDFVEIKYLCMGGI

SEQ ID NO: 17615 - protein, 349 aa, Streptococcus pyogenes M1 GAS
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 17616 - protein, 391 aa, Rickettsia rickettsii
MTNNTKTITLNLGPQHPATHGVLRLILEMDGEVVNNADPHIGLLHRGTEKLIEHKTYLQAIPYFDRLDYVSPMCQEHAFALAVESLLECKVPRRAQFIRVLFSELTRILNHTLNIGSQALDIGATTPLLWLFEEREKIMEFYEHVSGSRMHSNYFRPGGVVADLPEGLLEDIDKFIEQFPPKLHDIESLLNENRLWKQRLVDIGVVSQKEAMDWGFSGPMLRGSGIAWDLRKSNPYDVYDEMDFKVPIGKNGDCYDRYFVRMLEMYESIKIIKQCIEKMPKGAIKTDDPKLTPPTRAKMKESMEAMIHHFKLYTEGYDVPAGETYKAVEAPKGEFGVYLYSRGGNRPYRCRIKAPGFAHLQGLDFMSQGHLMADVITIIATLDIVFGEIDR

SEQ ID NO: 17617 - protein, 801 aa, Rhodobacter sphaeroides 2.4.1
MPVNDQSLTPNVLKTDVMRHLTFTLGKDAPHASLYDWRMALSYAIRDRIMEPWFASTRRTWEEDRKRVYYLSMEFLIGRILEDATINLGLHEMAERTMAELGQDFKAIVGDEPDAALGNGGLGRLAACFMESMATLGCPAYGYGIRYEHGLFRQRFEGGQQVETPEDWLSQRNPWEFDRPEATYIVGFKGHVETRDGREVWVPAETVKASAHDTPVVGWQGRWANTLRLWGAEPTTLFDLERFNRGDYTAAAEPETLARTLSRVLYPDDTTYQGKELRLKQEFFLTSAALQDILRRFKSGHGDLRALSRHVAIQMNDTHPAIAGPELIRLLVDEHGLSFDEALPVAQECLGYTNHTLLPEALERWATFTFGNVLPRHMQIVERIDGWHRRTFPARPHYVGIVKHHEVRMGELAFIMSHKVNGVSALHTDLVKANLFPELDRLHPEKIVNQTNGVTPRRWLKMANAPLARLIGETIGEGWEDDLDRLKGLEPHVKDQGFLGAFDAAKRQNKVTLSNWLGAECGVKVSPDALFDVQVKRIHEYKRQLLNILETVARWQAIRANPDAGWVPRVKIFGGKSAPGYAVAKEIIHLINDVAAVINADPLVGDLLKVIYPANYNVSMAERLVPAADLSEQISTAGKEASGTGNMKFMMNGAPTIGTLDGANVEILQEVGRENFFLFGLTAEEVMKRREDPDHARKAIEASQIMQNVLQAIAEGQFSPGQADRYHGLVHRVWHHDYFLVASDFDAYLAAQAEVDAAYKDRARWLTMAALNTARSGFFSSDRTIRGYMKEIWGVESALQD

SEQ ID NO: 17618 - protein, 244 aa, Lycopersicon esculentum
MATVSSASAALRTISSSSSKLSSAFQTKKIQSFKLPNPLISQNHKLTTTSTTASRSFSCKSQSTSTDSTNTEVQELSVYEINERDRGSPAYLRLSQKTVNSLGDLVPFSNKLYTADLKKRIGITAGLCILIKHEEEKKGDRYEAVYSFYFGDYGHIAVQGAYLTYEETYLAVTGGSGIFAGVSGQVKLQQLIFPFKLFYTFYLKGIPGLPSELLCTAVPPSPTVEPTPEAKACEEGAALKNYTN

SEQ ID NO: 17619 - protein, 324 aa, Coccidioides immitis RS
MDAKEIEVRSKALTKAAGSAEPSSTIISILKDLQNGVRPTEDLLRATKIGITVNRLKTHKHPDVARLASDIVHKWRHEVNKQKTGASPVGSQRSSDSPKQTPNGMATQTSGAEASDKMSKSTVPPDKRSWKADQVNTAHTQNKTRDSCIGLLYDGLCLNSTESPRTVLQKSIEVEAAAYSVFGPETKEQYRTKIRSLYQNLRNKSNPALRVRVLSNEIAPDKFVRMTHDELKSDERREEDRKIEKENMDKAMVAKAERSISKSLQCGKCGQRKVTYTEAQTRSADEPMTLFCTCLACGKSWRHQSIATMTSSHNLESEGVTHVL

SEQ ID NO: 17620 - protein, 92 aa, Vibrio cholerae O1 biovar eltor str. N16961
MARTAAALHILVKHKEQADDILAQLKKGAKFHVLAKKYSTCPSGKKGGDLGEFRQGQMVPAFDKACFQGEVLTPQLVKTKFGWHVVKVLYRT

SEQ ID NO: 17621 - protein, 259 aa, Synechococcus sp. RS9917
MAAAGLIGRRGADLARRRRRQGLPAWNLRVLPVCASTETALSQWLQHRPWQGPQPRAVIARHQIRAQGQWGRVWQAPAGGVWISAALPWPSTAAAPGLLGLAVALALAERLEGEGVPIRIKWPNDLLIGDRKLAGVLPRMVYCGGQLRLARIGVGLNVINPVPVGAVALRQVLAPGRCRPWVWTTEVLRCLERACGFALAPQTLVRAVEARLWQRQVRDPATGELWRITGLAADGALQLQQGTRTMSWTRWTDAREQGL

SEQ ID NO: 17622 - protein, 140 aa, Rhodobacter sphaeroides 2.4.1
MAIERTLSIIKPDATRRNLTGKINAKFEEAGLRIVAQKRIHLSLAQAQKFYGVHKDRPFFGELTEFMASEPVVVQVLEGEGAIAKNREVMGATNPANADAGTIRKEFALSVGENSVHGSDAPETAAEEIAFFFSGLELVG

SEQ ID NO: 17623 - protein, 60 aa, Triticum aestivum
  misc_feature (9)..(9): Xaa can be any naturally occurring amino acid
  misc_feature (14)..(14): Xaa can be any naturally occurring amino acid
  misc_feature (20)..(21): Xaa can be any naturally occurring amino acid
  misc_feature (35)..(36): Xaa can be any naturally occurring amino acid
  unsure (1)..(60): unsure at all Xaa locations
LAWFRPRYXFFGVXTRGTIXXVNVSELGFVTPAGXXVWGKYAQVTNNPEKEGCIKAVLLV

SEQ ID NO: 17624 - protein, 395 aa, Gloeobacter violaceus PCC 7421
MSRLATRVASLTPSLTLAIAAKAKALAAGGVDVCGLSAGEPDFDTPAPIKAAAKAALDRGETKYGPVAGQPRLRERIARKLERENGLPYTPEQILVTNGGKQGLYNAIMALIEPGDAVLIPSPYWLSYPEMVSLAGGTSVLLPTTEATGFKITPEQLEAAITPRTRLLILNSPSNPTGMVYSRPELEAITEVVLRHDLMVLSDEIYEKLVYDGARHHSIGGLGREMFARTITSGGFSKAFAMTGWRLGYLAGPTDLIGAAGAIQSHSTSNVAAYSQAGALAALEDPQVALEVERMVRVFAERRTAMYDAVAAIPGLRCARAQGAFYLLPDISATGLNSTAFCEQLLDQFHVAAVPGIAFGSDSHVRLSYATDLDTIYKGVERLGQFVRQCLAVRA

SEQ ID NO: 17625 - protein, 311 aa, Oenococcus oeni PSU-1
MKVVVPKALSKAGKNYLSEHDFELIEAPDDKQETILKVGKDADGIVLMTDPFDNQTLTKFTNLKIIARHGVGFDNVDEKFAGEHGVYVTITPMANASTVAETTIAEILDLSKNLTKISDEMRQGNFAYKLDHMGFDLSHKKIGVMGYGRIGRQVAEKANALGMDVLIFDPFVKETKIGKLVDRDTLISQSDVITLHLAVTDQTIHGFGKRELEMMKKSASLINLGRGALVDEQALIDALKTKQINGAALDVFDEEPLPLTSEFYKLDNVLLTPHIASNTKECMERMAVDSASEVVRVLSGEKPKWAVNKIK

SEQ ID NO: 17626 - protein, 458 aa, Oenococcus oeni PSU-1
MSKKTYSKLVKNQELTGDVIDLTYEGLGVVKVDDFPVFIVNSLPGERIKFAITRVLNSYAFGRVLGIIKESPDRVRADHPEMIASGIAPLVNLSYPAQLEFKRKQIRQLFHKVGIDDLEILPTLGMKNPTHYRNKTVVPVKFQAGKLVTGFYRRGSHKLVPIEDYYLNDPKIDVVVGIARDVLNDFHISAYNEISREGIVRYLMVRHGYHSGQTMLAVVATKKHLPHEKEIIKEINQRIPDLTSFLLNYNPKQTNVQLGLDNRVLSGQQVIHDTLLGLDFEIGINSFYQVNPQTTAVLYTKAAELAGLKSNQLVIDAYSGIGTIGLSIARQVRKVIGVEVVVPAVEDAKKNMLANRIENAEYIAADAAEQFIKWADAGVKPDVVFVDPPRKGLTSDLIQSLGVMAPLKFVYISCNPATLARDAVLIKEQGYRISKAVLPIDQFPQTMHVESITVFEKE

SEQ ID NO: 17627 - protein, 700 aa, Ustilago maydis 521
MYASSVRRSANFTLANGAQIPKLGFGTWKMSKEQATPAVAHAIKTGYRHIDCAWAYRNEDAVAAGIKKAGVPRSQLWLTSKLWNSFHHPEHVEKALDASLKDLGTDYLDLYLMHWPVAFLNSKGSMVPSIRSTGGHPVESEDLSRDFMATYRVMEEMVKKGKVRNIGVSNFNIRRTSEVVDEASIKPVVNQVEVNLGVHNEELRNYAHAHGVTLQAYSPFGSNQNVAKSLEDPVVVDVAQRNNITPAQVLLAWTLGRDIIPISKSVTPERIEENFRVLDIQLAEEEIKHLTNEALSRPIERTVDPTEGWGVADEIFEDGVDQTREMELKGGSYVPPPAHESPAEHRLEPRNDPETPARMLHTAAHPLASSSRSTLVSRRRTAVQAKSSSSFFRGFATTSRVAAVAEVAPPSASEAPAVSESALLRTTSKSALATPGLKFLDGEQRIERETKKMNMYTVRRMSTSTTTQASVRASARVTATSSAVKPTTRKYPAKKSFLYEKYLRLLSDSQMVLVLQHNNLSVAELAQVRSDIAAINLAEGQTSKASLTVVRAGLIKAVTRQLSEKNAAMKSLQPALSGPIALLTCEHLTPAYLSALLNVVDRALGHVPPRAPAVGAKFPETAVANPRLVPLAAVLEGKRLLHVPQTRDVGRIGGLDQLRSQIVGLLSAPAQQLAHVLTHASGQQLAMTLEARKRDLEAKQ

SEQ ID NO: 17628 - protein, 136 aa, Mycobacterium avium subsp. paratuberculosis K-10
MTERTLVLIKPDGVQRQLVGEIIGRIERKGLTLVALELRHVSQDLAAQHYAEHEGKPFFASLLEFITSGPVVAAIVEGPRAIAAFRQLAGGTDPVEKAIPGTIRGDFGLETQFNLVHGSDSVESAKREIGLWFPDA

SEQ ID NO: 17629 - protein, 382 aa, Streptomyces coelicolor A3(2)
MIATPPASRIAELRRRSRRPALAPAPPGAVSLAMGEPDFPTPPTVVQAAVSALREGHTHYADQRGLRELRAALAARLPERPGGAWDADDVLVTHGATAALAAVVLATVGPGDRVVVPEPAYSLYADLVVLAGGTVDFVPLAPDLHWDLDALAAALPGAAMMIFSNPSNPTGIVHRREELEALGKLLDGTDVLVVSDEAYHRLAYPGHEPVSALEIESLRGRTVYVQTFSKTYAMTGWRVGYLTGPREVLDAAAQVHRTWNGSLNTAVQHAALAALDLPDGVVGAMADRYRQRRDLVVGRLSGVPGLHLVPPEGAFYGFLRYDADRPSEMVARELAACQVLVRAGAEYGPSGEGHLRISFAASEDDLWVGLERIVRYFAEARS

SEQ ID NO: 17630 - protein, 428 aa, marine gamma proteobacterium HTCC2207
MNTFSRTTGISVVVANMIGTGVFTSLGFQLLGIQSFFVLMMLWLIGGLTALCGALTYAELGANLPRSGGEYNFLSRLYHPAAGFISGWVSATVGFAAPVALAAMTFGAYLSAVFPAISPRWSAVSLVVLLTLLHCRSRQTSSAVQQLFTALKVLLILLFCATIFIWGDAPQSAISFAPQTGDSTLLFSGAFAVALIYVNYAYTGWNAATYLTSELDNPQRNLPVVLFVGTGLVMMLYLLLNFTFLSAAPMAILEGKLEVGVIVADHALGETAGKAMGLVLALLLISTVSAMTMAGPRVLQVIGEDFTVFSRLSRCNSHGVPMTAIVFQGMLAVIFILSATFESVLVFSSFVLGVNTLFAVLGVFVMRWKKLNIKGAYKTFGYPFAPIIYLSVTVWTLAYVLISRPIEGGIGVAMIAVGGLLYTLSANK

SEQ ID NO: 17631 - protein, 413 aa, Rhodobacter capsulatus
MDGDIRHNSYDDGSEDVLTGEQSIRNFNINFGPQHPAAHGVLRMVLELDGEIVERADPHIGLLHRGTEKLMESRTYLQNTPYFDRLDYVAPMNQEHAWCLAIEKLTGTAVPRRASIIRVLFSEIGRILNHLLNVTTQAMDVGALTPPLWGFEEREKLMIFYERACGARLHANYFRPGGVHQDLPPDLIDDIEIWAKAFPQVLDDIEGLLTENRIFKQRNADICIITEAEIEKWGYSGVMVRGSGLAWDLRRAQPYECYDEFDFKVAVGKNGDCYDRYLVRMAEMRESTKIILQACAKLRAPDGQGDILARGKLTPPKRAEMKTSMEALIHHFKLYTEGFKVPAGEVYAAVEAPKGEFGVYLVADGTNKPYRAKIRAPGYAHLQSIDAVAKGHQLADVSAIIGTMDVVFGEIDR

SEQ ID NO: 17632 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDTNEMCAFVRQTIADLSSKEVSEATRIQYGGSVKPNNIKEYMAQTDIDGALVGGA

SEQ ID NO: 17633 - protein, 964 aa, Saccharophagus degradans 2-40
MSHGTSLDELFNSRDFIGRHIGPNADQTRAMLDAMGLDSIDQLIDLTVPASIRGEETRALAAPVNEQQALAELKNIAGNNQRFKSYIGMGYHPTYVPPVILRNVLENPGWYTAYTPYQPEIAQGRLEGLLNFQQMIIELTGMDMANASMLDEATAAAEAMAMAKRVARKNKSNTFFADKHCHPQTLAVLQTRASHFGFELVIGDITQDLNKQEVFGAITQYPGTSGEVKDLRPIVNQAHEQDALLIVAADILSLVLLESPGAMGADIVVGSNQRFGIPMGFGGPHAAFFGFREKYKRATPGRIIGVSVDTRGKRALRMAMQTREQHIRREKANSNICTSQVLLAVMSVFYAMYHGSAGVTRIAQRVHTLTKMLAQGLTAQGHKLAFDNYFDTLCVIVNDQQQGLFDRAQQAGVNLRKLDKNALTISLNECTSLEDIHQLLDIFSLGKHSQDVKSLETKALAAEVIPASCRREGPALNHPVFEQYHSETEMLRYLKRLESKDIALNHAMIPLGSCTMKLNATAEMIPVTWPEFGELHPFAPMEQAAGYSTLFTQLQDMLKACTGYDAISLQPNAGSQGEYAGLVAIRKYFEHLGQTERNICLIPASAHGTNPASAQMVEMKVVVVACDNLGNVDLNDLKAKVAQYGETIAALMVTYPSTHGVFEEEITAICDLIHSVGAQVYIDGANMNALVGLAAPGKFGGDVSHLNLHKTFCIPHGGGGPGMGPIGVKSHLAPFLAGHPVQPVPNTLVENGTISAAPWGSASILTISWMYIRMMGAEGMKRATEFAILNANYIAHRLQDHYPILYKGKNGYIAHECLLDLRPLKESSGITEEDIAKRLMDFGFHAPTMSFPVAGTLMIEPTESESQAELDRFCDAMIKIRQEASLVESGELPRDNNPLVNAPHTLDDALDETWTRPYTRDEATRPLPYLHAHKIWPTVNRIDNVYGDRNLICSCPSIESYTEE

SEQ ID NO: 17634 - protein, 344 aa, Hordeum vulgare
MGHHHHHHHHHSSGHIDDDDKHMLEASAKATMGQGEQDHFVLKSGHAMPAVGLGTWRAGSDTAHSVRTAITEAGYRHVDTAAEYGVEKEVGKGLKAAMEAGIDRKDLFVTSKIWCTNLAPERVRPALENTLKDLQLDYIDLYHIHWPFRLKDGAHMPPEAGEVLEFDMEGVWKEMENLVKDGLVKDIGVCNYTVTKLNRLLRSAKIPPAVCQMEMHPGWKNDKIFEACKKHGIHITAYSPLGSSEKNLAHDPVVEKVANKLNKTPGQVLIKWALQRGTSVIPKSSKDERIKENIQVFGWEIPEEDFKVLCSIKDEKRVLTGEELFVNKTHGPYRSARDVWDHEN

SEQ ID NO: 17635 - protein, 125 aa, Glycine max
ACSMISSPSVTTVNRACAGMFAPFTGLNSIAGFPIMNTNTDITSIASNGGRVQCMQVWPPVCKKKCETLSYLPDLDDAQSAYEVQHHLMNGWITCLECQLEHCFVYRVHYMSPVYYDGLYWTIWN

SEQ ID NO: 17636 - protein, 477 aa, Arabidopsis thaliana
MDNIAAQLKRGISRQFSTGSMRRTLSRQFTRQNSLDPRRNNMRFSFGRQSSLDPIRRSPESLSCEPHMSVPENLDSTMQLLFMASKGDVNGVEELLNEGIDVNSIDLDGRTALHIASCEGHYDVVKVLLSRRANIDARDRWGSTAAVDAKYYGNVEVYNLLKARGAKAPKTRKTPMTVGNPKEVPEYELNPLELQVRKVDGISKGTYQVAKWNGTRVSVKIFDKDSYSDPERVNAFTNELTLLAKARHPNIVQFVGAVTQNLPMMIVVECNPKGDLSVYLQKKGRLSPSKALRFALDIARGMNYLHECKPDPIIHCELMPKNILLDRGGQLKISGFGLIKLSKIGEDSAKVVNHEAQIDKSNYYIAPEIYKDEVFDKRADVHSFGVILYELTEGVSLFHPKPPEEVAESICIEGKRPTIRTKSKSYPPELKELIEECWHPEISVRPIFSEIIIRLDKIVTNCSKQGWWKDTFKFPWK

SEQ ID NO: 17637 - protein, 949 aa, Silicibacter sp. TM1040
MPFEPTDYLPYDFANRRHIGPSPEEMAEMLKVVGADSLDALIDETVPQSIRQKAALDFGRPMSERELLFHMREVAGKNKVMTSLIGQGYHGTVTPPAIQRNILENPAWYTAYTPYQPEISQGRLEALLNFQTMISDLTGLEIANASLLDEATACAEAMTMAERVSKSKAKAFFVDRDCHPQNIAVVKTRAEPLGIEVIVGNPDKMDPEAVFGALFQYPGTYGHVRDFTDHIAKLHEHKGIAVVSADPMSLTLLKEPGAMGADIAVGSTQRFGVPVGAGGPHAAYMATKDAYKRNMPGRIVGVSVDAHGNKAYRLSLQTREQHIRREKATSNVCTAQALLAVMASMYAVFHGPKGLKAIAQRIHRKAVRLAKGLEEAGFKVDPQAFFDTITVDVGPLQAAVMKSAVDEGINLRRVGETRVGISVDETTRPETIEAVWRAFGIVRADDDFTPDYRVPANMHRKSDYLTHPIFHMNRAETEMMRYMRRLADRDLALDRAMIPLGSCTMKLNAAAEMMPLSWPEFSTIHPFAPADQQAGYGEMVEDLSKKLCDITGYDAISMQPNSGAQGEYAGLLTIAAYHKARGEGHRNICLIPMSAHGTNPASAQMVGWKVVVVKSDERGDIDLEDFRAKAEKHADNLAGCMITYPSTHGVFEETVHEVCKITHDAGGQVYIDGANMNAMVGLSRPGDLGGDVSHLNLHKTFAIPHGGGGPGMGPIGVKAHLVEHLPGHPETGGSEGPVSAAPLGSASILTISWAYCLMMGGAGLTQATKVAILSANYLAKRLEGAFDVLYKGPTGRVAHECILDTRPFADSADVTVDDVAKRLMDSGFHAPTMSWPVAGTLMVEPTESETKAELDRFVDAMLSIRDEIKAVESGEMPRENNALKNAPHTMEDLVKDWDRPYSREQGCFPPGAFRVDKYWPPVNRVDNVYGDRHLICTCPPLEDYAEAAE

SEQ ID NO: 17638 - protein, 330 aa, Mesorhizobium loti MAFF303099
MFRAKIEKVATGDLDIRTLQTAWPDEPMEFGNPALGLDKVKEYFGHPDEVVDFIGDAEILVTQLAPLSEAMMRRLPALKLVAVSRGGPINIDMAAARAHGITVVNVPGRNATAVAEFTLGAILAETRLIRVGHEALRKGEWRGDLYRADRTGRELSEMTVGVIGYGNIGTKVVRLLRAFGCHVLVSDPYVQLSAEDRNAGVELVALDNLLARSDVVTLHPRVTEETRGLIGKDAIALMKPGVILINTARGPLVDYDALYEALVSGQIASAMLETFAVEPVPSDWPLLQLPNVTLTPHIAGASVRTVTYAAEQAAEEVRRYLTGLPPVNPC

SEQ ID NO: 17639 - protein, 519 aa, Oryza sativa (japonica cultivar-group)
MGEGINGDAGDLAAAPYDQWLPFSPAGGSPRPSARYKHAAEVVREKLYVVGGSRNGRYLSDIQVFDFRTLKWSALSAARDSSQLNIENNTTDPSFPALAGHSLVNWKKYIVVVAGNTRTSTSNKVSVWLINVETNSWSSVDTYGKVPISRGGQSVSLVGSRLIMFGGEDNKRRLLNDLHILDLETMMWEEVKTGKGGPAPRYDHSAAVYADQYLLIFGGSSHSTCFSDIYLLDLQTMEWSQPDTQGAHINPRSGHAGTMIDENWYIVGGGDNASGSTDTIMMNASKFVWSVVTSVPARDPLACEGLTLCSTTVDGEKFLVAFGGYNGQYNNEIFVMKLKPRNLVQPRLLQSPAAAAAAASVTAAYAVITDEKTRDIVATDDLDVKRVQPSGSSKQITTELDALNGEKGKLESRLAEVRDENSKLKDRLDMVKLSHGELTKELKSVQHQLAAEGSRCQKLESQIAAAHKRLESTDSLENELEVLRQQISQVEQTMTTAQRQKSGGVWKWVAGSAEISDDE

SEQ ID NO: 17640 - protein, 307 aa, Oryza sativa
MSSPHGGLDDQIERLMQCKPLPEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 17641 - protein, 407 aa, Rhodospirillum rubrum ATCC 11170
MRGWVLPDHAPGMPCGLGPGCYTAADWPSAVTGAGRMVERRIPTLRQPQRPPRQSRQRSIDQSRPRSPKRESDVTSMHEPRFDVAGIGNAIVDVLSHADDAFLATNDLPKGGMTLIDETRAEVLYASMGPGIEASGGSAANTMAGLASLGARTAFIGKVRDDALGAIFRHDITSIGVTFPTAPLTEGPSTARCLILVTPDAERTMNTYLGACTQLAPDDIDAEVIADSAITYIEGYLWDQPAAKTAILQAAAQARKAGRKVALSLSDSFCVDRHRDTFLELVDNHVDILLANEHEVMALFGSADLDQATAALRGRCALAVVTRSAKGCRIVSAESVTDVPAETVDHLVDTTGAGDQFAAGFLFGLCRGYEPKLCARIGAIAAAEVVSHFGARPEAASLADLVKAKLG

SEQ ID NO: 17642 - protein, 157 aa, Pyrococcus horikoshii
MSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 17643 - protein, 394 aa, Ralstonia solanacearum
MDAHRLHTAARLANIRAFHVMELAKQARELELAGRSIIHMGIGEPDFTAAEPVVRAAEAAMRRGVTQYTGALGIRPLREAIARYYHTVYGLDIAPERIIVTAGASAALLLACAVLVEIGGEVLMPDPSYPCNRHFVPAFDGVARLVPSGPQTRFQLSAEQVEANWTDRTQGVLLASPSNPTGTSILPDELRRIVETVRGRGGFSIVDEIYQGLSYDQAPVSALSFGDDVVTINSFSKYFNMTGWRLGWLVAPTELVPQFEKVAQNLFICASAVAQHAALACFEPEALAIYEGRKAEFHRRRDFIVPALESLGFQVPVKPDGAFYVYADCRGVNHPHAGDADALTQSMLNDAGVVLVPGLDFGPYTAHHYIRLSYATAMDHLEEAVARLARLFRR

SEQ ID NO: 17644 - protein, 464 aa, Oenococcus oeni PSU-1
MKQAIETIPANKKLKYIKKIAILATFGAFLFGYDTGVINGSLSFMARGDELNLSPFMEGLVTSSLLFGAAIGAVIWGRLADRYGRKSILRVLAIIFFFSTLGSSIAPNSYVLIIGRLFMGLAVGGVAGIVPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 17645 - protein, 399 aa, Ralstonia solanacearum
MGSHFCRRAAANALAGGPLQLPAMSIATVEEIIAEIRAGRMVILVDEEDRENEGDLILAADFVTPEAINFMARFGRGLICLTLTAERCRQLDLPLMVTRNGTPHGTNFTVSIEAAEGVTTGISAADRARTVQVAVARSASPDDLVQPGHIFPLMAQPGGVLMRAGHTEAGCDLASLAGLTPASVICEIMKDDGTMARLPDLVEFAREHGLKIGTIADLIQYRSRTESIVERIGERNMETQFGTFRAVAFRDHAAGRAHLALVKGTPTPATETLVRVHEPLSVLDLLECQRTTHSWSVPAALRAVQAAPTGVVVLLNCGDSPERLFTQFSALDAPQERPRSKPDPRIYGIGAQILKDVGVGKMRVLASPLKLPSMAGYDLEVTAYQSMADTPQATTAATH

SEQ ID NO: 17646 - protein, 458 aa, Oenococcus oeni PSU-1
MKAHHLNIFFIFVFGALGGLLFGFDTGIISGASSLIESDFSLNIEQTGFITSSVLIGSSIGALSVGSLSDKFGRKKLLILASVLFLIGSGLSMSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 17647 - protein, 458 aa, Escherichia coli CFT073
MMESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 17648 - protein, 994 aa, Yarrowia lipolytica CLIB122
MLRTLNRTSRILRLSATKTRFGSTFSAATRPLDTYLRRHVGSESADVNKMLRALDYATAESAMDSFVSDVVPPNVLTKRPLAVKPTQGFSESELTSRLGEIASKNKVFKSYIGKGYVGTVVPPVIQRNVLENPLWYTSYTPYQPEISQGRLESLLNYQTVITELTGMAVANASLLDEGTAASEAVTMAFNAFKGKRGIFLVDKNVHPQTIAVVQSRSVALDVDVKVVDVSDLSNGKSESPIDQVCGVLVQYPTTDGSIVDYQKLSDTLKGEGNGSLLCVAADLLALTLLKPPSDFGADIVLGTSQRFGVPMGYGGPHAAYFAVADGQHRKMPGRLIGMSRDRLGGEAYRLALQTREQHIRREKATSNICTAQALLANMSAFYAIYHGPEGLRKIAERVNLLTSILATAVEAKGVKVENKHFFDTLTLQVQDANKVISAAEAKEINLYKLDDKTVSLTLDETVTHGDLVNLASVFGVSEADLESAADNVTSSIPSDMLRTDKYMQHDVFNKYHSETELLRYMKHLQSKDLSLADAMIPLGSCTMKLNATTQMAPITWPEFGQLHPFVPLNQAQGYKELLIELEDDLADITGFDRMSLQPNSGAQGEYTGLRVIRAYLESQGQGHRNICLIPVSAHGTNPASAVMSGMKVVAVKCKKDGELDLVDLAAKAEKHKDNLAAFMVTYPSTFGVFEPGVKEAIDIVHKNGGQVYMDGANMNAQIGLTSPGEMGADVCHLNLHKTFCIPHGGGGPGMGPIGVKSHLAPFLPAHPVVEMSEVTGLSTEKSIQPVSAAPFGSASILPISWAYIKLMGATGLLKATEIALLNANYMKKRLEPHYPILYTNNKDKCAHEFILDMRPFKASSGIEAIDIAKRLQDYSFHGPTMSWPVANTLMVEPTESESLAELDRFCDALISIRQEIKEIEDGKIPRENNVLKNSPHPQQDLLAETWDRPYTREQAAYPVASLREKKFWPSVARVDDTFGDLNLFCTCEPPALEE

SEQ ID NO: 17649 - protein, 139 aa, Wolbachia endosymbiont strain TRS of Brugia malayi
MAIERTLSILKPDTVKNNIIGNINSYIEKSGLRIIAQKMMLLTKKQAELFYAIHKDRPFFGGLVEFMTSGPVIVQVLVGENAISKYRQIMGATDPKQADKGTIRGDFADDVNENRVHGSDSLENAHKEIAFFFAECELV

SEQ ID NO: 17650 - protein, 341 aa, Mycobacterium avium subsp. paratuberculosis K-10
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPVKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 17651 - protein, 380 aa, Arabidopsis thaliana
MSAILAAAIGGAVGALALIALFVFLLWFCVFRRKNLSRTSETGSSDPSTQEGRNVAIELSMREARRFEMEELAQATKSFTNKSLIGIGKFGEVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWMQNLTDYADIPMMIDERLGGTYTAEGVEELITLTLRCVDVSSEKRPTMSFVVTELERILDKEVSLTTVMGEGTPTVTLGSQLFKATK

SEQ ID NO: 17652 - protein, 117 aa, Zea mays
  misc_feature (43)..(43): Xaa can be any naturally occurring amino acid
  unsure (1)..(117): unsure at all Xaa locations
KGKIEAREGHNRSNEAGSTVGGKGQTLSCKQYAEKAYMNMTLXLHNESNVDQKVDDDVQQGDLHACVQTHDHTQLAKVLKHTMKEKRMELADPADDTLPKDRHDAEKELLTVLRTSK

SEQ ID NO: 17653 - protein, 251 aa, Pseudomonas aeruginosa PAO1
MRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 17654 - protein, 282 aa, Staphylococcus aureus subsp. aureus MRSA252
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYIDLVLIHQPYNDVYGSWRALEELKETGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 17655 - protein, 134 aa, Staphylococcus aureus
HETDEEINKKAHAIFKHGMTPIICVGETDEERESGKANDVVGEQVKKAVAGLSVDQLKSVVIAYEPIWAIGTGKSSTSEDANEMCAFVRQTIADLSSKEVSEATRIQYGGSVKPNNIKEYMAQTDIDGALVGGA

SEQ ID NO: 17656 - protein, 361 aa, Oryza sativa
  misc_feature (31)..(31): Xaa can be any naturally occurring amino acid
  misc_feature (171)..(171): Xaa can be any naturally occurring amino acid
  misc_feature (178)..(178): Xaa can be any naturally occurring amino acid
  misc_feature (262)..(262): Xaa can be any naturally occurring amino acid
  misc_feature (280)..(280): Xaa can be any naturally occurring amino acid
  misc_feature (316)..(316): Xaa can be any naturally occurring amino acid
  misc_feature (326)..(326): Xaa can be any naturally occurring amino acid
  unsure (1)..(361): unsure at all Xaa locations
AAALKLVDPPGCRNSARGFTLHCSQIHIDLXPTLSDEDKEVIRRWGAPNKIDFLSLSYTRHAEDVRQAREFLSKLGDLTQTQIFAKIENVEGLNHFDEILQEADGIILSRGNLGIDLPPEKVFLFQKPALHKCNMAGKPAVVTRVGDSMTDNLRPTRAEATDGANAGLDGXSDAILLXALTPLRGLYPGSTLSSIGGQKFALGAEKVFNQDLYFKRAGKYVGEPVTHWASIASSAVRAAIKVKASVIICFTSSGRAGRLIAXYRPNMPVLSVRSASIRRXQLTWNVTGAFEARQSLIVRGLCPMLGEPRHAIESNXASNESVLKVXVYHGKASGVIKSYDRVVVCHKVGDSSRVKIMRCAN

SEQ ID NO: 17657 - protein, 414 aa, Matricaria chamomilla
MKPASSSADSGTESCSSKGVAKTGEGLRQYYLQHIHDAQLQVRQKTHNLNRLEAQRNELNSRVGMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCAFIRVSGSELVQKYIGEGSRMVRELFVMAREHAPSIIFMDEIDSIGSARMESGSGNGDSEVQRTMLELLNQLDGFESSTKIKVLMATNRIDILDPALLRPGRIDREIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 17658 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEVTRIQYGGSVKPNNIKEYMAQTDIDGALVGGA

SEQ ID NO: 17659 - protein, 254 aa, Mesorhizobium loti MAFF303099
MRVVYWVGTSWKMNKTLAEALDFAERLAGFIPGFDDRIQPFVIPPFTAVREVKRALSSTRIKVGAQNMHWADAGAWTGEISPPMLRDCGLDLVELGHSERREHFGETDRTVGLKTAAAVKHGMIPLICVGETLAERESGQADAVLSAQVEGALQFLEGEAKTAKILFAYEPVWAIGDKGIPASADYADKQQALIKTVAGALLPSVPPVLYGGSVNPGNAAELVGQPNIDGLFIGRSAWQADGYIDILGRASAAI

SEQ ID NO: 17660 - protein, 696 aa, Oryza sativa
MARRDAMRTCGGGWRAGPSARRGRAGPCRLQVSRPASSPRSSSPRWIMPASPRALAATVGLELDKVAVGSSTEKKAAVVTAWLSLPSRRPTPLPEPFLHRRRREGHHRGEPRLTDGQIRRSRFSLVVGTGSAPRRLATGVMDVELRLVANVGSGLLASCRRRIQPYCRIRDATPRWRRGGREKGGDSTGGSSSNSSSEEDERDVAAHRMSDMNQCACHRKDKGVTISGVVKRRKEDVAQGVPTVAAAPGDMMAKVKPAAVNSSSGGLDQAETSGATAGESGGGSGRARRTAAAGEAGMSGGGAAGENGGGRACPLWSSVSTSSSSVVALLAASLRWLLVAVVLFTWLPLMCPVQDCSQPSRSLPHAAAYAAAAMALLAAAYYLLPDYQEPVEEPVPDPAPPPAAVARCPPPLSPAVAPPVSTRRRRQEKRRKGKKEGMRLQSRPDYSNPDQTAPNLLAGKERQTASESETANPRLYKSTLVNANRFRALEEEEEGIIKATDQIVDRFSMARRGTEAFPDLGAQCDREDCNQLDFLPFDCDGCGKTFCAEHRTYRDHGCARAADQGRTVVVCEACGDAIERRAGDGGGDDAAVLEAHARSRRCDPARKRKPRCPVPRCKETLTFSNTSGCKGCGQKVCLKHRFPADHACAGAGAGAASKAAGAAAAARSAGQCGRDAQKKEGGGWKLPQSVRNMKIF

SEQ ID NO: 17661 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGITPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPPPMEEGIDAALSAAAAKEGVTWSDYQKDLKKAGRWHVETY

SEQ ID NO: 17662 - protein, 512 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLVPLFNVDLQDVFQRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGLRHEPSYKFFSFNAGPRTCLGKNLAMNLMKTVIVEILQNYEIKIVSGQKIEAKPGLVLHMKHGLKVTMTMKCSSLE

SEQ ID NO: 17663 - protein, 141 aa, marine gamma proteobacterium HTCC2207
MASERTLSIIKPDAVAKNVVGQILSRFETAGLQIIACKMQQLTQEQAEGFYAEHSERPFFKDLVAFMTSGPVSVQVLEGENAVMTNRDLMGATNPKEAEAGTIRADFAESIDANAVHGSDAAASAAREIAYFFADNELCSR

SEQ ID NO: 17664 - protein, 962 aa, Arabidopsis thaliana
  misc_feature (196)..(196): Xaa can be any naturally occurring amino acid
  unsure (1)..(962): unsure at all Xaa locations
MDTMRISGVSTGAEVLIQCNSLSSLVSRRCDDGKWRTRMFPARNRDLRPSPTRRSFLSVKSISSEPKAKVTDAVLDSEQEVFISSMNPFAPDAASVASSIKYHAEFTPLFSPEKFELPKAFFATAQSVRDALIMNWNATYEYYNRVNVKQAYYLSMEFLQGRALSNAVGNLGLNSAYGDALKRLGFDLESVASQEXDPALGNGGLGRLASCFLDSMATLNYPAWGYGLRYKYGLFKQRITKDGQEEAAEDWLELSNPWEIVRNDVSYPIKFYGKVVFGSDGKKRWIGGEDIVAVAYDVPIPGYKTKTTINLRLWSTKAPSEDFDLSSYNSGKHTEAAEALFNAEKICFVLYPGDESTEGKALRLKQQYTLCSASLQDIVARFETRSGGNVNWEEFPEKVAVQMNDTHPTLCIPELMRILMDLKGLSWEDAWKITQRTVAYTNHTVLPEALEKWSLELMEKLLPRHVEIIEKIDEELVRTIVSEYGTADPDLLEEKLKAMRILENVELPSAFADVIVKPVNKPVTAKDAQNGVKTEQEEEKTAGEEEEDEVIPEPTVEPPKMVRMANLAVVGGHAVNGVAEIHSEIVKQDVFNDFVQLWPEKFQNKTNGVTPRRWIRFCNPYLSDIITNWIGTEDWVLNTEKVAELRKFADNEDLQSEWRAAKKKNKLKVVSLIKERTGYTVSPDAMFDIQIKRIHEYKRQLLNILGIVYRYKKMKEMSASEREKAFVPRVCIFGGKAFATYVQAKRIVKFITDVASTINHDPEIGDLLKVIFVPDYNVSVAELLIPASELSQHISTAGMEASGTSNMKFSMNGCVLIGTLDGANVEIREEVGEENFFLFGAKADQIVNLRKERAEGKFVPDPTFEEVKKFVGSGVFGSNSYDELIGSLEGNEGFGRADYFLVGKDFPSYIECQEKVDEAYRDQKRWTRMSIMNTAGSFKFSSDRTIHEYAKDIWNIKQVELP

SEQ ID NO: 17665 - protein, 654 aa, Methylococcus capsulatus str. Bath
MTAASFAQILLLLGTTALVVAVFQWLRVPSSLAYLVVGVLLGPHTGGPVIENPEIHGAAEFGIVFLMFTIGLNLSLPQVHALRHLVLGLGTGQVVLTTLVVGAAAFAFGLSPEAAFVVGAVFAQSSTAIIGKQLAEQGEEYSRHGRLAVAMSVFQDVTAVPLIVVVPVLAVPSLRVLGESLAWALAKAVLAFVLVFFAGRWLLRPLFHAVASRRSAELFTLTVLLVSLGAGGLTYQLGLSVAFGAFLVGMMLGETEFRHQVESTIRPFRDVLLGLFFVSIGMLFDPSLMEGTWQWALGGAFVLLAAKTVLVAVLVRATGIDLATAWRVGLLVAVGGEFGFALLAIALDAGVISQLTGQIVLMAVLLSMITAPFLIRYNRVLVEGWFRPPPGEEGALSAGPGVAGSPHDHVIICGYGRIGQNIGRFLEEERIPYVALDLDPQRVKEARIACEPVYYGDSSERDMLEAVGIGKARLVVVSHEDLAAAHKVLHHAAALRPGLPVMVRTRDESHVEELRRAGAAEVVPETLEAGLMIASQALLLLNVPLSRVARRIREQRLNRYLLLREFFRGDETFSDDVQSQDGDRLRAVPLPPGCRVAGCTLAELALENVVVTALVRHGVRELAPAPETRLAEGDAVVLFGAVSDLDKAERRLLG

SEQ ID NO: 17666 - protein, 278 aa, Rhodobacter sphaeroides 2.4.1
MASIDGLPPLREVIRAHGLSAKKQLGQNFLLDLNLTAKIARLAGDLTNSDVLEVGPGPGGLTRGLLAEGARRVLAIEKDARCLPALAEVAAAWPGRLEVLNADALEVDVAARLTPPIRIVANLPYNVGTELLTRWLSSDWPPFWESLTLMFQKEVAERIVAKPGSKAYGRLALLSQWRTDPKIVLTLPPDAFTPPPSIHSAVVHFTRLEAPRHPADPKVLARVTAMAFNQRRKMLRSSLKGLVPDIETVLREAGIEPTQRAEEIPLEGFCALARRLAG

SEQ ID NO: 17667 - protein, 718 aa, Cryptococcus neoformans var. neoformans JEC21
MLTPCRADEHWVVVELCDEIRIEAVEIAVWEFFSGVVREVRVSVGGEDEEDDAEEPGQDDVAGRGHRWKQVGSFIGKNVRGSQTFSLSQPTSFHRFIRLDFPSYFGSEYYCPVSSLKVYGMNQMEAFKWEQKQLSAVAKDRDRTGNREHEEEERRAKERREREKKERDERDKQEQRERELDELEKLLHEQAGRLVPELLTESGLFSSIDETAPTNVPTVVSKRDGDSDSPPTNESMATSLIESTSIESTSIESPTSIESPSTSYTRAVPPRSDSSESIYAFIIRRLNALEGNSSLVARYIEEQAKVMRSMLKQVQVGWDEWKGEWEDEDRGRWQQERMRQEDRLGRVLSQLEQQRIAFDAERKAIETQLRVLADQLGYERRRGIAQLIIMVVIILLGAASRSSTMDAILTPLLKEARRRRSDYYHRKSLSGPLAGLHIDMGAGRPPAIIGQARPTSTTPSAHPHRHSSSTPTPRLKTSLSRAGSGHRSNTSLKRRGIVPQVPPSYRSVSSSEFTFSPLSHLPPTSSPSPANIPNPNPNPRNVRVSFPPPRQTPPPPSVSSRKLAQSAHLHHLHTTAAAAAAREDTERGITASMRRRRMRSSLVNDDNEQQTTVSGLGSGKADAGGGGGGGGGEEAERVVGAEDNSQGEWGTDDFDTEADDFDTEAEAEAEVSKVEDQVRDKKDSETDRKEQDQLGETEQQPVREKRGVQGEHVGLARA

SEQ ID NO: 17668 - protein, 567 aa, Oryza sativa
SLSPRTTASPPLLSSLPPTRRKKEKEEEKSSAMAKKKERAVNVSGKPRHSLDVNRANDKKGAGGGAGGGGGGRSAATVRRLKMYKMRPLRDRGGKILKHDLQSKELPNTRIEPDRRWFGNTRVVNQKELEFFREELQSRLSNNYNVILKERKLPLSLLQDHQKQARAHLLDTEPFEHAFGPKGKRKRPKLMALDYESLLKKADDSQGAFEDKHATAKLLKEEEEDGLRDLVRHTMFEKGQSKRIWGELYKVIDSSDVVVQVLDARDPMGTRCYHLEKHLKENAKHKHLVFLLNKCDLVPAWATKGWLRTLSKDYPTLAFHASINSSFGKGSLLSVLRQFARLKSDKQAISVGFVGYPNVGKSSVINTLRSKSVCKVAPIPGETKVWQYITLTKRIFLIDCPGVVYQNNDSETDIVLKGVVRVTNLADASEHIGEVLRRVKKEHLKRAYKIEDWVDDNDFLVQLSKTTGKLLRGGEPDLTTTAKMVLHDWQRGKIPFFVPPPQQGEDSPSETAEPVEKSDEEGVSSDRTAAAMKAIAGIISSQQQMNVPCQKEFGVTNEDSEVAEQSE

SEQ ID NO: 17669 - protein, 283 aa, Heliobacillus mobilis
MSKELRQRIAQYGIRAKKGLGQNFLSDSEYVYRIVDAAELSSGDVVVEIGPGPATLTPHLAEAVGPEGKVLAIEVDESLRPLLMDLCREYPQVEILWQDALKVDYDAVTAPYRGDKPFTLVANLPYYITTPIMMGLLEGRFNLSHMVIMVQKEVADRMLARAGTKDYGALSVAVQYHCEVKLVTKVPPGAFIPPPKVSSAVVRLNRRRQPPVHVFDEKAFFRVVRAAFNQRRKTLLNALGGLGLEMTKTEMSERLAQAGIDPGRRGETLNLDEFARVTDALYR

SEQ ID NO: 17670 - protein, 542 aa, Salinibacter ruber DSM 13855
MVEFELLRSLGIMLLAALGVVLVARTARVPNIVAYIGAGLLLGPALGVLTVTHTIELIAEFGIILLLFLVGLELSLDKIKAVGTTAFVAGGVQMGGTALGGGLLAGLVGVPVVEAVVVAVAIMFSSTVVVVKMLEKQSDLDAPYGQIAVGVLLVQDLVVVMVLTFVAGLAGPGELAWADVARGLGQAFVGMVLLGGLIAAAARYVLPPAIQWISRMTEGLFIWSLFWCFLVVLGAEALHLSPELGAFLAGIALAQLPQCHELRQRVHPLMNFFIIVFFVSLGLQMELGAALARWPLALALAAFVMVVKPLLFFGVLPRLGHGEETSFRTGLSLAQISEFSLIFGALALSSGLIDEALLSVITLVGLVTFALSSFLLLYSDRLYAAVKPYRPLAWLGARQEAPAPPPDGLQGHVIVVGLNTLGRCLVDRLTAAGETVVAVDTDPEKLARRSVSTVHGNAVHETTREAADWEDAKLVVSSLSIEGTNNLLAYHAQRAGVPCSIHAFDRTSENSLRTFGVDHLIRSKHEGARRLLDELKSRAVLS

SEQ ID NO: 17671 - protein, 268 aa, Magnetococcus sp. MC-1
MKKRVRVPDLVRMKQQGEPIVALTAYDYTLARLVDAADVDLVLVGDSLGMVVQGHETTLPVTLDEMIYHTRAVARGCQRALVVLDMPFGSTQNGPERTFEQAARAMKESGAAAIKLEGGQAMAATVAYLTERAIPVIGHLGLTPQSVHAFGGFKIQGRDQAAAQRIADDALALQQAGAGAIILEGIPAALAQQVSQSLTIPTIGIGAGVGCDGQVLVIYDMLGLYGDLAPKFVKRYLDGVPVIGGAIGAYVQEVRNRQFPTPDHSFEK

SEQ ID NO: 17672 - protein, 127 aa, Brassica napus
  misc_feature (76)..(76): Xaa can be any naturally occurring amino acid
  misc_feature (121)..(121): Xaa can be any naturally occurring amino acid
  unsure (1)..(127): unsure at all Xaa locations
YDTDKEMTLLKFVDDQWGPVRSFNWFATHGTSMSRTNSLISGDNKGAAARLMEDWFEQREELVSDEIPRRVSSIIXNHQDSRKLASEELLQIASYFESQPGRPATRVSSAATRVTSALRKXDNPGFV

SEQ ID NO: 17673 - protein, 321 aa, Festuca rubra
MNSTSPRMILPVCSSPSTKTLNWLLSTPVKGARANRIRVQRGLPDPACVIIPHRTFALSQLPVHEFYGHGDAILDLSWSKNGDLLSASMDKTVRLWQVGRDSCLKVFSHTNYVTCVQFNPTNGNYFITGCIDGLVRIWDVRKCLVVDWANSKEIVTAVCYRPDGKGAVAGTITGNCRYYDASENRLELESQVSLNGRKKSLHKRIVGFQYCPSDPKKLMVTSGDAQVRILDGAHVISNYKGLQSSSQVARSFTPDGDHIVSASDDSRIYMWNYANQLAPLTSRVKSVWSSERFFSNDVSIAIPWNASQARNSISLSCNIPS

SEQ ID NO: 17674 - protein, 450 aa, Lactobacillus johnsonii NCC 533
MKQQNHLKRSLGFFSAISIVIGTIIGSGIFFKQASVLQSAHNSTLAISAWIFGGVITLAAGLTIAEIGAQMPYTGGLYVYIEKLYGRILGFLAGWMQVIVYGPAIIAAVGGFTGILIANFFNLNDSWRIPLSIGCMLFITIINFLDNKVGAAFSVITTIGKMIPIAAIIIFGIFWGQNNALGQTISDVKQSSGGFGVAVLATLFAYDGWILIANLGGEMKNPQKVLPQAIILGITIVLTIYTLITVGILRFIPADLIERLGEDTTTYLATKAFGNIGGKLLTLGIIISMLGTLNGKIITFPRIVYAMAKRNDLPFSSYLTYLTPKGKSPIVATIFITVLATLMLVLFDPDRLSDLCVFTIYCFYILAFFGIFKLRRENSNRPFSTPLYPLVPIVAILGGLFIIVSELFNDPAGVVLFLGIVAVGLPIFYYLKRKEKTSRNKAIEINENHD

SEQ ID NO: 17675 - protein, 480 aa, Oenococcus oeni PSU-1
MENKKTNISKTNYALNFIKTKSKAERHLKIIALCVTLGGLLFGVDTGVINGALPYMAKKQELNLNPATEGLVTSSITLGAAFGAIFAGRLADRYGRKRILFYLSIVFFFCTAICSLAPNAIIMMIFRFLLGLAVGSASVIVPTFLSEIATVKLRGPLVTQNEIMITGGQLLAFVVNAILGNIFVNVSNIWRYMIAFGMIPSALLFIGTLIVPESPRWLIMKGKTKTALKILKGIRSDKRQSQQEVTQIQATLKKEKEVSHISWYDLKKPWIKKLIILGSGLGIVQQIVGINIIMYYGTTVLIKAGFTHNIALITNIANGIVSVLATYTGMHLMNHINRRKMLLTGIAGTGGALALITLVSQILPHSKLLPVCVVFLTLIFLSFFQGCISPTIWLLMSEIFPQNLRGLGMGISTFFLWMANFLVGFLFPIFLNYFGFSITFGIFVLCNLISFIFVYKFAPETRNKSLERVQLELRTRIDKN

SEQ ID NO: 17676 - protein, 226 aa, Triticum aestivum
  misc_feature (77)..(77): Xaa can be any naturally occurring amino acid
  misc_feature (88)..(88): Xaa can be any naturally occurring amino acid
  misc_feature (127)..(129): Xaa can be any naturally occurring amino acid
  unsure (1)..(226): unsure at all Xaa locations
ANYVLCSYILEMVQFILWNRILIAELVELPPADTLNDFLCFLQFIIGSSFDAFHDCVIQLPKVLWIIETAPNDELKXAKEIIQRIRRXELYKFCNQYSVPKDKLDHFKNITAQDIVCSQITSKVLLXXXDVAVSNVKIDLTRGKDNPLESIKFFKDFGCEEKFPITDERVSHLLPVCNQDRIVRVYAKKPDLVEAVSEAFENLQLRMYGEKTQVHGTPTKKKRRFN

SEQ ID NO: 17677 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFGYITKAVAEMHGLYATFMPKPLFGFPGNGLHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFSYVEENVYEMSEEKRKELGLETLPGNLGEALGELEKDKVVKEALGDSYKNFINYKWKEWESYLEYLEEKHIPPDTEKVTEWELERYFFL

SEQ ID NO: 17678 - protein, 99 aa, Zea mays
MAWRASLSRSLKEIRVLFCQSSPASAAAREFVKKNYGDIKARNPSLPFLVRECSGVQPQLWARYDMGVERCVNLDGLTEAQIDKKLEELAKAGESLKTK

SEQ ID NO: 17679 - protein, 382 aa, Gluconobacter oxydans 621H
MSFTIASRLADLPRPATIAMAARARELKAQGADVISLALGQPDFPSPPEAIEAAYAAAKAGDTGYPPIPGQKPLIDAIIRKFRRDNALDVTSDRIMVANGGKQVIFNALMASLEVGDEVIVPAPYWVSYPLITRMLGGVPVEIRCREENGFRPDPEAIREAITPRTKWLVLNFPNNPTGAILERQNLEAIADVLREAPHVLVMSDEIYEHLTFDGKKHLSLLSVAPDLADRILIVNGMAKAYAMTGWRVGFACGPVPLIQAMIAVQGNSTSGVCTLAQAGSVAALDGDADGIARMLETYERRRGLVVGALQQVPGLTCVMPDGASMPIRGCGPDWWHIGAGTVARHGCGFCGGTSGRSACRDRAGLGVRIQPVSAPVFCCFG

SEQ ID NO: 17680 - protein, 406 aa, Gluconobacter oxydans 621H
MIRKPVMSFIADRLNRILPSQTIAVTQKARALKAEGRDIISLSAGEPDFDTPDFIKRAAIRAIEAGKTKYTDVAGTLELRKAVAARLNADFDLDYKAEEICVSTGGKQVIYNVMVSTLNAGDEVIIPAPAWVSYPDIVTLADGTPVIVQTDPENGFRLTAEQLRAAITPRTKWLCLNSPCNPTGAAYDTEALKALTDVLLDYPDIWILTDDMYAKLLYDGAVAKTVVQVEPRLRSRTVTMNGVSKAYAMTGWRIGFSAAPVELTRQLVKLQGQSTSNPCSIAQAAAQEAVSGPQDFISEMVAVYQERRNLVIGMLNEAPGLSCALPEGAFYAFPSIAGTLGKTSKGGRLIDGDEAFVTALLEETGVAAVHGTAFLTPGYFRISYATSTELLKEACTRVQNFCRGLS

SEQ ID NO: 17681 - protein, 147 aa, Brassica napus
MGGKGWFLLKLLMFQGLFTSPPQDPGFDFFYFVLQWPGAYCDTKRACCYPTSGKPAADFGIHGLWPNYKDGSYPSNCDPDNEFDPSEISDLVSTLQTKWPTLSCPSNEGFKFWEHEWEKHGTCSESVMDQHKYFENTLALRDRVNLL

SEQ ID NO: 17682 - protein, 134 aa, Staphylococcus aureus
HETDKEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 17683 - protein, 526 aa, Aspergillus niger
MAASSSLDHLSNRMKLEWHSKLNTEMVPSKNFRRTSIIGTIGPKTNSVEKINSLRTAGLNVVRMNFSHGSYEYHQSVIDNAREAAKTQVGRPLAIALDTKGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTSGKTARYLSKYRPVCPIVMVTRNPAASRYSHLYRGVWPFLFPEKKPDFNVKVWQEDVDRRLKWGINHALKLGIINKGDNIVCVQGWRGGMGHTNTVRVVPAEENLGLAE

SEQ ID NO: 17684 - protein, 242 aa, Rhodobacter capsulatus
MARHVLGQTDTTMAEAARLAPHLAGPAWVFAHRQTAGRGRRGRDWLMPSGNFAATLVFRPAVTPATAALYSFVAALALEAALTEVMGPGPVTAIKWPNDVLLNGGKIAGILLESVGTGGQISHLAVGIGVNLAKAPPAAALEPGAVAPVSLLGETGLVIDPLDFLAPLARGFAHYAATFERYGFAPIRAAWLARAARIGQRITARTGTETLTGTFETIDDTGALILATGSERRAISAADIFF

SEQ ID NO: 17685 - protein, 134 aa, Staphylococcus aureus
HETDEEINKKAHAIFKYGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 17686 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 17687 - protein, 314 aa, Phytophthora nicotianae
MSQCASFSTGGKGPFARSRKKQQESAVESVEYAELDLNRLAVIGGGNMAEAIITGVLTEGLIPSSKVVVSDPNPSMRGKYAKLNVETHTRNSSAVKDADVILVAVKPQVVDDVLRAVKASMDPDALVISVVAGQSIKQLQQHLGQDSHIIRTMPNTPAMIGEGTTVWAQSAEVTSVQHELTKQILGSFGVEVFVDDENALDMATALSGSGPAYFFLVAEAMIDTGVHMGFSRPVATKLVQQTMLGSALYMQSEDVHPVELRNNITSPGGTTAAGLYRAEKNGFRAVIADSIWAAYERCLELGSSEPVQRQRPRS

SEQ ID NO: 17688 - protein, 366 aa, Thermoplasma volcanium GSS1
MVKIIQDPVFGPIKADGVILDLIDSPEFQRLRRIKNLGLCSLVFPGANHTRFEHSIGTYYLASLYNEHLRTMSDELKIAALLHDIGHFPYSHTIEEFYMETEKIDHLQAGINLIEGKAESEIPAILEKHGIDPHWVSSILKGISNVLSEIISGPLDADELDYLRRDSFYCGVSIGYVNPLRIIDVSSVYEGQIVSEEKGLSDIESLLISRFLMYQAVYFHKTCRIANKMLGIAARLAEAIGTSRMVDEELMALLLSKKRSERIARDIINRRLMKVIFKEKYGEELYRDITDRIGEDAIVDVIPPLSFSGRERLKTDVSVKIQGRIVAGEEISPLVNSLNQAIERRYVYVYGYKEDEEKIKSDLRGL

SEQ ID NO: 17689 - protein, 132 aa, Brassica napus
VFEEAENELKEIETGLQSAETDKNHYEDVMNDKVLPDIKMAEAKHNELEAKRLESNEKASIICPESEITALGPWDGSTPIQLSAEINRINHRLKRESDEYSESIDDLMVTLEEKEHKIGRKRITYKSFREKL

SEQ ID NO: 17690 - protein, 491 aa, Methylococcus capsulatus str. Bath
MSHELRLDQPGLLRTRCLIDGQWVDADHSKTFSVTDPATGRALADVPAMGAAETMRAIAAAEHAWTGWRGKTAKERAAVLRRWYELILSHTEDLARILTAEQGKPLTEARNEIGYAAGFVEWFAEEAGRAYGETIPSPVPDKRLLVIRQPIGVCAAITPWNFPAAMITRKIAPALAAGCTVVVKPAEQTPLTALALADLAVQAGFPPGVINVVTGDPEAIGGELTSNPLIRKLSFTGSTEVGRLLMAQCAATVKKISLELGGNAPFIVFEDADLDAAVEGALLSKYRNTGQTCVCTNRFLIQDSIYDAFAERLAAKVRRLEVGNGLDEGVVQGPLIDEQALAKVERHIADALDRGARVLAGGGRHPLGGRFFQPTVLVDVTPEMLCTREETFGPVAPLLRFGSEEEALAIANATEYGLAAYFYTRDLARAFRVGEALEYGMVGINTGMLSYDVAPFGGVKQSGIGREGSHHGMDEYLELKYLCLGGMAPSA

SEQ ID NO: 17691 - protein, 497 aa, Kluyveromyces lactis NRRL Y-1140
MAGITGITPEFKNSDLIRKGAFVDGQWLETASETFNVTDPATLEVIATLPDQSIEVIHEAIDSAAEAFRLFKKTTPKTRSTWLRNLYNLMMENVDDLAKIITWENGKALSEAQGEVKYAASYFEWYAEEAVRMYGTTIQPNNGSNRAFTVRQPVGVCGIICPWNFPSAMITRKAGAALAAGCTVVVKPDSQTPLSALALAHLAEKAGFPKGVFNVVLTATRTPEFGLALCESPKVKKISFTGSTNVGKILMKQSASTMKKLSFELGGNAPVIVFDDADLEQAVTQTILSKFRGLGQTCVCANRIYVQRTIIDSFAEKLAKQVNEFVIGHGLDSKTTHGCLINENAIKKVEAHVKDALEKGAKTVVAGGRLPELGPNFYAPTVLSHVPSTAVVNKDETFGPLCALIPFDTMEEVVGYANDTELGLASYVFSKNIDTVYTVAEALETGMVSCNTGLFSECTIPFGGVKESGFGREGSLHGIEDYTVIKTITIGNLPAPL

SEQ ID NO: 17692 - protein, 662 aa, Methanosarcina acetivorans C2A
MESLLLRDLLIIFGLSIPVVFAFSRLKIAPLVGFLLAGILAGPFGLGLIQESGEIELLAEIGVVLLLFTIGIEFSLRDLLQLRRIVLFGGGLQLSINTLAVAFVFVLLGSSRETSIFLGALVALSSTAIVLKILQEKGEIYSAHGRTSLGILIFQDVAAVVIILLTPVLAGVSGEENGFFKLILQALGLVLLTLLSARYVVPFIMYHVARTRNSELFLLSVVVIGLSVAWLTSMAGLSLALGAFLAGLIISESEYSTQALGNVIPFRDMFMSIFFISIGMLLDLDILRQHLFLILAATFAVLLLKAFVNALSTFLIGFPLNTMILVGFSLSQVGEFSLILAGVGFANGLLSTEIYQEFLDVAVLSMVLTPFIMSMAPQAAAFAQELPLPQVLKSGWYKGFLEQKREKELENHLIIIGYGVNGRNVATAARAALIPYRIIDINPDTVRKEKSKGEPIMYGDAAQKAVLEHAGIKTAKSVVITAGDPVSAQRIIEAARRLNPEIHIIARTHFLSELDRFYSLGADEVISDEFESSIELFSRVLHRYMVPFSEIETMGEQLRADHYRILRSPEMRRKSLCELSLDFSEVEIRSIRVGKHSGAAGQTLGNLNIRKRYGVSVLAISRNHKLIYDLRAETELKSDDILLVISPPERLEELRELFEEKE

SEQ ID NO: 17693 - protein, 596 aa, Arabidopsis thaliana
MSQSIQFSSPSHTPHLLHLPHSQFNRPLSSISFRRFPLTTIKYTSIRASSSPSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 17694 - protein, 452 aa, Methylobacillus flagellatus KT
MKAGTQKTLTHSDLVEQGVRFLLASYVDLHGVPKAKAVPISHFDRMMNGSEMFTGAALDGVPQEISDEEVAAHPDMGSAIVLPWSKDIAWLPSDLYTQGEPFNACSRTILKKVRQQAAELGMAMQLGIEAEFFVLKDQEAGGFSPISTRHHLKKPAYDVARLLDNKPWLSELVEAMDSLDWGVYSFDHEDGIGQFEIDFSYFEVLRMADNFTFLRMMANEIARKHGGFASFMPKPYGDRAGSGAHFNISLTDINTGLNLFEPEQDDPRGCGLSTLGYQFIAGVLRHLPAICAVVAPTVNSYKRLVKQGSMSGFTWAPVFCCYGNNNRTNTIRIPLGGKRIEIRAVDSACNPYLGAAMILAAGLEGIRENLDPGDPHLDNMYEKTPEELASLGIRELPKTLEEAIDAFEADPLSRQVFGDQMFSAWTQYKREEWLSYITHVSDWEYDRYLKLF

SEQ ID NO: 17695 - protein, 1715 aa, Aspergillus nidulans FGSC A4
MVFKPFTHIARQSFTKAFTHGYAQSVVAASQSSYASSTTLNHLTVANPAKYSRTTQLQHVFQPSSSSGAGAKASQGSSGGGDAGLAAYYAAWQQAQQTGDDSDWKQLQLKRGLGWKPLTEEEASKRKDENGLSPTARSDLNHSPHLTQASVNADVSAKVEEAVAREIQIQEEQARAEEASEAQDASATEAFPDLPDDVAAVGDIATEESRLASERIEQLACDKKFVDIPGAFAALLRDGLTPTVGAYNALLDSAIELHDDRSQAIPKALDVYSDMLRRRVIPDEQTYRMLVQLFVLRAHDAMKAMEVLEQERVRYGGMEEPGKFMLHSSELEKAILAEDDSLGIALKLFDTATARHADLVFPIDTYRHLISACATEGKVDAMVRVYAHMESHKVTPHASIFPSMIDAFASAGELTSAVECYNEYRSLAVSDDNGTFCIIQRLDGQVYAALIKAYITCGKEENAMRFLDRIRSSFDEVTENRETRQEALESVIIHDALVQHALKSGDYAKALGQAKTRLRDGALDQAMSQICIAAADSGNLEIASEAYDLLPKDVETRQKPAVSMLALHVRDGNVSAARSLWLMLSTVGQATSDMVQPTVMYAVALLKSGRTEESLVEARNMFSRIRSSNDLSSNSLREQINECIHLLSRVLVQSAAILSTQASMSLLWLMAENGALISPVAQHAVAFLGPLEISQLNSRDLALALQVQAGILVNNSAMSFDAAHPIRFSHMLDIALATGLAMDSTTVNLVDQAVNKLFTSRPDMVSRWHSYLGLTSSPSSYISGPHTPVSEISSMSSVLSEDSFDPYAYATDFKGSALIADGLESTNGRPEAHLNEALNRLRNMRRAGRHPRYVTYAKLIGAAAKNNRVDLVHEVLSMARRDVPLLPQYKAVKYGWTSILDAMVAACLTLGDRGLAAKYHHELSELGSAPSANTFGLYITTLKESTKTFDEATEALKIFHRAVAEGVEPTSFLYNALIGKLGKARRIDDCLQYFAEMRANNVRPTSVTYGTIVNALCRVSDERFAEEMFEEMESMPNYKPRPAPYNSMIQYFLNTKRDRSKVLAYYERMLSRNIKPTMHTYKLLIDAHASLEPVDMEAAEKVLETVRASGQEPEAVHYASLIHAKGCVMRDMEAAHDVFKSAVSNPKVNVQPCLYQALLESMVANRQVAQTETVVEDMVKRRVEMTAYIANTLIHGWAAEGNIQKAQAIYNSVGIEKREPSTYEAMTRAFLAADDHASASRTVQEMLSRGYPTAVAHKIADLVGNDAHHWDLIASTQGWTRFSLAPQPDINYGHWEALECQELFVFIWTYCIQRLVNYFPSMRHNRLFNPIRPLRWSFPPRRNYHTNPSYFSAMDSTNPQHKRPKKLIFAPGDIEATPETQTPRAGEPLIPASALPPRVVAEALRSDTMTPNTELDNKVLSHPARAHQFVRNPPLTISQLHPTNPLYQFHAWFRDPRLERSSAPETCTLATASLPTGRVSARVVYLKELDERGWTVYSNWGSREGKGGQVFGSSIGQNGDSGFPDSMPSGVDEPLVQDLELKEHGNKWAALTFCWSVLERQVRIEGKVEPLSREESEMYWRTRERGSQIGAWASWQSKVLWSAESGTLVSRRRKSFGPGEDSGSIIYPDIPHDVNETDIDDGRALLEKRVQEMEARFADTKDIPLPPFWGGVRLIPESVEFWQGRRSRLHDRFRYVRIHGTDESSYKWRIERLSP

SEQ ID NO: 17696 - protein, 661 aa, Candida glabrata CBS 138
MATIPKRHTYGGGPEVHYTRNPYSAAPRNSMSSRGKKHVTFGPYIVGSTLGEGEFGKVKLGWTRTPSTGPEQRPAVSKQVAIKLIRRDTIVKNSEKEIKIYREINALKHLTHPNVVRLEEVLQNSKYIGIVLEYASGGEFYKYIQRKRRLKESTACRLFAQLISGVTYMHSKNLVHRDLKLENLLLDKNENLVITDFGFVNEFLPDNEYMKTSCGSPCYAAPELVISTRPYVARKADVWSCGIILYAMLAGYLPWDDDSTNPEGDDIGKLYQYITRTPLKFPEYITPIPRDLLRKILVPDPNKRVNMQYIHRHEWLKPHRPFLAVSTSQWDKLIKNSANVQLDHTKRVSRTSQHFETEQENSSVNQPVRSDMVNKAMDTSNTTDDAQHSIPNRQPLANVFINSRTYSARSASYAPRHSMSDDPNAIESARHAVQNKHESNLATVMGSPNKDKDDTTEDNNLETVARTSSHHRKPRPTSYYPVDINRSANNFSPIVLNLTNSDENDNSKHPYSTSTSNNPVAPTPQRDQSQVVTDEHGLQLEKNRVREQPLTSDKSRMSSLRSNATAKSSDSKKNKRFSLLSFYTNNGSKTSLHNDSKVSVTPSSKEESATVPPSIPSVVHHTDTTENKRNHRASMMGPSAGGDKSTARRVIDFFKRRSMRM

SEQ ID NO: 17697 - protein, 393 aa, Nicotiana tabacum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGVAEYQKLITRNPIFLERVEGVGIIGGDEALNWGLSGPMLRASGIEWDLRKVDHYESYDEFDWQVQWQREGDSLARYLVRIGEMTESIKIIQQALEGIPGGPYENLEIRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 17698 - protein, 149 aa, Arabidopsis thaliana
  misc_feature (90)..(90): Xaa can be any naturally occurring amino acid
  misc_feature (94)..(94): Xaa can be any naturally occurring amino acid
  misc_feature (102)..(102): Xaa can be any naturally occurring amino acid
  misc_feature (113)..(113): Xaa can be any naturally occurring amino acid
  misc_feature (115)..(115): Xaa can be any naturally occurring amino acid
  misc_feature (117)..(117): Xaa can be any naturally occurring amino acid
  misc_feature (119)..(119): Xaa can be any naturally occurring amino acid
  misc_feature (123)..(124): Xaa can be any naturally occurring amino acid
  misc_feature (126)..(126): Xaa can be any naturally occurring amino acid
  misc_feature (133)..(133): Xaa can be any naturally occurring amino acid
  misc_feature (138)..(139): Xaa can be any naturally occurring amino acid
  misc_feature (141)..(141): Xaa can be any naturally occurring amino acid
  misc_feature (143)..(145): Xaa can be any naturally occurring amino acid
  unsure (1)..(149): unsure at all Xaa locations
MASSMLSSTAVVTSPAQATMVAPFTGLKSSASFPVTRKANNDITSITSNGGRVSCMKVWPPIGKKKFETLSYLPDLSDVELAKEVDYLLXNKWXPCVEFELXHGFLYREHGNXPXYXYXRSWXXWXFICWVTXFGQVXXEXMXXXGVPG

SEQ ID NO: 17699 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEATRIQYGGSVKPNNIKEYMAQTDIDGALVGGA

SEQ ID NO: 17700 - protein, 802 aa, Bacillus anthracis str. 'Ames Ancestor'
MFTHVESFKSAFLEKLETMYGKSFKDSTTRDQYNTLGYMVREYMNSQWIATNESYRSGERKQMYYLSIEFLLGRLLGSNILNLGIRDVCEQGLSELGISLQQLEEVEADAGLGNGGLGRLAACFLDSLASLDLPGHGCGIRYKHGLFDQKIVDGYQVEFPEQWLLHENVWEVRRHDQAVEVSYFGNVEPLYIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRLHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEEVLHYYQNGGYRASDYYHHNGHIKKVVDQLTNGFFAQSGAEFEAIYDSLVIQNDEYFVLRDFGPYAERQEAVGRAYENRTKWLEMSILNIAQSGHFASDRTILQYSNEIWGIGNTVTQI

SEQ ID NO: 17701 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTDQSVVALHRIGISSVIKLLTVK

SEQ ID NO: 17702 - protein, 340 aa, Selaginella lepidophylla
MGSEAKIKIGINGFGRIGRLVARVVLERDDVELVAVNDPFISTEYMAYMFKYDSVHGKWKKADVEVKDHETLIFGGKPVGCFACKDPSEIPWGKFGAEFVVESTGVFTDRDKASAHLKAGAKKVVISAPSSNAPMFVMGVNENDYKPDIDIVSNASCTTNCLAPLSKVINDRFAIIEGLMTTVHSLTATQKTVDGPSSKDWRGGRGAGFNIIPSSTGAAKAVGKVLPALNGKLTGMAFRVPTADVSVVDLTVRLEKPASYEEIKKAVKEESEGKLKGIMGYTEDAVVSSDFIGDSRSSIFDAAAGIALNDSFVKLVSWYDNEWGYSNRVVDLIVHMAKTK

SEQ ID NO: 17703 - protein, 266 aa, marine gamma proteobacterium HTCC2207
MTIQHQARKRFGQNFLVDQHIIGQIVAAIGPSADDNLIEIGPGTAAITEHLIQRCPTMKVVELDRDLVGFLTEKFADYPDFSIYSGDALKTDFAQFHDGRQLRLVGNLPYNISTPILFHLLKNRTLIKDMHFMLQREVVDRLSAAPGSKTYGRLSIMVQYHCRVMPLIPVPPSAFRPAPKVQSAIVRLKPHSTKPCLAENEELLSQIVSLAFQQRRKTLRNGIRAYAEHLVGVEAVVDLSRRAEDLSVADFVALSNYINQRILSKK

SEQ ID NO: 17704 - protein, 428 aa, Zea mays
  misc_feature (212)..(212): Xaa can be any naturally occurring amino acid
  unsure (1)..(428): unsure at all Xaa locations
NPLVAMVCNGSPETTLALASSLDGSNREKKRRARFLEGRRSMSSDRLMVPEHVFALSEKPIRTFVGHSEDVLDLCWSKSQYLLSSSMDKTVKLWHISSTSCLKTFSHSDYVTCIQFNPVDDRYFISGSLDEKVRIWSIQNREIVDWKDLHEMVTAACYTPDGQSALIGSHKGSCHIYDTSDNKLLQKKQIDLQIKKKKSSQKKITGFQFLEXFLPGSTSRVLITSADSRIRVVDGLNLVHKYKGFRNTNSQISACLAANGRYVISASEDSHVYIWRNDGSLEKGRSKANVTVTNSYEHFHCQDVTVAVAPPSNGSAVVSRSNSTKHDERDSVLEHPMLHAVPEKLQDSSDLQLQSGNILSTSSNHSGDRATWPEELMTPTKQSPQSSASLLSGADQAPSWSAWGTVIVTAGRGGQIRAFQNFGFPARV

SEQ ID NO: 17705 - protein, 659 aa, Oryza sativa (japonica cultivar-group)
MATMKLGSKPEIFVLEGLTWRCMTELESDVVVEVGEMSFYLHKFPLLSRSGVLQRMISEYQAPQEDGGGGGGMCTLQLDDIPGGAKAFELAARFCYDVKIELNAHNVVCLRCAAEYLRMTDDYAEGNLITQAESFLADVLANWKDSIKALETCEGVLPTAEDLHIVSRCITALASKACASDAAACSTGHAAASASAVAVAAKNASYDALWNGIGSGGTPRGGGGAAGAAAGCSGMDWWYEDVSFLSLPMFKRLIQAMEGKGMRPESIAGAIMFYAGRFLPGLKRNTSFSNASFGGDCGAGSRSITPRAANVSAPSEGDQRYFLEEIVALLPAKKGVASTRFLLGMLRTAMLLHASPLCRENLERRIGAQLEDACLDDLLVPNLGYTVETLYDIDCVQRILDYFMSSTDGLGTGYTSPAVVEEGSQLGALHAGSPSSLSPITMVAKLMDGYLAEVAPDTNLKLPKFQALAAVVPDYARPVDDGIYRAMDIYLKSHPWLSESEREQLCRLMNCQKLSLEACTHAAQNERLPLRVVVQVLFFEQLRLRTSIAGWFFVSGNAAAGGDGAPQPHPGGSAIVPKGAAAAGQSDADAEADEGKGKELPAEAITDVKARVSELEKECMSMKQEIRRLGKPRRSWSLLTRKCRFGTKVQQAQPTMSSK

SEQ ID NO: 17706 - protein, 408 aa, Streptomyces avermitilis MA-4680
MSAATPPTERRVSARVGAISESATLAVDAKAKALKAAGRPVIGFGAGEPDFPTPDYIVQAAIEACSNPKYHRYTPAGGLPELKAAIAAKTLRDSGYEVDASQVLVTNGGKQAIYEAFAAILDPGDEVIVPAPYWTTYPESIRLAGGVPVDVVADETTGYRVSVEQLEAARTENTKVLLFVSPSNPTGAVYTREQIEEIGRWAAEKGLWVLTDEIYEHLVYGDAEFHSLPVVVPELADKCIVVNGVAKTYAMTGWRVGWVIGPKDVIKAATNLQSHATSNVSNVAQVAALAAVSGDLTAVAEMREAFDRRRKTIVRMLNEIGGVLCPEPEGAFYAYPSVKALLGKEIRGKRPQDTVELAALILEEAEVAVVPGEAFGTPGYLRLSYALGDEDLVEGVSRIQKLLSEAKD

SEQ ID NO: 17707 - protein, 138 aa, Triticum aestivum
  misc_feature (89)..(89): Xaa can be any naturally occurring amino acid
  unsure (1)..(138): unsure at all Xaa locations
MASEQTFIMIKPDGVQRGLIGEVINRFEKKGFYLKGLKLQNVEKSFAEQHYADLSSKPFFAGLVEYIVSGPVVAMVWEGKSVVSTGRKXILAPPNPLASEPGNIRGDFCRSTSGRNVIHGKRTFEKCEGKEDRPVGFP

SEQ ID NO: 17708 - protein, 435 aa, Mesorhizobium loti MAFF303099
MGNDLAAFAKKNGVKYFMISYTDLFGGQRAKLVPAQAIADMQKDGAGFAGFATWLDLTPAHPDMLAVPDPDSVIQLPWKKEVAWVAANCIMDDKEVDQTPRNTLRRLIAEAAGDGMHVKTGVEAEFFLISPDGSVISDQYDTASKPCYDQQAVMRRYDVIAEICDHMLALGWGPYQNDHEDANGQFEMNWAFDDVLATADKHSFFKFMVKSVAEKHGLRATFMPKPFQGLTGNGCHAHISVWDETGKTNVFADNSMELGLSAKGKNFLGGIMKHASALAAITNPTVNSYKRINAPRTISGATWAPNTVTWTGNNRTHMVRVPGPGRFELRLPDGAANPYLLQAVIIAAGLDGIRSKADPGKRYDIDMYQHGHTVKGAPKLPLNLLDALREFDKDKSLKAALGEEFSSAYLKLKHQEWNSYASHFTQWERDHTLDI

SEQ ID NO: 17709 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLGSSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 17710 - protein, 278 aa, Rhodopseudomonas palustris CGA009
MSLAIGSASGTLQPFIARVLMPVPAVRPLIAGNWKMNGLKDSVAELDAMLKGAAELPQGIDLLVCPPATLVASFAARVAEAQAGKALPFSIGGQDCHANASGAHTGDIAAEMLADAGAAAIIVGHSERRADHAENDAIVRAKAQAVWRAGLVAIVCVGETQGERDAGHTLDVVAGMLAGSLPDGATAANLVVAYEPVWAIGTGRTPTAADVEEVHGFIRKTLSDRFGAAGETMRILYGGSVKPSNARELLAVPHVNGALIGGASLKASDFLAIAAGCP

SEQ ID NO: 17711 - protein, 179 aa, Oryza sativa
  misc_feature (11)..(11): Xaa can be any naturally occurring amino acid
  misc_feature (20)..(20): Xaa can be any naturally occurring amino acid
  misc_feature (33)..(33): Xaa can be any naturally occurring amino acid
  misc_feature (66)..(66): Xaa can be any naturally occurring amino acid
  misc_feature (73)..(73): Xaa can be any naturally occurring amino acid
  misc_feature (167)..(167): Xaa can be any naturally occurring amino acid
  unsure (1)..(179): unsure at all Xaa locations
MASSGFSLTLXPDHPKLPKXKTVALVVLDVMWXEANADKYNCIHVAQTPVMDSLKNGSPERWQTLXWTGAHGXTAVGLPSEDDMGNSEVGHNALGAGRIFAQGAKLVDLALASGKIYDGEGFNYIKECFDKGTLHLIGLLSDGGVHSRLDQVQLLLKGASERGAKRXRVHILTDGRDVL

SEQ ID NO: 17712 - protein, 206 aa, Zea mays
  misc_feature (164)..(164): Xaa can be any naturally occurring amino acid
  unsure (1)..(206): unsure at all Xaa locations
MHKLGRGSRDKVQQFMAITGASEKAALQALKASDWHLEGAFDVFYSQPQIAVANTRHLEELYNRYKDADMIMVEGISQICNDLQARTSFILVDPQDIVMLVISWHMKASTMCEFTRQEFIGGLQSIGVDSIEKLQAKLPSLRAELKDDHKFHEIYNFAFACARXKGQKSLALQTAIGMWQLLFAERSWPLIDYWCQFLQVRHNKAF

SEQ ID NO: 17713 - protein, 519 aa, Candida glabrata CBS 138
MRVRKKTSKRTSTRMREGIKKKATAQRRKEKKMAKKDITWKSRSKKDPGIPASFPYKAQILEEIEAKKMREMEERELAKQQRLEAKRAAMEAGVTEEMMDDDEDDSNGLSALVESAQAAAEEYDGHPYSEELQSQPVDVIDYDIDFYTDADNDNDSELEKSRKAYDKIFKTVVDASDVILYVLDARDPEGSRSRRVEQAVLQSQGKRLLLILNKIDLVPPHVLEQWMNVLKSSFPTIPLRAAPGATNKSTFNKKLTQSATANALMDALKTYANNSKLKRSIVVGVIGYPNVGKSSVINSLLSHRGGTSKACPVGNQAGVTTSLREVKVDNKLKILDSPGICFPGENRSMSKVEQEAELALLNALPPKYEIDPYPAILKLVKRIAGSDEMTENFKKFYELPPIPSGDPETFTKHFLIHVARKRGRLGKGGVPNLSSAGISVLNDWRDGKILGWVLPKASKNNTIEPSVQESTISSGAQPAPAKSEQTTIVSDWSKEFDLDGLFSTLDNAIQDSKDQAMQD

SEQ ID NO: 17714 - protein, 530 aa, Aspergillus niger
MLFRSLLSTAVLAVSLCTDNASAAKHGRFGQKARDAMNIANGSANAVKHSLKIPVEDYQFLNNKTKPYRVESLPDVHFDLGEMYSGLVPIEKGNVSRSLFFVFQPTIGEPVDETTIWLNGGPGCSSLEALSPGECRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAAPASTLTALIKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 17715 - protein, 377 aa, Aspergillus oryzae
MPGRTLPTFTSAEVESHNNAKSCYVTLGSKVYDITSFVDDHPGGGDLILEYAGRDVEEILRDTVSHEHSEAAYDILEDSLIGFIASESTGKGASIDAAKANGVGGTSGPVYAATGMSREEDLSVETDYSKDYQTHKFLDLNKPLLMQLWNGGFSKEFYLEQIHRPRHYKGGESAPLFGNFLEPLSKTAWYMVPIIWLPPVTYGTVLGFAGLGNVYAAAAYWIGGLALWTLIEYLMHRFLFHLDKYLPDNRVGLTLHFLLHGIHHYLPMDKYRLVMPPTLFVVLATPFWKLAQSVFFYNWYAALTVYCGGIFGYICYDTTHYWLHHRNLPPYYKGLKKYHLQHHFADFDNGFGVTSRFWDRVFGTELQTPAPKDVKTQ

SEQ ID NO: 17716 - protein, 578 aa, Rickettsia conorii str. Malish 7
MEKMNDHILINVIILLGTAVFIVAILKRLRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIEENRSQSTQIGRVSLAILLLQDLAVVPLLVIVPLLAGNNKASLAAALGIALLKAVTALLTIFIVGRVFLRPVFSFISSESNNASELPISMTLLIVLSAAWATETFGLSLALGAFVAGVLVAETEFRLQAEESIYPFKSLFLGLFFMTVGMNIDALEMYEKISHILTLSIALIGIKTLIITAFCILFGFNKGVAFYSGLLLSQGGEFGFILFSLGKDSGVLEESTADILLLVVTFTMALTPLLAALGQKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYETGLQIGGTVLKNIGISEQEINRIKVQFRLGNYIIAKKEDALSEVEDND

SEQ ID NO: 17717 - protein, 663 aa, Rhodopseudomonas palustris CGA009
MSPRRSRGCSSVPKVAVARLVRLARLADGGAKFGAAVGDGWWAGLCRSLPRLGRSAPDDDGNPPRRSFDNHRVARGDRVEIGSKGQRRCYMVVDVIPDGSGVIDRATEVTIDHRAMADATTSPYDDVGGLAREVALVREMVELPLRFPHVFARLGIEAPKGVLLYGPPGCGKTLIARTVAREAGVYFLHVNGPEIIQKHYGESEEMLRRIFADAQKQPAAIIFFDEIDAIAPNRETVLGDVEKRVVAQLLALMDGLTARGNIVVIAATNLPNSLDPALRRPGRFDREIGIAPPDRAGRLEILRIHTRRMPLADDVDLAQIAAAAHGYLGADLAALCREAAMGCTRDLGPRLVAGDPGAAAALDGDLQVRMDHFRRALREVPLASTRSLTTEVAASHWDEVGGLDDIKALLRETVEWPLKYPQRLAFAKTTAPRGILLTGPTGTGKTLIVRALATQSDVNFIAVNGPELLSKWVGETERAIRDVFRKARQSAPSIIFFDEVDAIVASRGGDDGGARIGDRMVGQFLLEMDGLAGLDGVVVIAATNRPDLIDRALLRPGRFDHIATLALPDRAARAAILAIHCRGRALGSDVDLAALAKACAGMSGADLEALCRRAAMAAIRASIIAEPGADFAPFAITGGDFDAALADWRTATPEGASKLDAVA

SEQ ID NO: 17718 - protein, 248 aa, Synechococcus sp. WH 5701
PIEKHHHEVAASGQQELGMFAELISAADNVMIYKYVVRNVARKYGRSATFMPKPVFADNGSGMHVHQSLWRDGQPLFFGLGTYADLSQTARWYIGGLLRHAPSFLAFTNPTTNSYKRLVPGFEAPVNLVYSQGNRSAAVRIPLSGENPRAKRLEFRSGDAMANPYLAFSAMLLAGLDGIRQQIDPGDGMDLDLFELPPEDLEQIATLPSSSEGVLAALEADHEYLLAGEVFSEDFISNWIALKSEALQ

SEQ ID NO: 17719 - protein, 271 aa, Vibrio cholerae
MRNDVHLGHKARKRFGQNFLNDPYIIDGIVSAINPKPGQNLVEIGPGLGAITEPVGREVDKFTVIELDRDLAERLRNHPELASKLTIHEGDAMRFDFKQLVKPNNKLRVFGNLPYNISTPLMFHLFEFHRDIQDMHFMLQKEVVNRLAAGPGTKAYGRLTVMAQYYCKVVPVLEVPPSAFVPPPKVDSAVVRLVPYEDLPHPATSLEWLDRVVREGFNQRRKTVRNCYKGLAEPETLETLGINPGMRPENLTLAQFVALANWLDATHKTHA

SEQ ID NO: 17720 - protein, 265 aa, Xylella fastidiosa
MESQLFNAPAKKAFGQHFLVDRYYIDRIIHAITPQPNDHIVEIGPGQGAITLPLLKCCGSLTAIELDRDLIAPLTAAATPLGKLDIIHRDVLTVDLSILAKPGNKKLRLVGNLPYNISSPILFHVLQQAAIIADMHFMLQKEVVDRMAAPPGSKVYGRLSVMLQAWCEVTTMFVVPPDAFQPPPKVNSAITRLVPRDPTTIRIADTKRFSDIVRAAFGQRRKTLRNSLADICTPAHFEHAGIRTNARAEQLEVTEFIALANAKDT

SEQ ID NO: 17721 - protein, 362 aa, Robiginitalea biformata HTCC2501
MNSSNYYAVLMAGGVGSRFWPVSTRQFPKQFHDMLGTGQSLLQRTFSRLARFIPEEQILILTNTRYNDLVLEQLPGLSPEQIIGEPAMRNTAPCILYAAMKIRKMNPEALMLVAPSDHWIEDEAAFERDVTACFSQCADHQTLCTLGIQPTFPNTGFGYIEFDAGGNAPRELRDVVQFREKPDYQTAKGFLQQGNFLWNAGIFAWSAKGILEAFRHYQPGLFELFEKGLESFNTEGESEFIERYYPTAENISIDYAIMERSDSVKVLPASFDWNDLGTWGSLYDKMEKDRQDNAVAQGRVLSRDSSGNMVRLPGEKVAVLEGLKDYIVIDKPEVLMIIPRDREQEIKQWVAEVGDTFGDEYI

SEQ ID NO: 17722 - protein, 407 aa, Magnaporthe grisea 70-15
MSNAVVGTVYEQIIKGVMEASRTDFEDNGFGESEINELQQVWQQKLTTMGAASFPWDPKPDAPTPPPPPAQADQHRMPPTANYTQATLSPPTAAQPGLALPRPNPPANNGVQQKKDATIGEPAIKLEPGTQPVGQFAPPAGNATNIAQQRAMQNIANYAAANNMMQSGAQAQQQRMPMPMPMPPAQAQQQQQQQQQQPQLAQQQAYQQHQQQIPSNPQQQMQPPQQPQNGSLGQSQTDGPAHEEDTWEAVMMRRNADGSATAMGRVEVDRMLHAKIAAQAKAMEGGGLMVPLKQVKTKKNKDRRRRAAPQATITGPSTSGGSVPQVDGPDDDDGDEDLDDAINSDLDDDNEPDESDEDGDELQQQMLCLYDKVQRVKNKWKCTLKDGVLCVNGKEYVFHKATGEYEW

SEQ ID NO: 17723 - protein, 153 aa, Zea mays
MEEELSQMEPGAKVTLQRQASSGSLTQGPSGELRRQTSLESSPRSGRGGNRHLFGRQSSMDPNRRRGRSQSPVGSQADQDLAVPDNLDSTMQLLFLACQGDAPGVEALLRGGVDVNSINLDGRTALHVAACEGHREVVSVLLDWEANIDARDR

SEQ ID NO: 17724 - protein, 666 aa, Gibberella zeae PH-1
MVLAKSKNSVGLGNALMNDRFGKGKGTDRKRTSAITRTNHATGEQYLVNEKKDAAWVKMRSVTEQGDLDEFLATAELAGTDFTAEKTNNVKIIHTDQKNPYLLSAQEEKDVLGKHKQHKGRLSVPRRPKWDSTTTPDELDRLERESFLNWRRGLAELQENNDLLMTPFERNLEVWRQLWRVIERSDLIVQIVDARNPLLFRSEDLDDYVKEIDPKKQNLLLINKADMMTPKQRLAWAKHLTEAGIAYRFFSAELAKAENEARNLEDSDDEAVDSPVEEQGESSGQQEQEGASLTEEPEESQIDQEAKVAEETDEIDTQILTVEELEGIFLKHAPADAGSGHKLQVGLVGYPNVGKSSTINALIGSKKVSVSSTPGKTKHFQTIHLSPDVVLCDCPGLVFPNFATTKADLVCNGILPIDQLREFLGPVGLVTQRVPQPFLEAIYGIHVRTRAIEEGGTGIPTASELLRAYARARGFQTQGLGQPDESRAARYILKDYVAGKLLFVSPPPGIDDAADFNRGLYDEEHLPEKRRAALSAAMSHLSVVDPASSEPFLADDDDAVDLASTISVPLPAGPKSQKLDKGFFGPGSNQGHVSKPFNYQYSDQGKEDPLAGKHLSGRKARTMVALENGLDPKDVAKTSSKKHFKGNPAGGKGKRRIARKLNAEED

SEQ ID NO: 17725 - protein, 352 aa, Thermoanaerobacter tengcongensis MB4
MKGFAMLSIGKVGWIEKEKPTPGPFDAIVRPLAVAPCTSDVHTVFEGAIGERHNMILGHEAVGEVVEVGSEVKDFKPGDRVVVPAITPDWRTSEVQRGYHQHSGGMLAGWKFSNIKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIDSQIMDLTEGKGVDAAIIAGGNVDIMATAVKIVKPGGTIANVNYFGEGDVLPVPRLEWGCGMAHKTIKGGLCPGGRLRMERLIDLVVYKRVDPSKLVTHVFRGFDNIEKAFMLMKDKPKDLIKPVVILA

SEQ ID NO: 17726 - protein, 241 aa, Thermoplasma acidophilum
MADYEKQKMNAAIKAAEYVRSGMIVGLGTGTTSYYLINEIGRRVREEGLKIRAVCTSRRTEDLAKQNGIEVIQGTKDQIDLTIDGADQVGMYGTLIKGGGGALLREKIVAYNSKEMYVIVDSRKIEAAHFGSFPLPVEIVPFMHMRTLENLRGICTQTDLRMNEKGEPFVTDNGNYIADMHMGMIDDPINLERSLKSIPGVVEVGLFNGIAKRIFEGTDEGCNIYSITNSGIKKEEVYFDP

SEQ ID NO: 17727 - protein, 561 aa, Arabidopsis thaliana
  misc_feature (149)..(149): Xaa can be any naturally occurring amino acid
  misc_feature (177)..(177): Xaa can be any naturally occurring amino acid
  misc_feature (196)..(196): Xaa can be any naturally occurring amino acid
  misc_feature (213)..(213): Xaa can be any naturally occurring amino acid
  misc_feature (221)..(221): Xaa can be any naturally occurring amino acid
  misc_feature (386)..(386): Xaa can be any naturally occurring amino acid
  misc_feature (398)..(398): Xaa can be any naturally occurring amino acid
  unsure (1)..(561): unsure at all Xaa locations
MANHHRLLRGGGSPAIIGGRITLTAFASTIALFLFTLSFFFASDSNDSPDLLLPGVEYSNGVGSRRSMLDIKSDPLKPRLIQIRKQADDHRSLALAYASYARKLKLENSKLVRIFADLSRNYTDLINKPTYRALYDSDGASIDESVPRXLEKGVKERIRISLNVIAKANEFFEYKLXFRCVIDLVLIEIEKESRFXNSCNYGFYFRSITVIKXFHNFVLRXFEERIAHPEKYTDEGKDRPRELEDPNLYHYAIFSDNVIAASVVVNSAVKNAKEPWKHVFHVVTDKMNLGAMQVMFKLKEYKGAHVEVKAVEDYTFLNSSYVPVLKQLESANLQKFYFENKLENATKDTTNMKFRNPKYLSILNHLRFYLPEMYPKLHRILFLGGXDWIVQKDLTGLXWEIDMDGKVNGAVETCFGSFHRYAQYMNFSHPLIKEKFNPKACAWAYGMNFFDLDAWRREKCTEEYHYWQNLNENRALWKLGTLPPGLITFYSTTKPLDKSWHVLGLGYNPSISMDEIRNAAVVHFNGNMKPWLDIAMNQFRPLWTKHVDYDLEFVQACNFGL

SEQ ID NO: 17728 - protein, 439 aa, Oryza sativa
MHRAELRGECRRRHEPGVADGRLRRTRTFPMGKNGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTIQLCIQYFWEQEEFDIISHQTRISLHFQAGKKQMLRHAFTYHWRLWSIPEIKDCLEEAGFKSIHVWIREMPNTQSSGNAKEYNANRDVKYEELQHFNQADAWNAYVVGVANI

SEQ ID NO: 17729 - protein, 512 aa, Clostridium perfringens ATCC 13124
MSKKPVMLMILDGFGISPNKEGNAVAAANKPNYDRLFAKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKEFIVELENAMKEIGVGEIATISGRYYAMDRDNRWERVELAYNAMVLGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 17730 - protein, 336 aa, Magnaporthe grisea 70-15
MVKCGINGFGRIGRIVFRNAIEHPDCEIVAVNDPFIEPKYAKYMLEYDSTHGRFKGTVEVSGSDLVVNGKKVKFYTERDPANIPWSETGAEYVVESTGVFTTTDKASAHLKGGAKKVIISAPSADAPMYVMGVNEKSYDGSASVISNASCTTNCLAPLAKVINDKFGIVEGLMTTVHSYTATQKTVDGPSAKDWRGGRGAAQNIIPSSTGAAKAVGKVIPALNGKLTGMSMRVPTANVSVVDLTCRLEKGASYEEIKAAIKEAADGPLKGILEYTEDDVVSSDMIGNNASSIFDAQAGIALNDKFVKLVSWYDNEWGYSRRVIDLVTYISKVDGGK

SEQ ID NO: 17731 - protein, 277 aa, Ureaplasma parvum
MNKSFIKNKLKQESFVPSKKMGQNFLLSNNIKNKIVDVANINKDDLILEIGPGWGAITEILVQKTNILIAIELDKRLYAHLKTYIKTSNFHIINNDVLCVDLDNLILDYNNTQKIQKIKVVANLPYAISSKIVLKIIQSKLINDAYIMVQKEMAERIGAKVNTRGYNAFTVLVQLFCKTKILFEVNAKEFHPQPKVQSAVIHLENLHNSVNFNIEELGKFLRICFLNKRKKLKNNLSNIYDIKIINQMFIDYNLDMNLRAENIEPKMFLKLFNYLNR

SEQ ID NO: 17732 - protein, 319 aa, Halobacterium sp. NRC-1
MPPAMSDTRRAVLDALADGPTPGPALADKLGVSRAAVWKHVDALRDAGFTIDSGHDGYTLTGVPDYGGLAVSVDLDAPFTIEHHDSLPSTNDRARERAADGARDTVVLATRQTSGRGRRDRSWESPAGGVWASLVLGPDLPPARVPLLTFAAAVAVTDAAREAGVDAAIKWPNDVVVPGEPAARGNRKLAGILTEMEGEASRVSWVVVGLGVNVNVDPAALAPGATSVRALAGETDRRVFVQRVLERFDALRGRPEAALAAWRERAATLGEHVRITQDDDNTITGRAVDVTAHGALVVATGGESTTVVHAGDCQHVRPA

SEQ ID NO: 17733 - protein, 279 aa, Thermotoga maritima
MDGCHLSRDKLQGDGEGCDLKTSDYLKKYGVRLKKHLGQVFLSDDRIAKRIVKAAELTPEDVVVEIGAGAGTLTEELAKTGARVIAYEIDESLAPILQERLSKYPNVELRFEDFLKAKNVPEGAICVSNIPYNITGPLMEKIIEWKFKRAIVMIQKEVGERILAKPGKKTYGYLSVVVQTFYEVKKLFDVSRSCFVPNPEVDSTVVDLKRKPVDLDFEKFKKFVSMIFAKKRKTLKNNLRPFLSIFEGVDLSRRAEQLTVEEIVELYEKWRRALECSRG

SEQ ID NO: 17734 - protein, 949 aa, Robiginitalea biformata HTCC2501
MKTAQFASRHLGIRPGDLPAMTGRIGVENLEQLIYETLPDGIRLKGPMQLDPPMAEHEFLQHIHELGRENDLMKSYIGLGYHPTITPSVIKRNILENPGWYTAYTPYQAEIAQGRLEALLNFQTVVSDLTGMELANASLLDESTAAAEAMAMIFELRSREQKKTGCVKFFVSEGVLPQTLALLETRSAPLGIELVPGAPETARLDGDFFGALLQYPAADGSVGEFGDFVAQAHSLDIKVAVAADLMSLCLLVPPGEFGADVVVGSTQRFGIPMGYGGPHAAFFATREAYKRQIPGRIIGLSKDVDGKPALRMALQTREQHIKRDKATSNICTAQVLLAVMAGAYAVYHGPDGLRRIAGNIHAAAASLAEGLEKMGVSLRHSSFFDTVTAEVPAGAVRKEAEAAGINLNYFGDGVSVSLNETTGPWDIADILEVFARALGTDSPGCTDFSAESRIPAGLRRATDFLGQDVFNRYHSETEMMRYLKKLERKDLALNHSMISLGSCTMKLNAATQMLPLSMAEWGNLHPFVPVSQATGYQKMLRKLEAYLTEITGFAATSLQPNSGAQGEYAGLMVIRAYHESRGEGHRNVCLIPASAHGTNPASAVMAGMKVVVTKTDDKGNIDVADLEEKVAAHSDSLAALMVTYPSTHGVFESSIRQVTQLIHDNGGQVYMDGANMNAQVGLTNPATIGADVCHLNLHKTFAIPHGGGGPGVGPICVAPQLAEFLPKNPLVETGGKHGIPAISAAPWGSALVCLISYAYIRMLGAEGLTQATKIAILNANYIKERLREAYPILYTGELGRAAHEMIIDCRPFKKMGIEVTDIAKRLIDYGFHSPTVSFPVAGTMMIEPTESESLEELDRFCDALLSIRREIDLSGEQPNPILKNAPHTADMVTADTWDYPYSRAEAAFPLPHVRENKFWPSVRRVDDAFGDRNLMCTCAPLEAYAETVE

SEQ ID NO: 17735 - protein, 542 aa, Zea mays
MEPFFLFVGLALVLCFLTLYYRHLQSKKTSPLEPTEWPIVGHLPGLVANIHRFHDWATGVLAGVGCNFEARGGRTGLRYFITCDPSNVRHIFTSNFANYPKGEEYAAIFDVLGGGIFNADGESWRRQRVKAQMLMTGPRFRAFTARCSRDKVERSLLPFLAHHAAADDEGRPTPCDLHDVFLRLTFDMTCTLVFGVDPGCLALGLPGVPFARAMDDALETLFLRHITPTACWKLMSVLGVGQEKKMAAARRTIDCFVATTVAKRRADKLREGEGEGVCSSFDLLSSFICHEDDSSENDDDDDVFLRDTTVNLLLAGRDTTGAALSWFFYLVSKDPRVEQKLLDELAPIAASRRTKGAEDAAHAGSGMVTFDADELGSGLVYLHAALSECLRLYPSVPFEHKVAAAADVLPSGKELKAGDKVLVFNYSMGRMEGVWGKDCMEFRPERWLNQEGTKLRYEPSYKFISFNAGPRTCLGKEMAFVQMKTVAAAVLWNFAVEVVPGHVVEPKLSIILHMKNGLAVKVTRRDDGTAPSSSCVRHTACF

SEQ ID NO: 17736 - protein, 180 aa, Vitis pseudoreticulata
MASSMVSSATVATINRATPAQANMVAPFTGLKSLSTFPGTRKANTDITSIASNGGRVRCMKVWPTEGLMKFETLSYLPPLTDEQLSKEVDYLLRMNWIPCLEFTKLYPYPHREHNRSPGYYDGRYWTMWKLPMFGCTDSAQVIKEVQEARTEYPNAHIRIIGFDNNRQVQCIAFIAYKPS

SEQ ID NO: 17737 - protein, 540 aa, Yarrowia lipolytica CLIB122
MDKTFSVTVEPSPSPSDLEYGEVKHTTKRALKSRHVQLIALGGCIGTGLFIGSGTILSSSGPGSMLCAYIVMSFVIWTVMNALGEMTTFLPIDGASPPMYVNRFVDDSLAFACGWNYWYAYAILVAAEVTAAAIIFEYWTSAVHSAVWITIVLVTCVLLNIIAVAIFGETEFWFASIKIIGILGLIIVGIVIFFGGGPKHDRLGFRYWKDGKAFLPYIIDGAGGRFCGFWSAIIRSGFSFILSPELVTISAGETEAPRRNIPKATRRFAYRLIFFYICGSLVIGTIVSSDDPLLLNKKNEDASASPFVIGIQNAGIPVLNHIINGVILTSAWSSGNSFLFAGSRTLYSLACQGEAPQIFTKCSKNGVPYYCVAITAAVGCLAFLNVSASSANAFNWLSNLSTISGFLAWICVLIAMLRFRKAVAFNDITLPFKTPGQPYTTIVVLAFISLLTLTNGFTVFVGGSFTGADFVAAYITIPLFLVLYLGHRFGYKRAGLKTTWWRSIPEIDMVSGLAECEKTELLTPERKPRNWLEKVWFWIA

SEQ ID NO: 17738 - protein, 375 aa, Zygosaccharomyces rouxii
MDSEVAALVIDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSMPHAILRIDLAGRDLTDYLMKILSERGYSFSTTAEREIVRDIKEKLCYVALDFEQEMQTAAQSSSVEKSYELPDGQVITIGNERFRAPEALFHPSVLSLESSGVDQTTYNSIMKCDVDVRKDLYGNIVMSGGTTMFPGIAERMQKEITALAPSSMKVKIIAPPERKYSVWIGGSILASLTTFQQMWISKQEYDESGPSIVHHKCF

SEQ ID NO: 17739 - protein, 112 aa, Brassica napus
  misc_feature (95)..(95): Xaa can be any naturally occurring amino acid
  misc_feature (107)..(107): Xaa can be any naturally occurring amino acid
  unsure (1)..(112): unsure at all Xaa locations
MCSIHAVIQVSQPQWRRKKTRFMFHLNPNTKFAFFPRALSSSDNNDGSVSSSRQNNRQMGYDPSEELFGVDFKPRNVSGDSREPRSWFGPNGQYXRELPCPTCRGRXYTSCP

SEQ ID NO: 17740 - protein, 258 aa, Gloeobacter violaceus PCC 7421
MILDKRKFQLHLKTETLGHGFHLYERIDSTNRLAMEFLREGAAEGTTILAEQQTGGRGSNGRQWESLPGGLYLSVILRPQLKLADIFQLTLVAAFGVAQSLGRLTGADVRLKWPNDLVIEQGRRLAKVGGILTETRIQGDRLAGAVVGIGINWDNPVPAEAARLKPLSRRDLDLAPVAAAVLLGLEQSYQLWHQRGIERIVSGYERYLVNLGQAVEVPGHDGQGRIIGIDERGALRVLFLDGGEALVMPSELRLGYAL

SEQ ID NO: 17741 - protein, 331 aa, Phaseolus acutifolius
MMTEGMMDKAVLDDVIRRLLEGKGGKQVQLSESEIRQLCVNARQIFLSQPILLELRAPMRVCGDIHGQYQDLLRLFEYGGYPPAANYLFLGDYVDRGKQSLETICLLLAYKIRYPDKIFLLRGNHEEAKINRIYGFYDECKRRFNVRLWKIFTDCFNCLPVAALIDDKILCMHGGLSPELENLDQIKEIQRPTEIPDSGLLCDLLWSDPDSSIEGWAESDRGVSCTFGPDVVAEFLDKNDLDLVCRGHQVVEDGYEFFAKRRLVTIFSAPNYGGEFDNAGALLSVDDSLVCSFEILKPADRASGSSSKMNFKKQPPQNGKDLVIGKDFRFK

SEQ ID NO: 17742 - protein, 267 aa, Triticum aestivum
SSRRAMSSPASRWTRAPSSLLEPTVRTTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 17743 - protein, 149 aa, Zea mays
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGLADWQSSQHPWIYEK

SEQ ID NO: 17744 - protein, 775 aa, Bacillus anthracis str. A2012
MKKAYEEVDRVLTDSTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEEYQLDVKQTLTLKPGDFKIRIVPRNQTISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKGDELKGVQYAVFGCGDHNWASTYQRIPRYIDEQMAQKGATRFSTRGEADASGDFEEQLEQWKQRMWSDAMKVFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFEPFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNVGEAHLYFGCRHPEKDYLYRTELENDERDGLISLHTAFSRLEGQAKTYVQHVIKEDRIHLISLLDNGAHLYICGDGSKMAPDVEDTLCQAYQEIHEVSEQEARNWLDRLQEEGRYGKDVWAGI

SEQ ID NO: 17745 - protein, 101 aa, Arabidopsis thaliana
  misc_feature (14)..(15): Xaa can be any naturally occurring amino acid
  misc_feature (30)..(31): Xaa can be any naturally occurring amino acid
  misc_feature (42)..(42): Xaa can be any naturally occurring amino acid
  misc_feature (54)..(55): Xaa can be any naturally occurring amino acid
  misc_feature (84)..(84): Xaa can be any naturally occurring amino acid
  unsure (1)..(101): unsure at all Xaa locations
RNNNNVFSMLSSAXXVTFFFQASMVTPFTXXNSSSSFPFTLXTNKDITSISFYXXRFNYINLFPPIVKNKFLTLSYLPDLNDFXLANEFYYLFLNKWIPFF

SEQ ID NO: 17746 - protein, 501 aa, Gloeobacter violaceus PCC 7421
MQSSDPAIRFRAMSAVQPQLEALIDQLDTIRSHAESLKQQFAEHLQHVHPNFADSAHNLIDYLALRQFDLREIQEQLSGLGLSSLGRTEAHTMASLNAVVQVLERLAGSGGEVVSFADDYARGRDLLTAHTEVLLGPRPATRATRIMVTLPSEAEGDYRLLCALIRAGMNCARINCVHDSETVWERMVGNIRRAEREVGRACRILMDLGGPKLRTGPLAEPLTLRKGEGLVLCRDAEEGRSACEDSPARVVCAVSGIYGGVQVGEAVLFDDGKIESVVRGVAQDEIQLEITRADDKGSRLAADKGINFPESRLKLRGLSEQDLEHLDFVARRADIVGMSFANEPEDVFALQAALGERGAGHLGILLKIETRRGFEQLPRLILAAMRSYPAGVMIARGDLAVECGWERTAEVQEEILWLCEAGHMPVVWATQVLEKLAKKGLPSRAEITDAAMSQRAECVMLNKGPHIVEAVHSLADILCRMQEHQHKKTATLRSLKVSNLV

SEQ ID NO: 17747 - protein, 332 aa, Buchnera aphidicola (Acyrthosiphon pisum)
MTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 17748 - protein, 455 aa, Nostoc sp. PCC 7120
MSRHTDYSSLEQIQTTGADAPKPLLTLSDAVALIVGIVIGVGIFQTPALVASQAGSDTAVLLFWLAGGIVSIIGALCYAELATTYPNVGGAYYYLKRAFGQNTAFLFAWARLTVIQTGSIALAAFVFGDYASEIWRLGTFSSSMYAAVIIALLTILNILGLHQGKWTQNLLTAAQVLGLLLVVLFGLASTANSANSAVSPEPSSSGSWGLAMVFVLLSYGGWNEAAYISAEIKNRQRNILRSLMWSIGIITAIYLLINLAFLRGLGLANMANSSAVAADLMRAVWGTPGVVFISLLIAICALGTINASIFTGARTNYALGQDFNLFGFMGSWRQIPSTPATALLVQGAIALALVVLGTFTRKGFETMVDYTAPVFWFFFLLSGISLLILRQKEPHIPRPFRVPFYPITPLLFCAVCGYLLYSSVVYTNVGAVVGVLVVIAGVPLLFWNRYRQGKA

SEQ ID NO: 17749 - protein, 468 aa, Nostoc punctiforme PCC 73102
MTKIIWQQGELIEVTIANLSDTGDGVGRADERVVFVPDTVPGDRAIVRLVHVKPKYAHGKLQELLEPSSHRIRPNCIVADKCGGCQWQHINYDYQLVAKQNQVIQAMERIGGFVQPPVNPVLAAPSALGYRNKSTYPLGTSATGQVQAGYYQKGSHQLINLNQCPVQDARLNPLLAEVKQDIQRQGWQIYDEQRHQGKIRHLGLRIGRHTGEMLLTLVVKDWNLSGIETQAQEWLKRYPQLVGVSLNRNSDRTNAIFGSEIRCIAGVPHLRENFAGLEFQVRPDTFFQVYTETAEALLQVIQSELNLQGHELLVDAYCGIGTLTLPLAKKVRIATGLEVQPAAVEQALLNAHCNGIDNVTFLVGAVEKLLPKMGTIPEVVILDPPRKGCDRAVIDTLRQLKPSRIVYVSCKVATLARDLKLLCQDGQYTITRVQPADFFPQTAHVEAAAFLVLSDLHKDSNSFKKTEI

SEQ ID NO: 17750 - protein, 375 aa, Glycine max
  misc_feature (27)..(27): Xaa can be any naturally occurring amino acid
  misc_feature (71)..(71): Xaa can be any naturally occurring amino acid
  misc_feature (76)..(76): Xaa can be any naturally occurring amino acid
  misc_feature (139)..(139): Xaa can be any naturally occurring amino acid
  misc_feature (300)..(300): Xaa can be any naturally occurring amino acid
  unsure (1)..(375): unsure at all Xaa locations
MQKKKKNRNEVVLCSAEGTGGCSRLAXAAMDLASNLGGKIDKAEVLSAVQKYEKYHVCYGGQEEERKANYXDMVNXNTNDLVYQPFMEFWLGGESFPFLHPDMVKGESLRESIKRHEHFLPLQLGLKPGQKVLDVGCGXIGGPLREISRFSSTSITGLNNNEYQITRGKELNRIAGVDKTCNFVKADFMKMPFPDNSFDAVYAIEATCHAPDAYGCYKEIFRVLKPGQYFAAYEWCMTDSFDPQNPEHQKIKAEIEIGDGLPDIRLTAKCLEALKQAGFEVIWEKDLAVDSPLPWYLPLXKSHFSLSSFRLTAVGRLFTKNMVKVLEYVGLAPKGSLRVQDFLEKAAEGLVEGGKREIFTPMYFFLARKPDLDRN

SEQ ID NO: 17751 - protein, 338 aa, Triticum aestivum
MAHNLVPDAWGWITSLPPFSQWRTNTMSLCICATPSASASSQPTSMTLSVAKTPPTQPSYLTFSISANYREPIFLWTSKPVHLKTKAQQSLDEQDMVQLFVDIVNQVLWYGPDNSSKPSFRFPGAQQLHGGSFSDAFNIVFLSLAFLVCIYEAPRDLRRGCLDSLRTQLTGPKCRGAAKTLVKMLGANLEDQWMQTMNLAVTNWMAEMRSSHHAPRAASPLFSYALQASGLWKVQLYCPVIAMGMEDPAAAAAQDERLLFSLTYQQLEGVVQLAVAFLDIRCDVDPLVSETLMAERGYGSEEKHFPSRVMLQITPMQQTDVLSVSVSKSSDNPTHEFG

SEQ ID NO: 17752 - protein, 199 aa, Zea mays
  misc_feature (37)..(37): Xaa can be any naturally occurring amino acid
  misc_feature (58)..(58): Xaa can be any naturally occurring amino acid
  misc_feature (85)..(85): Xaa can be any naturally occurring amino acid
  unsure (1)..(199): unsure at all Xaa locations
NSSYNVRLLWLPSAKGILAADDPTGTIGKSLSTIHVXNDVENLRDLRELLFCCPGALXNIMRVILFKDTLNQKTKDGKPFVDVLXEGGVLPGIKDDYGTIEVAGTDNETTTQGHDDLDKLCPKYYEARARFVKWHDVLKSVPNDASQVVIHLNAQGLARYGIICHENGLAPTVEPEILVDVPHEIDICSYLTETVHADC

SEQ ID NO: 17753 - protein, 493 aa, Ralstonia metallidurans CH34
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 17754 - protein, 402 aa, Streptomyces coelicolor A3(2)
MEFRQSNKLSEVCYEIRGPVIEHANALEEAGHSVLRLNTGNPALFGFEAPEEIVQDMIRMLPRAHGYTDSRGILSARRAVAQRYQALGLEVDVDDVFLGNGVSELISMAVQALLEDGDEVLIPAPDFPLWTAVTTLAGGKAVHYLCDEQAEWYPDLADMEAKITDRTKAVVIINPNNPTGAVYPKEIVEGILDLARRHGLMVLADEIYDQILYDDAVHHSAASLAPDLVVLTFCGLSKTYRVAGFRSGWLVVTGPKQHARDYLEGLTMLASMRLCANAPAQYAIQAALGGRQSIRELTAPGGRLHEQRDVAWEKLNEIPGISCVKPKGALYAFPRIDPAVHKIHDDERFVLDLLLREKIQVVQGTGFNWPSPDHFRILTLPHAEDLEAAIGRIGRFLSGYRQ

SEQ ID NO: 17755 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKSQ

SEQ ID NO: 17756 - protein, 1041 aa, Arabidopsis thaliana
  misc_feature (640)..(640): Xaa can be any naturally occurring amino acid
  unsure (1)..(1041): unsure at all Xaa locations
MGKKRIMFFASLLLITIFLSFSYAGITRESPLSIGKTLSSSNGVYELGFFSFNNSQNQYVGIWFKGIIPRVVVWVANREKPVTDSAANLTISSNGSLLLFNENHSVVWSIGETFASNGSRAELTDNGNLVVIDNNSGRTLWESFEHFGDTMLPFSNLMYNLATGEKRVLTSWKSHTDPSPGDFTVQITPQVPSQACTMRGSKTYWRSGPWAKTRFTGIPVMDDTYTSPFSLQQDTNGSGSFTYFERNFKLSYIMITSEGSLKIFQHNGMDWELNFEAPENSCDIYGFCGPFGICVMSVPPKCKCFKGFVPKSIEEWKRGNWTDGCVRHTELHCQGNTNGKTVNGFYHVANIKPPDFYEFASFVDAEGCYQICLHNCSCLAFAYINGIGCLMWNQDLMDAVQFSAGGEILSIRLASSELGGNKRNKIIVASIVSLSLFVILAFAAFCFLRYKVKHTVSAKISKIASKEAWNNDLEPQDVSGLKFFEMNTIQTATDNFSLSNKLGQGGFGSVYKGKLQDGKEIAVKRLSSSSGQGKEEFMNEIVLISKLQHKNLVRILGCCIEGEERLLVYEFLLNKSLDTFLFGGFLLASFLFYKRLFFYMELSVLIVSIRYYCLDSRKRLEIDWPKRFNIIEGIARGLQXIHRDSCLRVIHRDLKVSNILLDEKMNPKISDFGLARMYQGTEYQDNTRYMAPEYAWTGMFSEKSDIYSFGVILLEIITGEKISRFSYDLKPKQQAWESWCESGGIDLLDKDVADSCHPLEVERCVQIGLLCVQHQPADRPNTMELLSMLTTTSDLTSPKQPTFVVHTRDEESLSQGLITVNEMTQSVILGQQVDQDLMDTVQFSPGGEIISIRLARSELDANERNMIITASIVSFALFVIMASAAFGFWRYKAKISKDASQVAWRNDLKPQDVSGLNFFEMNTIQNATNNFSISNKLGQGGFGPVYKGKLQDGKEIAVKRLSSSSGQGKEEFMNEIIGLLCVQHQPADRPNTLELLSMLTTTSDLPPPKQPTFVVNTVVDESPSKRLITVNEMTHSMILGR

SEQ ID NO: 17757 - protein, 330 aa, Silicibacter sp. TM1040
MTKTYQLVGIGNAVVDVISQCDDSFLDHMGIEKGIMQLIERERGEVLYAAMKERVQTPGGSVANTIAGAGALGLSAAFIGRVHDDALGRFYAEAMQDDGVDFVNPPVAGGELPTSRSMIFVSPDGERSMNTYLGISSELSSADVSNAVAGQAQIMFLEGYLFDKDKGKSAFMEAARDCRAGGGKPGIAISDPFCVERHRADFLKLIETELEFVIGNEDEIRSLFETDDLEAALAKTAAICPLVVCTRSGDGVTVVSQEGRIDVPVIKVVPVDATGAGDQFAAGFLFGLAEGRDLETCARMGNACAAEVISHIGPRPKADMRAVLKQAGLL

SEQ ID NO: 17758 - protein, 544 aa, Thermoplasma acidophilum
MKTKIVATIGPASSSPEIMKQMIDNGLSLVRINSAHADIKDVSKITQMVRSINRDVGIMIDLKGPELRTGEFAGGTLKISSGKDYVMGKDIVLNNMNVLSAVQVGDRILMSDGEVSFEVESTDPFTIRALNDGVLRDRSRVNIPGRFIELGTITDRDRAFIREGIADGVDFFALSFVQKSENVDSLRDFVIDSGGDQYIISKIETKSGLDNIEEIVKSSDGIMVARGDLGVELPLKEVVLAQKHIIKTAHEDGDFTIVATQVLESMVNNSSPTRAEISDITNAIIDNADALMLSEESAIGKYPVQAVRTLKEVSDYVEDKVSFDSSYYFKGNTIAYSVARAAKILSDDIKSDGIVALTHTGSTVRMISSLRPKAMVYAATVSESLARKLNIYFGVLPLHMEGNAEDLSFSEIMEYIVRSGRFADGSKLVMTSGDPYFTFGGTNDVKVAVVGKFIGRGYSFGDSLSGTATYGTKGDILMSEDGRIPGTDFRAFIFTSDIKPSLMSSLKGKTVVTKARLVRQIKEGERIYIDGNTGIILMASPDQK

SEQ ID NO: 17759 - protein, 149 aa, Brassica napus
  misc_feature (11)..(11): Xaa can be any naturally occurring amino acid
  misc_feature (16)..(16): Xaa can be any naturally occurring amino acid
  misc_feature (35)..(35): Xaa can be any naturally occurring amino acid
  misc_feature (45)..(45): Xaa can be any naturally occurring amino acid
  misc_feature (47)..(47): Xaa can be any naturally occurring amino acid
  misc_feature (52)..(52): Xaa can be any naturally occurring amino acid
  misc_feature (60)..(60): Xaa can be any naturally occurring amino acid
  misc_feature (62)..(62): Xaa can be any naturally occurring amino acid
  misc_feature (65)..(65): Xaa can be any naturally occurring amino acid
  misc_feature (79)..(79): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(93): Xaa can be any naturally occurring amino acid
  misc_feature (98)..(98): Xaa can be any naturally occurring amino acid
  misc_feature (102)..(102): Xaa can be any naturally occurring amino acid
  misc_feature (108)..(108): Xaa can be any naturally occurring amino acid
  misc_feature (115)..(116): Xaa can be any naturally occurring amino acid
  misc_feature (126)..(126): Xaa can be any naturally occurring amino acid
  misc_feature (130)..(130): Xaa can be any naturally occurring amino acid
  unsure (1)..(149): unsure at all Xaa locations
MASSMLSSAAXGTSPXQATMVAPFTGLKTSAAFPXTRKANNDITXIXSNGGXVSCMKVWXPXGKXKFETLSYLPDLTEXVELGKEDDYXLXAXRGIPXVEFXLEHGFXVYREHEXXPRNYDGRYWXTMGXLPLVKLTLLGKGPKREKGP

SEQ ID NO: 17760 - protein, 141 aa, Alkalilimnicola ehrlichei MLHE-1
MAVERTLSIIKPDAVAKNIIGEIYNRFEKAGLKIVAARMVHLSREQAEGFYAVHKERPFFNDLVGFMISGPVMVQVLEGENAIVKNREIMGATNPAEAAAGTLRHDYAETIDANAVHGSDAPETAKQEIEFFFKADELCSR

SEQ ID NO: 17761 - protein, 257 aa, Nostoc sp. PCC 7120
MPVTTQQLIQWKQQGRSIVALTAWDYTIAQILDGAGVDLILVGDSMAVMLGYKTTLPITLEEMLHHAKAVCRGVQRALVVVDLPFLTYQESIPQAINSAGRILKETGAQAVKLEGGYPAMVDTINRLVQAGIPVMGHVGLTPQSVHQLGLRQQGKTQETAQRILNEAIALEQAGVFSIVLEHIPADLAMQITQKVNIPTIGIGAGSHCDGQVLVTSDVLGLSERQPPFAKVYTNLRETITKAVQDYAAEVRDRQFPE

SEQ ID NO: 17762 - protein, 433 aa, Synechococcus sp. RS9917
MTAPTLNTSRSQAIFSAAQALMPGGVSSPVRAFKSVGGQPIVFDRVKGSYAWDVDGNKYIDYIGSWGPAICGHAHPEVISALQEAIEKGTSFGAPCELENTLASRVIDAVPSVEMVRFVNSGTEACMAVLRLIRAFTGRDKVIKFEGCYHGHADMFLVKAGSGVATLGLPDSPGVPRSTTANTLTAPYNDLEAVKQLFAENPEAIAGVILEPIVGNAGFITPEPGFLEGLREITKEHGALLVFDEVMTGFRISYGGAQAHFGVTPDLTTMGKVIGGGLPVGAYGGRREIMEMVAPAGPMYQAGTLSGNPLAMTAGIKTLELLKQPGSYEKLAATTERLISGIIEAAGAAGLPITGGSVSAMFGFFLCDGPVRNFEEAKTADTERFGRLHRAMLQRGVYLAPSAFEAGFTSLAHSEADIDATLQAFRETFAEIA

SEQ ID NO: 17763 - protein, 432 aa, Listeria innocua
MDHSMSKKLHDEALLHIVGGVNSPSRSNKGVGGGIPVTMERANGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTRSTAEEVITVPFNDLTSFKEALAVWGDQVAAVLVEPIVGNFGMVAPAEGFLEAVNELAHENGSLVIYDEVITAFRFMYGGAQNYLGVIPDLTAMGKIIGGGLPIGAYGGRVDIMEKVAPLGPAYQAGTHAGNPASILSGIACLEVLQEEGLYDRFEKYGSMLKEGIEKAAIKHGIAVTVNQIVGALTVYFTDEPVTNYAEAGATNGDLFGRFFKGMLEEGINLAPSKYEAWFITSAHSEADILETIQAVDTVFGKLVQGK

SEQ ID NO: 17764 - protein, 245 aa, Bacillus cereus E33L
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKALKKGEFPLTECLVDTEKRVLDYWHSEIAPKLKNGNKVIISSHGNTIRSLVKYLDNLSSDGVVSLNIPTSIPLVYELDENLRPIRHYYLSMDGEVPEGEIPKHISF

SEQ ID NO: 17765 - protein, 361 aa, Medicago truncatula
MAAAVTAAVSFPYSNSTSLPIRTSVISPDRLVFKKVSLNNVSISGRLTVRAEVATEAPAPVKVEKISKKQEEGIVVNKFKPKTPYIGRCLLNTKITGDDAPGETWHMVFSTEGEVPYREGQSIGIVPDGIDKNGKPHKLRLYSIASSALGDFGDSKTVSLCVKRLVYTNDAGEVVKGVCSNFLCDLRPGSEVQITGPVGKEMLMPKDPNATVIMLGTGTGIAPFRSFLWKMFFEKHEDYKFNGLAWLFLGVPTSSSLLYKEEFEKMKEKAPENFRLDFAVSREQVNDKGEKMYIQTRMAQYAEELWELLKKDNTFVYMCGLKGMEKGIDDIMVSLAAKDGIDWIEYKRSLKKAEQWNVEVY

SEQ ID NO: 17766 - protein, 1790 aa, Neurospora crassa
MSSHDKNGRATSSSGKASSFFSRATGKNKADKRNASDEGGRYLAADNDAASTHTARSSRHYRDSSVISLDRPDTPESGLNMTAGVVTTIPYDPVSPDNRSPVALDHLPRPDQMPLRRELVPHHLNKGTGDFHQYPTIDQSPSSPYNGQSPSASSSRSTLATANITMASTGRQAQFQQWGPPRESSLPGYNSRGHSYMTTRSSGDNASIYSGRDGHYQEAPGTSHRSSRIGLPSTSSQSSYLSPHAHKDRDTQRLTKVAAGHQGSEGFNFPKPDDDNVIEQMFINLMQKRGWHNLPDQAKRQMIAYPAAKKWTLIYQDRLTEWQGEQKRRQTAKIGQYSNVDITQSSDDEGSPEWYVRKVMENALDSKGLGGLEVNLRTQQIGWVKRFIDCQGQIALTNVLLKMNRKTAYGPAQPDNGRLDKNLDREYDIVKCLKALMNNKFGADDALAHQQVIVALATSLISPRLTTRKLVSEVLTFLCHWGEGKGHVKVIEAMDVVKAQQGENGRFDAWMRLVEVTVDGRGKMGSLVGASEEVRSGGIGMENLLMEYAVATLILVNMLVDAPEKDLQLRIHIRAQFTACGIRRILNKMEAFQYELIDKQIERFRSNEAIDYEDMLERENSSIKDSIEGEVKDLNDPVQIVDAIQQRLNGTKTQDYFVSALQHLLLIRDNDGEERLRMFQLVDSMLSYVAMDRRLPDMDLKQSLNFTVQSLLDKLHTDSEARQALDEALEARQIADAAMAERDEMKERLALGADGLVAKLQKQIDEQAMFIEAQKRRAEGLKSELASLQTLRAKEAQRYELETRELYLMLRDAQDVAASNATKGNAKLGEEDVARMQGILDRERLLERLQMQIERQKTQFKLEGRVWGEVIGPSDRLRALREEMDGFGDDTPEVVPPKDFTNSMLGSVKRSTRIPRKPVGSRSDHVEDVLEESDVEIGDDGEIVYEKPRVVKIRRPVVDPKQTNGMFNELTGKVRRYDASDSEEGDGITTGPSHPSMESQTPITPSDTETPKIQVTDATGPSAPAAASGPPPPPPPPPPPPPPPGFLPGAPAPIPGAGGPPPPPPPPPPPPPPPGGLPGAAPPMPGAGGPPPPPPPPPPPPMPGMAGPASGRFLAQNAGLPTTNSVGLPVVRPKKKLKAFHWDKVDTPLATHWAAHTPSPESREEKYHELSKKGILDEVEKLFMAKEIKKLGGGGAKKDDKKQIISNDLRKAFEIALAKFSQFPVEKVVQMIIHCDKDVLDNPVVMDFLQKDDLCNISDNTAKVMAPYSKDWTGPDAGKDTREQDPNELTRQDQIYLYTAFELHHYWKSRMRALALTRSFEQEYEEITEKMRAVVAVSESLRDSVSLMNVLGLILDIGNYMNDANKQARGFKLSSLARLGMVKDDKNESTLADLVERIVRQQYPEWEDFAKDIEGVIAAQKINIEQLQADAKRYIDNIKNVQMSLDSGNLSDPKKFHPQDRVSQIVQRVMKDARFKAEQMQLYLEEMVRTYNDIMVFYGEDPSDDNARREFFSKLASFITEWKRSREKNIQLEEQRKRNEASMKRKNAQFKALQASEAQGPASPTSTGAMDSLLEKLRAAAPQTRDQRDRRRRARLKDRHQVRIASGQQVPDFNEIPEVEAALQTGKSAASATTDDDGAGNGLVSPDALPPTKEAPDAEEDDVARRAAALLQSFQGGDGAEDDAEKRESLRKSRRQTAAEERNMRRRRREKAQTSTAGEEGKDESTAADGSEAAPSASAEDLSAAEAKTDGPSSPRPGTATGAEASEETETTPTATATDTNPEESKETTG

SEQ ID NO: 17767 - protein, 306 aa, Fagus sylvatica
MPSHSDLDRQIEHLMECKPLPEAEVKTLCDQARAILVEEWNVQPVKCPVTVCGDIHGEFYDLIELFRIGGNAPDTNYLFMGDYVDRGYYPVETVTLLVALKVRYRDRITILRGNHESRQITQVYGFYDECLRKYGNANVWKFFTDLFDYLPLTALIESQIFCLHGGLSPSLDTLDNIRALDRIQEVPHEGPMCDLLWSDPDDRCGWGISPRGAGYTFGQDIAAQFNHTNGLTLISRAHQLVMEGFNWCQDKNVVTVFSAPNYCYRCGNMAAILEIGENMDQNFLQFDPAPRQIEPDTTRKTPDYFL

SEQ ID NO: 17768 - protein, 122 aa, Brassica napus
KFKQKQHTVTNLVEEDGTTKVQLSDVSSDSIPLMLVALIATFFKHLRSFFLRFSSSSVVVVEEDASASSVYSGLANLADQLKLNRLLSYLYADNAAAAASDCIVCLSTLKTGEEVRKLDCRH

SEQ ID NO: 17769 - protein, 408 aa, Moorella thermoacetica ATCC 39073
MPEQVLLEIGLALAIVAFAGILAARFRVSIVPLLILAGMVVGPHAPVIGILDFRFIKSAPLIDFMGRVGILFLLFSLGLEFSVGRLLKAGRSILVGGSIYMAINFTLGMVLPIIWGWPLRETLVVAGLISISSSAIVAKVLVDLKRTARPETEMILGLMLFQDVFVAVYLSIISGLVLTGSASPASVLKSTSLALGFMLGLILAGRKLAPLINRLLNVPSDEVFMLIVFAFLTLVAGFSETIHVAEAIGALLVGLILAETDHLDRIEHIVVPFRDFFGALFFFSFGLSIDPLTLGGAVGPVLTAVAATLTGNFLAGILAGRMAGYSYRGCTNIGLTITPRGEFSIILANLAKTGGLLPVLQPFAALYVLLMAILGPLLTKESKWIYNQLAHIFGWPAWKEINKPDRTI

SEQ ID NO: 17770 - protein, 261 aa, Thermus thermophilus HB27
MRRTVKDFRNAKGQRLVYLTAYDYPTARLAEAAGVDAILVGDSLGMVVLGYPSTVPVTLEEMLHHTKAARRGAPETFLVADLPYLAYATLDRALLAAERLLKEGGADAVKLEGGEEVAEIVRGLVRAGVPVLGHVGLTPQTASQLGGYKLQGRRPEEAERILKGALALEEAGAYGVVLEMVPARLAKEVTERLSVHTVGIGAGPHTDAQVLVFHDVVGLYGDFKPRFVKRYLEAGRLIQEALSRYAQEVREGVFPGEEHSF

SEQ ID NO: 17771 - protein, 371 aa, Methylococcus capsulatus str. Bath
MTLNTIEEIIEDIRQGRMVVIMDDEDRENEGDLVMAAGHVRPEDINFMARYGRGLICLTLTRERCQQLRLPLMVNENRTPHSTNFTVSIEAATGVTTGISASDRARTIQCAVAPDARPDDLVQPGHIFPLMAQPGGVLNRAGHTEAGCDLARLAGLVPAAVIVEILNEDGSMARRADLEKFAAVHGLKIGTIADLIHYRMQNEQTVERICECDFPTEHGRFRLHAYQDRLDNKLHLALTLGDVAGGEPVLVRVHGRNLLTDLFGVRRGDIGISLRAAMKRIADEGRGVLVVIRNEEDDRCLVERIHQYQMEDHGVDIGQREDPGVDWRTTGTGAQILADLGVRKLRVLGAHKKYLGLSGYGLEVVDYVTTD

SEQ ID NO: 17772 - protein, 437 aa, Chlamydophila abortus S26/3
MPIIEESTMTYAEACRYFPGGVNSPIRACIPVGILPPIVSSAHRDIFIDSFGKTFIDFCGSWGSLIHGHGHPKILDVICNSASQGTSYGLTSENEISLAATLFSCLEFEDHKVRFVSSGTEATMTAVRLACATTGRSIMIKFLGCYHGHADVLLKGISIDESNIHQVPHIVDTYFSGNPYLPLNLILPYNDIQIFKEVMLQVGERVACVIFEPIAINMGVVLPKPGFIEGVITISRRFAALTIMDEVVTGFRMGIRGVRSIMDVDSDITVYGKILGGGMPVAAFLAHHRIMDHLLPLGQVFQAGTLSGNPIAMAVGKASLELCREVDFYPKLENLAQSFFAPIEEVICHQGFPVSLVRAGSMFSFFFRETPPTNLREVQECDHQMFGVFYRHVFAQGVYLSPAPMEASFLSSVHSKENLAYTQNVLIDSLMKTFGSL

SEQ ID NO: 17773 - protein, 271 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEREPKATHR

SEQ ID NO: 17774 - protein, 516 aa, Arabidopsis thaliana
MALVSLLEISIAFFCFLIFRIFLISKKPHRSFLTNWPLLGMLPGLLTVLPRVYDFITEVLEDGNLNYLFIGPFLGGIDMLFTVDPANIHHIMSSNFANYPKGTEFKKLFDVLGDGIFNADSDLWKDLRKSSQSMMNHPDFQRFSLATSLSKLEKGLVPLLDHVAKEKLVVDLQDVFQRFTFDTTFVLATGYDPGCLSVEMPEIEFARALDDAEEAIFYRHFKPEVVWKMQRLIGVGAELKLKRAHAIFDRVCSKCIASKRDEISQGIDSSSSKDLLMSSINVDTTKYKLLNPSDDRFLRDTILSFMLAGRDTTGSALTWFFWLLCNNQEAMTKIRQEINTNLFPRNKTDDGSVSYDSDSFNPQEVKKLVYLHGAVCEALRLYPPVPFNHKSPAKPDVLPSGHKVKANSRILFCLYSLGRMKSVWGEDAMEFKPERWISESGRSVHEPSYKFLSFNAGPRTCLGKEVAMTQMKTVAVKIIQNYDINVVEGHKIKPAPSVILHMKHGLKVTVSKRCLS

SEQ ID NO: 17775 - protein, 233 aa, Chlamydophila abortus S26/3
MKKDPYLEVKKQLALEAANLVEPGMLLGLGSGSTSREFIKAVAHKHKQENLDIRAVASSKESHSLAKSLGIPLVDDEEFTEIDLAVDGADEIDPQLRMIKGGGGAIFREKILLQSSRRRLILADESKHVQVLGKFGLPIEISPFGRSSIIATLKNLGYLGNLRKNSHGGFFITNNRNYIYDIHTPNVYPHPEEDLLKLLQIHGIIEVGFVIASVEVWFGYANGQIGKKNTGRV

SEQ ID NO: 17776 - protein, 479 aa, Arabidopsis thaliana
MIPGLLVEIHRVYDFITEILEVTNLTYPCTGPCFANLDMLVTVDPANIHHIMSSNFANYPKGPEFKKLFDILGDGIFNADSELWKDLRKSAQSMMMNPEFQKFSLATSLKKLEKGLVPLLDHVAKEKLAVDLQDMFQRFTFDTTFVLATGYDPGCLSVEMPEVEFARALDDAEEAIFFRHVKPEIFWRLQGLLGLGDEKKMTKARSTLDRVCSKYIAIKRDEVSRGTNNVDSHSKDLLTSYMNLDTTKYKLLNPSDERFLRDTILTFMLAGRDTTGSGLTWFFWLLIKNPEVIAKIRQEINTALFQRSKVDDDASNNNDSDSFSPQELKKLVYLHGAICESLRLYPPVPFQHKSPTKPDVLPSGHKVDANSKILFCLYSLGRMKSVWGEDALEFKPERWISESGNSVHEPSYKFLSFNAGPRTCLGKEVAMMQMKSVAVKIIQNYEMKIVEGQQIEPAPSVILHMKHGLKVTVTKRCLV

SEQ ID NO: 17777 - protein, 163 aa, Brassica napus
  misc_feature (107)..(107): Xaa can be any naturally occurring amino acid
  misc_feature (120)..(120): Xaa can be any naturally occurring amino acid
  unsure (1)..(163): unsure at all Xaa locations
MGKDVGGEKKKRGDGETMAVMSLMKDQQNPIHQFQVKFKEAETGFKSWLSKQKLPVEAAVVTAMGGVQGAFIGGLMGTLSPEMPQTGVDPQAMASLQQTQALVGGPXVQARNFAAITGVXCWLACVMKRIRGKEDLESAVVAAFGSGVAYSLVSAGLQGQPMN

SEQ ID NO: 17778 - protein, 469 aa, Arabidopsis thaliana
MLPCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 17779 - protein, 87 aa, Arabidopsis thaliana
ANEDGYHQDAFLAASMLSSAAEVTSPGGATMIAQFTGLTQCPGFPVTRKTTTDLTFIPSNGGRVRCMKVWPPIAKKKLETLYYRRDL

SEQ ID NO: 17780 - protein, 588 aa, Lactobacillus casei
MKKTKIVSTLGPASNTTDIIVKLIEAGANVFRFNFSHGDHEEHLARMNMVHEAEKITGKTVGIMLDTKGAEIRTTLEDTPNGKIDFHTGDKVRISMDASLKGTKEKVAVTYPGLYDDTHVGGHVLFDDGLIDMKITEKDEKNRELVTVVQNDGVLGGKKGVNAPGVAINLPGITEKDSDDIRFGLDNGINFIAASFVRKPQDVLDIRELLEEKNALNVQIFPKIESQEGIDNIDDILKVSDGLMVARGDMGVEIPFEHVPIVQKRLIKKCNSLGKPVITATQMLDSMQENPRPTRAEVNDVANAVFDGTDATMLSGESANGDYPVESVAAMARIDEYTEAAMMDQDAFALKEYSNKNVTEAVGQSVAHTARNLGVKTIVAATESGYTARMISKYRPKADILAITFSEKTQRGLMVNWGVYPIIAEKPANTDAMFDLATKKAQDLGFAKEGDLILITAGVPVGESGTTNVMKVQLIGSKLVQGSGVGDESTIGKAVIASNAQEAAAKMQKGDILVVKTTDKDYLPAIEKAAALVVETGGLTSHAAVVGIAMGIPVVVGAENATSVISDGQIITVDSRRGIIYKGATNAL

SEQ ID NO: 17781 - protein, 650 aa, Methylobacillus flagellatus KT
MYEQVSHSLLNDILIGLDPKVGCEDLKHFYIRLGANFYAIHSLFHQLYGDRQDFRLQMHKLVAVMAKQYVSRPQELRHRDLAREKDHNWFLSQKLAGYALYCQEFAQSLKGMHEKLDYLQELGINLIHIMPILDGPKGRNDGGYAVRDFRKIDEKYGTLEDLDTLSAELRSRDMLLVLDVVVNHTSDEHEWALKAQQGNKKYQEYYYTYPDRKIPDLFEQTMPEVFPDTAPGNFTWNEKMGRWVMTVFNNFQWDLNYRNPSVFIEMIDIILFWANHGADVIRLDAVAFLWKKIGSPCQNEREAHLILQLMKDCCQVTAPGTLFIAEAIVAPLEIIKYFGEDAVNAKECEIAYNATYMALLWDAVATKKTLLLNRGLRSLPTKLDGATWLNYVRCHDDIGLGFDDNDIRASGYDPQAHRRFLVDYYTGAYQGSTATGVAFGVNPKTGDARISGSLASLAGLETALLRNDAQAIDTSIRTIILLHSMIASFGGIPLIYYGDSIGTLNDNTYLDDENKHHDSRWVHRPSLDWNKAARRHEPGTVENRIFTAIQRILAVRKQIPAFADLNNREIFETSNPHLFTFLRFTSQGMHSRVLVIANFDASPQYMNLRELDSVNLFRHVEVKDLYSGETLSTKHGTLEIPPLGFYWLQL

SEQ ID NO: 17782 - protein, 583 aa, Penicillium marneffei
MYNAHRGMVPAPNNRLTELLEQLRQEFESQSRSTGEFEHQLTGQIQEMEMIRQKVYQLEQAQIKIKAEYENEIRVLRHELESRGVQTVPSHVGGPTHAGPSQAPPALGHGTNNLFGGIMANQGGSGPGLAPPPPQEQQPPQHGLQQPAPAAQQGPPQPPQSSYGGYQPSAGVNGYGPPPPPTASPGPGKGRGRAPPGPATPQQTHQLNYPAPGASPQIPRPTPTGQLVRERPGNTLANWNPDDLPASQKREGPDWYAVFNPEVQRVLDVELVHHLVHDSVVCCVRFSRDGKYVATGCNRSAQIFDVATGQNVATLQDESVDKDGDLYIRSVCFSPDGKYLATGAEDKQIRVWDIATRSIKHVFTGHEQDIYSLDFAGNGRYIASGSGDKTVRLWDVLEGKLVYTLSIEDGVTTVAMSPDGHYVAAGSLDKSVRVWDTTTGYLVERLENPDGHKDSVYSVAFAPNGRDLVSGSLDKTIKMWELTAPRGMLPGTGVKGGKCVRTFEGHKDFVLSVCLTPDGHWVMSGSKDRGVQFWDPNTGSAQMMLQGHKNSVISVAPSPTNNLFATGSGDMRARIWRYVEFPE

SEQ ID NO: 17783 - protein, 411 aa, Synechococcus elongatus PCC 6301
MPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPATYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 17784 - protein, 117 aa, Helicobacter pylori
MKIKNILLSGGSGKRLWPLSRSLYPKQFLKLFNHKSLFELSFKRNASLVDETLIVCNEKHYFLALEEIESEIKNKSVGFLLESLSKNTANAIALSALMSEREDLLIVTPSDHLIKDL

SEQ ID NO: 17785 - protein, 288 aa, Zea mays
MASEEVLHKVQNLIERCLQMYMNKKEVVDALSHHSRIEPCITELVWQQLEQQNPLFFKAYDMRLMLKNQIMVFNRLLQDQFEIMNKEFSSGIPSMSLPNDSNSNLLKQDSCFLPETAPGNAMPDGIMHNGSSSGIINDTPSGDQLLNASKDLHGLHSQIDASTSLQSDQNATAVLYGVDNETSATIKTESCYSSNADFAFCGNTFLESCQSIGDASGGGSFSSSELNGQPLNDSILDMESSSFSFLNQMPQSFMFSDLADDFNQNAEITPFLTPETNFSDSTGGDHTG

SEQ ID NO: 17786 - protein, 523 aa, Yarrowia lipolytica
MSNALNLSLALGVFLLAYYGFSVIQYRIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 17787 - protein, 167 aa, Candida glabrata CBS 138
MSTPARRRLMRDFKRMKEDSPPGVSASPLPDNVMVWNAMIIGPADTPYEDGTFRLLLEFDEDYPNKPPHVKFLSEMFHPNVYANGEICLDILQNRWTPTYDVASILTSIQSLFNDPNPASPANVEAATLFKDHKSQYIKRVKETVEKSWEDNMDDMDDSDEDDEDDE

SEQ ID NO: 17788 - protein, 502 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMTARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 17789 - protein, 46 aa, Brassica napus
  misc_feature (10)..(10): Xaa can be any naturally occurring amino acid
  misc_feature (12)..(12): Xaa can be any naturally occurring amino acid
  misc_feature (26)..(26): Xaa can be any naturally occurring amino acid
  unsure (1)..(46): unsure at all Xaa locations
DRSSIILPLXGXRQFHEVIGHFVEIXKDKIDGMTGANVRTIDPPHR

SEQ ID NO: 17790 - protein, 431 aa, Arabidopsis thaliana
  misc_feature (250)..(250): Xaa can be any naturally occurring amino acid
  misc_feature (271)..(271): Xaa can be any naturally occurring amino acid
  misc_feature (285)..(285): Xaa can be any naturally occurring amino acid
  misc_feature (386)..(386): Xaa can be any naturally occurring amino acid
  misc_feature (418)..(418): Xaa can be any naturally occurring amino acid
  unsure (1)..(431): unsure at all Xaa locations
MSPIPKPLFFFFFLNYVSLSTSLSLHLPLTSLPISTTTNSHRFTTSLLSRKNPSPSSPPYNFRSRFKYSMALIISLPIGTPPQAQQMVLDTGSQLSWIQCHRKKLPPKPKTSFDPSLSSSFSTLPCSHPLCKPRIPDFTLPTSCDSNRLCHYSYFYADGTFAEGNLVKEKITFSNTEITPPLILGCATESSDDRGILGMNRGRLSFVSQAKISKFSYCIPPKSNRPGFTPTGSFYLGDNPNSHGFKYFSXLTDLKSQERPKRERGGEIGLXMGEGLGLKEADQSXALVYPEAVGWDHFIWYSGFEFSLLVNAFYYIFRACIITLLGEVLNRVYFYGGTSYSGFKVNGAIIPRFLEDLIFIFTREFYILFPKWGFCVNVVVGIHGCXKSNRSSSLGAASNIYGNVHQQNLGVHFYCTNXYRGLPKADCSRVV

SEQ ID NO: 17791 - protein, 441 aa, Arabidopsis thaliana
MSVLIVTSLGDIVIDLHSDKCPLTCKNFLKLCKIKYYNGCLFHTVQKDFTAQTGDPTGTGAGGDSIYKFLYGEQARFYKDEIHLDLKHSKTGTVAMASGGENLNASQFYFTLRDDLDYLDGKHTVFGQIAEGFDTLTRINEAYVDPKNRPYKNIRIKHTHILDDPFDDPPQLAEMMPDASPEGKPKEEVKDDVRLEDDWVPMDEELGAQELEEVIREKAAHSSAVVLESIGDIPEAEVKPPDNVLFVCKLNPVTEDEDLHTIFSRFGTVVSADVIRDFKTGDSLCYAFIEFENKESCEQAYFKMDNALIDDRRIHVDFSQSVSKLWSQFRQKDSQKGKGNGCFKCGSTDHIAKDCVGGPSSKFIVKDQNRQHGGGEGYEMVFEGDVHETPKHNSHERERSEKIQRRSPHGNGEGKRQHRDERDDGRRQHDREDARELERKL

SEQ ID NO: 17792 - protein, 402 aa, delta proteobacterium MLMS-1
MAGPIELAARVKEIKASPTLAVDAKAKALKAQGADVLNFSVGEPDFDTPPHVCEAGKAAIDEGFTRYTPVPGILPLRQAVCDRQAADHGRHYQPDEIQICCGGKHGLYNMAQAMFGPGDEVLIPAPYWVSYPPIVQLAGATPVIVPLDEKSAFDLDPAILADYTSPRTRGIILNSPSNPTGSVLSARALTAIAAMALEQGWVVISDDIYDTIVYGTEKLPHILDLEPKLRDQTLILNGVSKSFAMTGWRIGYTAGPQHVIAAMNKIQSQSTSNPSSIAQKAALAALTGPQDFPTTMRDAFVPRLDFMVGALNAMAGISCVRSRGAFYVFPNMSAYYGRKTPAGTSIDGSLALADYLLEDALLATVPGVAFGADDFIRFSFATSLAVLEEGMERLAAALAKLN

SEQ ID NO: 17793 - protein, 274 aa, Schizosaccharomyces pombe
MDSAEKKLDLSPIELAKRLACHMAVDENYPENPKVIGIGSGSTVVYVVERLLTKPGVDSVVFIPTGFQSKQLIVNNGLRLGDPDCYPNVDVSFDGADEVDDNLQCIKGGGACLFQEKLIAFLAKRLVIVADSRKNSHVLGEYWKKGVPIEVMPMAYASILPQLVELGAIEPKLRMGAPGKAGPVVTDNGNFIIDAHFGLIKNPKELFAKIKLLVGVVEVGLFCDMISAVYFGSKDGSVTVKKASGEKHIIPAPVTAAANEVDAKVAETNAKPLN

SEQ ID NO: 17794 - protein, 400 aa, Rhizobium leguminosarum
MAFLADALSRVKPSATIAVSQKARELKAKGRDVIGLGAGEPDFDTPDNIKKAAIDAINRGETKYTPVSGIPELRKAIAAKFKRENGLDYSWEQTIVGTGGKQILFNAFMATLNPGDEVSIPAPYWVSYPEMVALCGGTRFFVSATQEHNFKLQAADLEKAITPKTKWFIFNSPSNPTGAAYTHDELKALTDVLMKNPQVWVLTDDMYEHLTYGDFKFVTPVEVEPQLYDRTLTMNGVSKAYAMTGWRIGYAAGPIQLIKAMDMIQGQQTSGATSIAQWAAVEALNGTQDFIPENKKIFEGRRDLVVSMLNQAKGIVCPVPEGAFYVYPSCKGLIGKTAPSGKVIETDEDFVSELLESEGVAVVHGSAFGLGPNFRISYATSEEQLEEACRRIQRFCGACK

SEQ ID NO: 17795 - protein, 278 aa, Bacillus cereus ATCC 10987
MKTKTDFLKMKEQGEPITMLTAYDYPSAKLAEEAEVDMILVGDSLGMVVLGYDSTVPVTVEDMIHHTKAVRRGAKETFIVTDMPFMSYHVSPQDTMVNARRIVQESGAHALKVEGAGEVISTIHYLTSAGIPVVAHLGLTPQSVGVLGGYKVQGKDAESAKKLIEDAKRCEEAGAIALVLECVPMQLAEFISKQLTIPTIGIGAGQKVDGQVLVYHDLISYGVNRVPKFVKQYTFVQEEIVRGISQYVTEVKTGQFPEEKHSFTMKEEECLALYGGKQ

SEQ ID NO: 17796 - protein, 332 aa, Saccharomyces cerevisiae
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLEKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 17797 - protein, 829 aa, Magnetococcus sp. MC-1
MTLDEQLSESSVHEHDRPDWNATFIKEKLVNYMVHDVGKDPDIASERDWYYAVVYFVRGVLSERRIRQNRYLRDEKGRRVYYLSMEYLIGRNLMRTVLDLDLNILLREALSEFEQDLDTIVACEVDAALGNGGLGRLAACILDSIANQSFPGMGYGIRYEFGMFSQSIEEGMQVEHPEHWLRHGNPWEFEQPNVKYRVRFNGKILCFKDADGNDTCQWVDTKDVVALAFDVPLSGHKTPSITNLRLWSARATRDFDLSYFNEGNYVEAVKDKAVSENLSKVLYPNDSTLRGQELRLKQEYFFVSSSLQDIMERFKLENGDIRQFPKRVVIHLNDTHPSLAVPELLRLFCDEYGLEFDEAWDLCRQTFTYTNHTLLPEALETWPIAIMEHVLPRHLQILYKINHQHLKEVKHRYPGNSTILSRMSLIDDVSKRVRMAHVCIVGSYSVNGVAELHSRLMQAGMFKDFKEMRPGVFTNVTNGIDQHRWLNMSNPGLSALIKESIGDKWVSDLPALVELAPLADDAGFRRQFHDIKRANKVRLAQLVARKTGVELDPSSMFDVQVKRIHEYKRQLLNLMHVVTRYIRIRDGVENDMVPRSVIIGGKAAPGYHIAKQIIRLINDVASTINNDPAIKGLLKLVFLPNYNVSKAEIIMPGSELSEQISTPGMEASGTGNMKFALNGALTIGTLDGANIEILEEVGDDNIFIFGMTADEAHDLRAGGYDPTLYFEKNAELRRVLEMIRDGFFCPDDPGRYSDLYNNLLFGGDHFLLLADYEAYIACQKQVEATYSNQDRWNRMAVLNTANMGKFSIDRTVRTYAENVWKVKPMQLKR

SEQ ID NO: 17798 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSSPFSDLCAMLVCKLFSA

SEQ ID NO: 17799 - protein, 1012 aa, Oryza sativa
MALAGSMAAAAATSTLLLLLHHGLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNCRNSARGNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPGNSDEGGLVGLQKLLVAGNRLSGERPREIGKLQQLSKADLSGNLISEEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSAVPLHELTHVFYVAMLCVAEQSVERPTMREVVQILTDLPGTAAAAAAAATAMDAPSHGSGKEQDRSAEMQQQDGSRESPPQQDLLSI

SEQ ID NO: 17800 - protein, 602 aa, Pichia angusta
MSYQRAVPSSSNHTMPERDRLDELLDAVKKEFDNLTRETTIYKDHHHDYELKINQQHQELTNIRNTVYELEQAHRTMKEAYEKEILRLKQDLENRDRLFQQQSLQQAQAQAQAQAQVKAQVQSQQHPLLDRPQGAFPQTPQQLPPPNLSGSPSDYRGAGFNGALPQINAQASGAKPEISQSTQLPPPPPVSTQEQQAASQTQTSPEQPPTAVQTSVVKTEADAGYVMRSQHNKPIPTFLKDFDSYSTLPYKKQHSEYYIVYNPKVPKKVDTSLVHSFDHTSVVCCVRFSKDGKFLATGCNKLTQVFSVETGDLVARLSDESSASSNGSYDTDTGDLYIRSVCFSPDGKFLATGAEDKIIRIWDLATRTIVKYLKGHEQDIYSLDFFPDGSKLVSGSGDRTVRIWDVFTGQCSLTLSIEDGVTTVAASPDGKLIAAGSLDRTVRVWDANQGFLVERLDSANESGNGHMDSVYSVAFTHDGKEIASGSLDRTVKLWSLKDLQKQQGSSKSNCEVTYVGHKDFVLSVCCTPDDEFILSGSKDRGVIMWEKATGEPYIMLQGHRNSVISVNVSPVMTQKRGVNGGYFATGSGDCKARIWRWEKVSS

SEQ ID NO: 17801 - protein, 268 aa, Rhodopseudomonas palustris CGA009
MTALHLGSKAAAAGYKLAAFDSTGSTNAEALASARAGEAGPMWFVTTEQTAGRGRRQRAWIAPRGNLASSVLEVMRVPPGTAATLGFAAGLALEAALQQVSLEARARSGTDFGFRLKWPNDVLASGKKLAGILLEVENVGDRLAVVVGIGTNVIAAPTDTPYPAVSLHDLGISVTAEDLFAALSDAWTELLGIWDNGRGFPEIRRRWLERAAGLGEPVSIRSGDSALEGVFDSIDDTGCLIVRTTDGRRVPVSAGDVYFKGVASMGAA

SEQ ID NO: 17802 - protein, 252 aa, Escherichia coli
MNQTLLSSFGTPFERVENALAALREGRGVMVLDDEDRENEGDMIFPAETMTVEQMALTIRHGSGIVCLCITEDRRKQLDLPMMVENNTSAYGTGFTVTIEAAEGVTTGVSAADRITTVRSDSDGAKPSDLNRPGHVFPLRAQAGGVLTRGGHTEATIDLMTLAGFKPAGVLCELTNDDGTMARAPECIEFANKHNMALVTIEDLVAYRQHMSVKPAENRCLIYCLNQETEVVAGFGFYFSLLCKMLIPLLFL

SEQ ID NO: 17803 - protein, 314 aa, Vibrio parahaemolyticus RIMD 2210633
MVNNSIQWFPGHMHKARKEIEEAIPQVDVIIEVLDARIPFSSENPMISKIRGEKPVVKVLNKRDLADPELTQLWIDHLEKEQNVKAMAITTSEPQEVHKIMELCRKLAPHREEVGKNIRTMIMGIPNVGKSTIINTLAGRTIAVTGNQPAVTRRQQRINLQNGIVLSDTPGILWPKVENPHSGFRLAATGAVKDTAMEYDEVAFYTVEYLAAHYPERLKERYQIEELPESDIEIMEEIGRRRGALRAGGRVDLHKVSEILLHELRQGTLGQITLELPEMITQELIEVEIETARKEEEKAKRKEERRKRYLRNKR

SEQ ID NO: 17804 - protein, 691 aa, Medicago truncatula
MLVVYDDDDVDVDVDDDPSDQHLGGGGGGGGCDTSSTEDSPSHQTTLHLVDPTTTTHHHIPYIGQMFPTHDAAYDFYTHFAKTCGFSIRRHRTEGKDGVGKGLTRRYFVCHRAGNTPAKSSTQTKPQRNRKSSRCGCQAYMRISKTTEFGPPEWRVTGFANHHNHELLEPNQVRFLPAYRTISDADKNRILMFAKTGISVHQMMRLMELEKCVEPGYLPFTEKDVRNLLQSFRKLDPEEETLDLLRMCRNIKDKDPNFKFEYTLDANNRLENIAWSYASSIQLYDIFGDAVVFDTTHRLTAFDMPLGLWVGINNYGMPCFFGCVLLRDETVRSFSWAIKAFLGFMNGKAPQTILTDQNICLKEALSAEMPMTKHAFCIWMIVAKFPSWFNAVLGERYNDWKAEFYRLYNLESVDDFELGWREMVCSFGLHSNRHILNLYSSRSLWALPYLRSHFLAGMTTTGQSKSINAFIQRFLSAQTRLAHFVEQVAVAVDFKDQTGEQQTMQQNLQNVRLKTGAPMESHAATVLTPFAFSKLQEQLVLAAHYASFSVEDGFLVRHHTKVEGGRRVYWSPHEGIISCSCHQFEFSGILCRHSLRVLSTGNCFQIPDAYLPIRWRRISVPSSKILQNAPSDHAERVKLFQNMVSSLITESAKSKERLDIATEQVSILLSRIREQPISLQCARDTSTIRNL

SEQ ID NO: 17805 - protein, 270 aa, Zea mays
MADGKGRENSAVALKTSPSVPMARGLRGGSNPLEEWSGRVKAIEAGFRAWMAKQPIHIEAAVSTAVGAVQGGALGGLMGSLTADGGSPFPIPQPPSNANSDAMASFKQAQALAAGPLVQARNFAVMTGANAGISCVMRRLRGQEDIQGSMTAAFGSGALFSIVSGMGTPNPVLNAITTGVAFAVFQGGFFMIGQKFSKPSSEDTYYFLTRSMLHKLGLEKYEKNFRKGLLNDQTLPLLTDSALRDVKIPPGPRLLILDQIKRDPGLVRAK

SEQ ID NO: 17806 - protein, 463 aa, Yarrowia lipolytica CLIB122
MGGNGQNGEIKVSGRGKGRIWLFGVKEKRWRARIPDKTAPGLAFQVARTGEKARDWVKTLRFGPQSSQWSAQCKHVDPHTPLRHNHISRARCRHKSFRHPHPSHRHRHTPTHSRITRPTRTATMEDSDVLMRDINDDGLKPMDAMGAGGEGTFTELTPTTRGQLDAWIARLTECQPLSEDDVNELCNMAKGVLQKEENVQPVHAPVTICGDVHGQFHDLMELFKIGGPCPDTNYLFMGDYVDRGYYSVETVSYLVAMKVRYPNRLTILRGNHESRQITQVYGFYDECLRKYGNANVWRAFTSLFDYFPVTALVENQIFCLHGGLSPMIESIDNIRELNRFQEVPHDGPMCDLLWSDPDDRGGWGMSPRGAGFTFGADISEQFNHTNNLSLISRAHQLVMEGFSWAHEQQVVTIFSAPNYCYRCGNQAAIMEVDENLSNSFLQYDPCPRPGEPSVSRRTPDYFL

SEQ ID NO: 17807 - protein, 306 aa, Burkholderia vietnamiensis G4
MNAPTSSDKPEAGDAHIARNRLDAHLDAAPRAWPLDIVAATGSTNADLANRLKALPRTANALPAPLVRVAFEQTAGRGRQGRPWFAQPGNALLCSVGCIVPRPVDALGGLSIAIGVALAEGLATLPLDGGTRVALKWPNDLLLTRTESDTTRIDGKLAGILIETVWNTDDATAVVIGFGINVRGAQAVAAQVDALRARDAALASGLPPAALSAACASANLTDTLAAALNALTPALAQFASDGLAPFVPRWHALHAYAGREVVLLEQGVERARGIATGIDATGRLLLDTPDGVQAIAAGDVSLREAQ

SEQ ID NO: 17808 - protein, 503 aa, Arabidopsis thaliana
MAMVIGLLEIFTAFVFFFVFQCFSLHKKTPKPLLTNWPALGMLPGLLLQVPRIYDWVTEALEAADMTGCFIGPWLSGTDILLTVDPVNIHYILSSNFANYPKGMEFNKIFEVVGDAIFNVDSGLWEDMRNSSHAIFSHQDFQRFSVSTSVSKLRQGLVPILDNAAEKHILVDLQDLFQRFLFDTSSTLMAGYDPKSLSVEMPKVEFADAVDGVADAVFYRHLKPAFLWRLQSWIGVGVEKRLRRGLAVFDQLLGKIISAKREEINSHGTHHPSRGEAMDVLTYYMTMDTTKYKHLEPSDDRFIRDTILGLVIAARDTTSSALTWFFWLLSKNPEAMTKIRQEVNKKMPRFDPADLDKLVYLHGAVCETLRLYPPVPFNHKSPAKPDVLPSGHRVDENWRVVIPMYALGRMKSVWGDDAEDFRPERWISDSGRLRHEPSYKFLAFNAGPRACLGKRLTFLQMKTVAAEIIRNYDIKVVEGHKPEPVPSVLLRMQHGLKVSVTRI

SEQ ID NO: 17809 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKTQ

SEQ ID NO: 17810 - protein, 400 aa, Methylococcus capsulatus str. Bath
MNRRQHEAGQPIPAAEQGGCLADAIRPFHVMAILARARELESSGRSIVHLEIGEPDFPTPEPVAAAATRFLAGGQVRYTPAAGLPELRERIAAYYAERYGVAVAPQRIFLTPGASGALSLALAVALSPGRRVMLADPGYPCYSNFVRLYSGDPHAVPVGAEQDFQLNAALCRMHCGGDVPVAISASPSNPTGTVMRTGVLRELVEWFEAEGGILISDEIYHGLEYGGRAVSALEFGQHTFVVNSFSKYFGMTGWRLGWVVVPEAYAAAVERVAQNIFISAPTLSQYAALAAFSEESRAELERRRRAFEARRDFLWGELVKLGFGVPVAPSGAFYIYADCSAFAEDSAEFAARLLETAGVAVTPGKDFGAQSPERYLRFAYTADIPVLQEAVGRIRRFVTG

SEQ ID NO: 17811 - protein, 339 aa, Triticum aestivum
MLALTSLSPRPARPSPSPATPPHRRPPPPRGRIRPTYAVATAASDGGGAADDYHSTIRSLNSHGRRHVPRKSLGQNYMLNARVNEELVAAAGVEEGDVVLEIGPGTGSLTAALLAAGATIVAVEKDKHMATLVRDRFGSTEQLKVIEEDITKFHVHSHFLPILEEKSHGKKKYAKVVSNLPFNVSTEVVKQILPMGDVFSVMVLMLQDEAALRLANASIQTPEYRPINVFVNFYSEPEYKFKVERANFFPQPTVDGGVIRFKIKDAGEYPLVSSNKSFFSMVNSAFNGKRKMLRKSLQHLYSSADIEAALTNIGLPPTARPSELGMDDFVRLHNHLGKV

SEQ ID NO: 17812 - protein, 165 aa, Pyrus communis
FTQQYQLAVCHFNPTPCKDPPDKLFTVHGLWPSNSTGNDPMYCKNTTLNSTKIANLTAQLEIIWPNVLDRTDHITFWNKQWNKHGSCGRPAIQNDMHYLQTVIKMYITQKQNVSEILSKAKIEPVGRFWTQKEIEKAIRKGTNNKEPKLKCQRNTQGTELVEVAL

SEQ ID NO: 17813 - protein, 443 aa, Zea mays
  misc_feature (68)..(68): Xaa can be any naturally occurring amino acid
  unsure (1)..(443): unsure at all Xaa locations
MPVPKPMERKQAAYSNLDERYAIQGEKYQGQQYSHIYFTRLHHMRNLLHALVPSWKPQLPGKLFPAHXVTTVLGLEEGKDCIIVGTLYKHMKLKPSILDEYAKERSAIPLVKPHNFMHPDDHLILEDESGRVTLAGAIPPAAFVTGVVVALHGKETSAGNFLVEDVLEAGLPPQSALSSAEEDKYVVFISGLSVGSDTFNPLQFQLLIDHVTGHLGDENEQSIASNIVRIVVVGNSVHISPRFVNGQTVPSKDQSRIAEPIKELDIMLTQLVASLPVDMMPGCHDPANFSLPQQPLHRCLFSGASTYNTFSSCSNPHQFELDSVQFLGTSGQNIDDLYKYSDAKDKLEFMERTLRWRHLAPTAPNSLGCYPYTDKDPFLVESCPHVYFVGNQDKYETRLLEGQEKQKVRLISIPRFSESGVAVMLNLRNLECSTLSFSTSFDA

SEQ ID NO: 17814 - protein, 169 aa, Pyrus communis
FTQQYQPAACNSNPTPCKDPTEKLFTVHGLWPSNSNGPDPVNCKPKTKVPQAQQPIDPSLKPQLEIIWPNVFNRADNESFWNKQWDKHGTCGYPTIKDKNHYLQTVIKMYITQKQNVSQILSKANINPDGIGRTRKLIENAIRNGTNDKEPKLKCQKNNGTIELVEVSL

SEQ ID NO: 17815 - protein, 473 aa, Nocardia farcinica IFM 10152
MAVTTSTTSGGHSNPPLPHPKWRLPIINDLLTINPIKPTLTSLRDAEQLGGIFERRLVDWPMIVVSDSELITEICDERNWAKHLGVPLRKMRHIARDGLFTARNDEPNWAKAHAVLAPAFTKEAMRSYHQTMLTTIGELLDYWAKRDGQWVDVGEDMNKLTLEIIARTGFDYTFDSFTRSEVHPFVAAMLRGLTYISRNSNMPPFLQKTIGARAAARHSRDITYVRTVVDDVIKARQASGTVGDHHDLLDRMLTVPDPASDELLDTTNVRSQILTMLVAGHETSAGVLAFALYELSRRPELVAAARAEIETRFADGDLSTIAYDDVAKLRTLRRIVDETLRLYPVAPGFFREARHETTIGGGRYRFGPGDWVLVLTLHAHRDPATWGPDAGEFQPDRWLPERMRSLDGRQVFKPFGTGLRACIGRQFAYHEIVLALAHILHTFEFTPDPGYELDIAEQITLKPHRFRLRLNHR

SEQ ID NO: 17816 - protein, 520 aa, Pyrus communis
DVQYLTGHVDERKPPQLADFLNWFLHDKKGTSTLSKPSSTGHRPHHVRVTGRLSTSCHLVDEDRELLLPRRHHNDDDHDNHVSSIFIDQSLTDGGEGGQIIKETSLLPGDQTRFGLESSLMRLELKGNSPHCLVQSDIPPCVQGDASEALDVTATAVASLEECARLSEENDVVQQAYRKEIVVSRNQVIRNSVEQPKVTLYNQSDLEGVHSELVKQGRITAVTNPRYLNLEPTLAMDWLEISWDELNIKERVGAGSFGTVHRAEWNGSDVAVKVLTVQDFHDDQLKDFLREVAIMKRVLHPNVVLFMGAVTKRPHLSIVTEYLPRGSLYRLIHRPASGELLDQRRRLRLALDVAKGINYLHCLNPPIVHWDLKSPNLLVDKNWTAKVCDFGLSRFKANTFISSKSVAGTPEWMAPEFLRGEPSNEKSDVYSFGVILWELATMQQPWGNLNPAQVVAAVGFKNKRLEIPRDLNPNVAAIIEACWANEPWKRPSFAVIMDSLTPLIKAPVTQPSRADMPLLT

SEQ ID NO: 17817 - protein, 402 aa, Rhodopseudomonas palustris CGA009
MADAAAPDAASVRNFTINFGPQHPAAHGVLRLVLELDGEVVERVDPHIGLLHRGTEKLIEQKTYLQAIPYFDRLDYVAPMNQEHAFCLAVEKLLGIAVPRRAQLIRVLYAEIGRILSHLLNVTTQAMDVGALTPPLWGFEEREKLMMFYERASGSRMHAAYFRVGGVHQDLPPKLVDDIDAWCDAFPAVVNDLDRLLSDNRIFKQRNVDIGVVTLDQAWSWGFSGVMVRGSGAAWDLRKSQPYECYAELDFEVPIGKNGDCYDRYHIRMEEMRQSVRIMKQCIAKLRAPHGQGPVVVDDHKIFPPRRGEMKRSMEALIHHFKLYTEGFHVPAGEVYVAVEAPKGEFGVYLVSDGSNKPYKCKIRAPGFAHLQAMDFLSRGHLLADVSAILGSLDIVFGEVDR

SEQ ID NO: 17818 - protein, 96 aa, Brassica napus
KRQLLNILGIVYRYKKMKEMSASERKKAFVPRDCIFGGKAFATYVQAKRIVKFITDVGSTINHDPEIGDLLKVIFVPDYNVSVAELLIPASELSTT

SEQ ID NO: 17819 - protein, 558 aa, Escherichia coli CFT073
MHHATPLITTIVGGLVLAFILGMLANKLRISPLVGYLLAGVLAGPFTPGFVADTKLAPELAELGVILLMFGVGLHFSLKDLMAVKSIAIPGAIAQIAVATLLGMALSAVLGWSLMTGIVFGLCLSTASTVVLLRALEERQLIDSQRGQIAIGWLIVEDLVMVLTLVLLPAVAGMMEQGDVGFATLAVDMGITIGKVIAFIAIMMLVGRRLVPWIMARSAATGSRELFTLSVLALALGIAFGAVELFDVSFALGAFFAGMVLNESELSHRAAHDTLPLRDAFAVLFFVSVGMLFDPLILIQQPLAVLATLAIILFGKSVAALFLVRLFGHSQRTALTIAASLAQIGEFAFILAGLGMALNLLPQAGQNLVLAGAILSIMLNPVLFALLEKYLAKTETLEEQTLEEAIEEEKQIPVDICNHALLVGYGRVGSLLGEKLLASDIPLVVIETSRTRVDELRERGVRAVLGNAANEEIMQLAHLECAKWLILTIPNGYEAGEIVASARAKNPDIEIIARAHYDDEVAYITERGANQVVMGEREIARTMLELLETPPAGEVVTR

SEQ ID NO: 17820 - protein, 303 aa, Lycopersicon chmielewskii
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHYLHTRAIIHRDVKSINILLDENFVPKITDFGISKKGTELDQTHLSTVVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17821 - protein, 303 aa, Lycopersicon hirsutum
TNSINDALSSSYLVPFESYRVPLVDLEEATNNFDDKFFIGAGVFGKVYKGVLRDGTKVALKRRKPESSQGIEEFETEIETLSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYA

SEQ ID NO: 17822 - protein, 303 aa, Lycopersicon hirsutum
TNSINDALSSSYLVPFESYRVPLVDLEEATNNFDDKFFIGAGVFGKVYKGVLRDGTKVALKRRKPESSQGIEEFETEIEILSFCRHPHLVSLIGFFDERNEMILIYKYMENGNLKRHLYGSDLPSMSWEQRLEICIGAARGLHFIHTRAVIHRDVKSINILLDENFVPKITDFGLSKKGTELDQTHLSTVVQGTLGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 17823 - protein, 587 aa, Pseudomonas fluorescens Pf-5
MHAISFIQDLAVIMLVAGVVTILFHRLKQPVVLGYIVAGFIIGPHTPPFGLIHDEQTIKTLAELGVIFLMFCLGLEFSLRKLFKVGATAFIAAFLEIVLMIWIGYEIGRWFGWSTMDSLFLGAILAISSTTIIVKALNDLKMKNERFAQLIFGVLIVEDILGIGIIALLSSIAVSGTVSSGEVFSTVGKLSLFMIVALVIGILLVPRLLAYVARFDSNEMLLITVLGLCFGFCLLVVKLEYSMVLGAFLIGAIMAESRQLLKIERLIEPVRDLFSAIFFVAIGLMIDPQILLQYAWPIAVITVAVVLGKMLSCGMGAFIAGNDGRTSLRVGMGLSQIGEFSFIIAALGMTLQVTSDFLYPVAVAVSAITTLLTPYLIRAADPLSLKLAGVLPKRLSRVLGMYGEWLRSIQPQGEGALLATMIRKILLQVGVNLALVVAIFFSGGYFAKRIGTYLEDWVSEPSWQKALIWGGALLLSLPFLIAAYRKLKALSMLLAEMGVKPEMAGRHTQRVRRVIAEVIPILSLLVIFLLLAALSSSILPTLELLVLIAVVAAAVAAVLWRWFIRVHTRMQVALIETFDHSKDNSGH

SEQ ID NO: 17824 - protein, 239 aa, Lentinula edodes
ISSGCGTTGALSCSSNAKGTCCFEAPGGLILQTQFWDTSPETGPTDSWTIHGLWPDNCDGSFSEDCDPSRDYTGISSLLTAQGASDTLQFMNQFWLNDPDDGSNEELWEHEWATHGTCYSTLQTSCLPEGSPKGAEAVAFFEQVVTLFKTLPTYEWLTNQGIKPSSSTTHTYSALTAALEAEAGVIPALNCDGSDLDEIYWYFHLRGSVIDGEFEPISAPEKGDCPSSGIKWLPKNNEK

SEQ ID NO: 17825 - protein, 439 aa, Silicibacter sp. TM1040
MDLSALKTIRIAACDLNGQMRGKRLPAGMAAKLGEGSARMPFSVLNVDIWGRDIEDSPLVFETGDADGILLPTKRGAVPMPWLATPSALVPMKMVHEDGRPFLGDPRQVLAHVLDRYAEKGWQVAAATELEFILVDDAGTEPLPPIDPLTGRALDQQSVLSIAELDAYDDFFTDLYDGAEAMGIPAQDAISEAGLGQFEINLTHQDAMRAADDTWLFKALVKGVARKHGFAATFMAKPYAEESGNGMHVHFSVVDKDGVNIFDNGGPEGTPALHAAVAGCINAMRDSSLVFAPHGNSYDRLVPGAHAPTSAAWAYENRTAAIRIPGGSPKARRIEHRVSGGDINPYLMLATVLGAALIGMEDGATPPPPSEGNIYDIDGLPQLAGSWAEAIDLFENSPLIARILPPMAIRNLVMTKRQELKGFAERPPESHWLSWLEAV

SEQ ID NO: 17826 - protein, 473 aa, Sulfitobacter sp. EE-36
MMHAILLCGGSGTRLWPLSRKCYPKQFAKLMGDESLFQISAKRLTGPGFAPPIVVTGDPFRFIVTEQLAQVERAAQAILIEPEGRNTAPAILAAALYIGRTDAQALMLVAPSDHVIPDGDAFAQTVQAAVPRAQAGDLVTFGITPTRAETGYGYLELAKGADASAKTPQPLARFVEKPDGATAAKMLQAGNFLWNAGIFLFTAQTIIAAYQAHAPDMLRTVKASLDGAESDLGFTRLAPEPWGQADDISIDYAIMEKADNLAVMPFAAGWSDLGGWDAVWLESGPDAAGNVCSDNATAIDCAGTLLRSETDGLQLVGIGLDNIIAVAMGDAVLVADKSQAQRVKEAVEALKRRDASQAVQLPRDYRPWGWYESLVIGGRFQVKRIVVNPGAALSLQSHHHRSEHWIVVEGTAKVTVDDTVKLISENQSVYIPLGSVHRMENPGKLPMVLIEVQTGSYFGEDDIIRYEDVYARG

SEQ ID NO: 17827 - protein, 455 aa, Silicibacter sp. TM1040
MPTPTRWQEKLPEAATTYLEGRRLDEVECVISDLPGIARGKAVPASKFAKQDYFYLPDSIFYQTITGDWAEAADEDGWIEKDMLLRPDMSTATAAPWTGDWTLQVIHDAYDRDGNPIPFSPRNVLKHVVSLYEAQGWKPVVAPEMEFYLVARNVDPARDIQPMMGRSGRPAAARQAYSMTAVDEFGPVIDDIYDFAEAQGFEIDGITQEGGAGQLEINLRHGSPVKLADEVFYFKRLIREAALRHDCFATFMAKPIADEPGSAMHIHHSVIDIESGENIFSGPQGGETDAFYHFIGGLQNHLPAGLAVMAPYVNSYRRYVKNHAAPINLEWARDNRTTGIRVPLSSSASRRVENRIAGMDCNPYLGIAVSLACGYLGLMEERRPTRQFKGDAYEGEGDFPQVMGQALDLFDESKALHEVLGPEFARVYSTVKRAEYEEFLQVISPWEREHLLLNV

SEQ ID NO: 17828 - protein, 967 aa, Oceanospirillum sp. MED92
MAVETRTLSDLQQANEFTHRHIGPDAEQTQEMLSYLGVDSVEDLMTQTVPDSIRLDDALDMTDSVSEADALAYLKQLAAKNKVNKSYLGMGYSNTLVPNVILRNVMENPGWYTAYTPYQPEIAQGRLEALLNFQQMVMDLTGMELANASLLDESTAAAEAMTLCKRSNRKKSNTFFVADDVHPQTIDVIKTRAEYFGYDIVVGNPLTDLEAADPFGVQLQYPSTYGDITDIKSVIDAAHGQKAMVSVAADILALVLLKSPGELGADIVLGSSQRFGVPMGFGGPHAAFFAASEKLKRSVPGRIIGVSIDVNGNQALRMAMQTREQHIRREKATSNICTAQALLANMASFYVVYHGPEGLKRIAERVHRLTAILANGLKAKGVQVNDTYFDTLTVTLPETQEVVYQRALEEGCNLRKIGSDKLGISLDETTLPADVAVLLDVILGDAHGQTVEALDAAIVAGEATGISADARREDAILTHPTFNSYHSETDMLRYMKKLENKDYSLVHGMIPLGSCTMKLNATAEMIPVTWPEFANIHPFAPADQVAGYHQMLNELEEQLVEITGYDKVSLQPNSGASGEYAGLLAIRKYQESIGEGHRNVCLIPSSAHGTNPASAAMMDMKIIVTKCDDNGNVDVADLRAQAELHKDDLSCLMITYPSTHGVYEEDIVEICDIIHKNGGQVYMDGANMNAQVGISKPGLIGSDVSHLNLHKTFAIPHGGGGPGMGPIGVKSHLAPFLASHKVSPVEGLNPENGAVAAAPYGSASILPITWMYNVMLGKSGLKASTQMAILNANYMTEKLAEHYPVLYRGRNNKVAHECIVDIRPLKEESGVTEEDIAKRLMDYGFHAPTMSFPVAGTLMIEPTESESKVEIDRFVDAMVQIREEIAKVQNGEWPADNNPLFNAPHTQADVMNGAWDRPYTREEAVFPNEATRTNKFWPMTNRIDNVYGDRNFICSCPGIEAYQDQEG

SEQ ID NO: 17829 - protein, 116 aa, Oryza sativa
MTGTSRLLISLWRQKYQVTTRINLTDMFAKYFLNPVEKKQYVCFWFSPNGAKDCHYSHALPPGYVLKSQMKALLEEESEKIAIEDEIEDQRKKVKTTTPMTTDLFMEYKKKKKKKK

SEQ ID NO: 17830 - protein, 334 aa, Pyrus communis
GVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSYTVPIYEGYALPHAILRLDLAGRDLTDALMKILTERGYSFTTTAEREIVRDMKEKLAYIALDYEQELETSKTSSSVEKSYELPDGQVITIGAERFRCPEVLFQPSMIGMEAPGIHETTYNSIMKCDVDIRKDLYGNIVLSGGPTMFPGIRDRMTKEITALAPSSMKIKVVAPPERKYRVWIGGSILASLSTFQQMWIAKAEYDESGPSIVHRKCF

SEQ ID NO: 17831 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPENGGPRICLGQQFALTEASYVTVRLLQEFGNLKQDPNTEYPPKLQNTLTLSLFEGAEVQMYLIL

SEQ ID NO: 17832 - protein, 451 aa, Lactobacillus johnsonii NCC 533
MDEKEKLKLKRSLKSRHVTMIAIGGAIGTGLFLGSGTAIQSAGPSIILSYLIVGIISFFMMRALGELILADPEQHSFIESVKKYLGNRMEFVAGWTYWLCWLSLAMADLTATGIYLKYWFKNLPQWVGPLVIVILLMLVNMVNVGLFGELESWFSMIKVLAILALIITGLILLIMHTKIDSRTVSLSNLVNYGGFFPTGSWGFLKSFQMVVFAFVGIEIVGLTAGETANPDKDIPKAINTLPVRIGLFYVGSMIAIMAVYPWNKIVTTTSPFVQVFGAIGIPAAAGILNFVVLTAAMSATNSAIFSTSRSLYALSRGNNAPKRFGKLSKKAVPNNALTFSSLILFIVVILNYIMPAQVFDIISSVSTINFIMVWIIIMWTHLKYRAENKEQLGKFRMPGFPITSWITIIFYLVILVILALIPATRLPLIISIIFILALALSYTLLERRKSK

SEQ ID NO: 17833 - protein, 349 aa, Rhodococcus sp. RHA1
MKATYMFGAGDVRVIDVPDHTIQSSTDALVRIVRACVCGSDLHPYHSMDAEPAGRSMGHEFIGVVEAIGSDVRTLRVGDFVIAPFAVSCGTCVFCTAGLQTSCVRGGFWNDASLGTAGGQAEAVRVPLADGTLVTVPVGEDADDALLNSLLTLSDVYGTGWHAAVRGGVGAGSVVTVIGDGAVGLSAVLSARLLGAEQIVLMGRHQRRTDLGREFGATDVVAKRGEEGIAKVRELTGGLGSAVVLEAVGHRPAYDQAVGVVRAGGVISRVGVPQYEDAPVGFGSLFGPNVTLTGGPAPVRAYIEQLLPAVLDGTVQPGKVFDRTVGLGQTPEGYAAMDARDALKVAVRP

SEQ ID NO: 17834 - protein, 303 aa, Lycopersicon hirsutum
TNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKRHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYA

SEQ ID NO: 17835 - protein, 320 aa, Bacillus licheniformis ATCC 14580
MDKPFVYVTRKLPEEQLSALKEEAHIEMWEKEEEPCPRAILKEKAKKAHGLLTMLSDTIDEELLKGAPHLKVVANLAVGYDNIDVEAAQKHRVICCNTPGVLTESTADLTFALLMASARRIVEASDWIRQGKWTGWGPLLLAGADVHHKTIGIVGMGSIGQAVARRAKGFGMKILYHNRTRNPDAEAELGASYLPFDELLEQADFVVCLTPLTHETKHLFNRSAFKKMKRSAIFINVSRGQVVNEDDLYEALVEKDIAGAGLDVFAEEPVQKDHPLVSLPQVTALPHIGSAAVETREAMMRLCAENIALVLRGKQAKTEI

SEQ ID NO: 17836 - protein, 94 aa, Brassica napus
  misc_feature (19)..(19): Xaa can be any naturally occurring amino acid
  unsure (1)..(94): unsure at all Xaa locations
MMMLTNIGKLVKQGNGCFXCGSMDHVAKDCVGGGNQASKFIVKDQNRQHGGGEGYDMVFEGDIAERPKREKSHDKDKIRRRSPRGYGEGKKQDR

SEQ ID NO: 17837 - protein, 303 aa, Lycopersicon hirsutum
TNSINDALSSSYLVPFESYRVPLVDLEEATNNFDDKFFIGAGVFGKVYKGVLRDGTKVALKRRKPESSQGIEEFETEIEILSFCSHPHLVSLIGFCDERNEMILIYKYMENGNLKSHLYGSDLPSMSWEQRLEICIGAARGLYYLHTRAVIHRDVKSINILLDENFVPKITDFGISKKGTELDQTHLSTVVQGTLGYLDPEYFIKGRLTEKSDVYSFGVVLFEVLCARSAIVQSLPREMVNLAEWAVESHNNGQLEQIIDPNLADKITPESLRKFGETAVKCLALSSEDRPSMGDVLWKLEYA

SEQ ID NO: 17838 - protein, 606 aa, Zea mays
  misc_feature (24)..(24): Xaa can be any naturally occurring amino acid
  misc_feature (291)..(291): Xaa can be any naturally occurring amino acid
  misc_feature (319)..(319): Xaa can be any naturally occurring amino acid
  misc_feature (324)..(324): Xaa can be any naturally occurring amino acid
  unsure (1)..(606): unsure at all Xaa locations
MAGDALIVIVTSFLLALPSATAIXQVCGNAGNYTANSTYQSNLASLAAALPANTSTSPQLFATATAGQSPDAVYALALCRGDTASSSNLTGCAACVKNSFAYAQRTCPHAKAASVYDDDCLLGFSSSDILIPANNMSTLFQYWNPASIPGGDASMVSADVKDLLTQTARAAASSPRRFATAFMDASGSSIPTLYSLAQCTPDLSAGDCLACLQRLVSLLNATTSVRLGGRVLVLRCNFRFENMMFYDGAPTTRVTTPSSSGPPAPPFPAPTTTDKRAAGTKPWVVAVSVLXAPPLAVVAALCFVLYCRWRSRRYTKARXGGDEXDWEMEAHLSEFWVFDLHQILEATDNFSEENKLGEGGFGPVYKGQLPEGVEIAVKRLASHSGQGFVEFKNEVQLIAKLQHRNLVRHLGCCSQEEEKILVYEYLPNKSLDLFIFADEDRRSLLDWNNRLAIIEGTAEGLLYLHKHSRLRVIHRDLKPSNILLDSEMNPKISDFGLAKIFSSNDVSSEGGTTTRRVVGTYGYMAPEYASEGLFSVKSDVFSFGVLVLEIISGKRNSGIHECGDFINILGYENAADRPTMLDVVAMLSTKTKVLDKPNHPAYFNVR

SEQ ID NO: 17839 - protein, 305 aa, Lycopersicon chilense
TNSINDALSSSYLVPFESYRVPLVDLEEATNNFDHKFFIGHGVFGKVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYE

SEQ ID NO: 17840 - protein, 137 aa, Triticum aestivum
  misc_feature (88)..(88): Xaa can be any naturally occurring amino acid
  unsure (1)..(137): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPXALEFSKVGFIFREHNASPGYYDGVLACGNCLFRCTDPHSVNEWRSQEDT

SEQ ID NO: 17841 - protein, 239 aa, Synechococcus sp. CC9605
MADLQTQMKQAVADAAVEQIKDGMVLGLGSGSTAALMIQGLGAKLASGELKDIVGVTTSFQGEVLAAELNIPLLSLNAVSRIDLAIDGADEVDPGFQLIKGGGACHVQEKLVAARADRFVVVVDSTKLVDRLNLGFLLPVEVLPGAWRQVKQQLEALGGSAELRMAQRKAGPVVTDQGNLVLDAKLDGGISDPVALEQTINNIPGVLENGLFVNITDEVLVGEITDGVAGVRSLQKRLS

SEQ ID NO: 17842 - protein, 430 aa, Oceanobacter sp. RED65
MNYSRSESLFNDAQTHIPGGVNSPVRAFKGVGGTPVFFKKGQGAYMYDEDGNRYIDYVNSWGPLILGHNAPEVMEAVKAQLENGLGFGAPTEIEIEMANKVCEIYPSMNMVRMVSSGTEATMSAIRLARGFTGRDKLVKFEGCYHGHADSLLVKAGSGALTLGVPSSPGVPSVLADLTVTLTHNDLDGVRECFSRIGNEIACVIVEPVAGNMNCIPPEPGFLEGLRELCDVHGIVLIFDEVMCGFRVAKGGAQEKYGVKPDLTTLGKVIGGGMPVGAFGGKKEIMEYLAPLGPVYQAGTLSGNPVAMSAGLAMLNAIEKPGFYDMLSEKAKKLCQGLEALAEKHGIALTTNQVGSMFGFFFSEEKSISRFDQVSRCNMDQFKAFFHGMLDEGVYLAPSAFETGFMCSAVSDEDIEFTLAAADKVMANLAK

SEQ ID NO: 17843 - protein, 249 aa, Xanthobacter flavus
MTAERRPLIAGNWKMNGLRAAKSELRTVAAGLAGLSAETMICPPFTLIGAFAADVAGTQLMIGGQDCHPAESGAHTGDISAEMLRDAGAVAVILGHSERRIDHQEGDAIVKAKVKAAWRAGLLPVVCVGETLVERDAGEAAAVVTRQVRQSVPEGATAVSLVIAYEPIWAIGTGRTPTTDDVAEVHGAIRHILAERFGAEANGIRILYGGSVKPDNAAALLATANVDGALVGGASLKAADFLAIARAVG

SEQ ID NO: 17844 - protein, 349 aa, Nicotiana tabacum
MSKQGALFDLASGVGGKINKEKVLSAVDKYEKYHGYYGGEEEERKNNYSDMVNKYYDLSTSFYEYGWGESFHFAPRWKGESLLESIKRNEHFLALQLGLKPGQKVLDVGCGIGGPLREIARFSSTSITGLNNNEYQITRGQELNNKIGLTLNQTCNFVKGDFMKMSFPDNSFDAVYAIAATCHAPDVVGCYKEIYRVLKPGQCFAVYEWCMTDSYDPNNEEHEKIKSEIELGNGLPEVRLTSQCLEAAKQAGFEVVWDKDLAEDSPVPWYLPLDTSHFSFSSFPLTALGRLLTRNLVSALEFVGLAPKGSQRVQGFLEKAAQGLVGGAKKGIFTPLYFFLVRKPISDLK

SEQ ID NO: 17845 - protein, 320 aa, Zalerion arboricola
MASTAKEGSELTLAVIGCGTMGIAILSGILASLDEIHAPNSQSSETDETPSKLPTKFIACVRSPKGAEKIKKALSPYKTPVKIIQSDNVTACREADVVLLGCKPYMAEGILGEEGMVDALKGKLLISILAGVPAEQIYGYMYGKTPVNPEKEGLCQVVRAMPNTASGIRESMTVIATSSPPLSATTSSLITWIFKRIGDVVQLPAATMDASTALCGSGPAFFALILEAAIDGAVAMGLPRAEAQRMAAQTMKGAAGLVLSGEHPALLKDKVTTPGGCTIGGLMVLEEGGVRGTVARAVREATVVASQLGKGVQGVNGTRF

SEQ ID NO: 17846 - protein, 356 aa, Saccharomyces cerevisiae
MTDLTTQEAIVLERPGKITLTNVSIPKISDPNEVIIQIKATGICGSDIHYYTHGRIANYVVESPMVLGHESSGIVALIGENVKTLKVGDRVALEPGIPDRFSPEMKEGRYNLDPNLKFAATPPFDGTLTKYYKTMKDFVYKLPDDVSFEEGALIEPLSVAIHANKLAKIKFGARCVVFGAGPIGLLAGKVASVFGAADVVFVDLLENKLETARQFGATHIVNSGDLPHGVTVDSVIKKAIGKKGADVVFECSGAEPCVRAGIEVCKAGGTIVQVGMGQEEIQFPISIIPTKELTFQGCFRYCQGDYSDSIELVSSRKLSLKPFITHRYSFKDAVEAFEETSHHPLNNIKTIIEGPE

SEQ ID NO: 17847 - protein, 1012 aa, Glycine max
MPKMRVLFVFLFFHFHFPETLSAPISEYRALLSLRSVITDATPPVLSSWNASIPYCSWLGVTCDNRRHVTALNLTGLDLSGTLSADVAHLPFLSNLSLAANKFSGPIPPSLSALSGLRYLNLSNNVFNETFPSELWRLQSLEVLDLYNNNMTGVLPLAVAQMQNLRHLHLGGNFFSGQIPPEYGRWQRLQYLAVSGNELDGTIPPEIGNLTSLRELYIGYYNTYTGGIPPEIGNLSELVRLDVAYCALSGEIPAALGKLQKLDTLFLQVNALSGSLTPELGNLKSLKSMDLSNNMLSGEIPASFGELKNITLLNLFRNKLHGAIPEFIGELPALEVVQLWENNLTGSIPEGLGKNGRLNLVDLSSNKLTGTLPPYLCSGNTLQTLITLGNFLFGPIPESLGTCESLTRIRMGENFLNGSIPKGLFGLPKLTQVELQDNYLSGEFPEVGSVAVNLGQITLSNNQLSGALSPSIGNFSSVQKLLLDGNMFTGRIPTQIGRLQQLSKIDFSGNKFSGPIAPEISQCKLLTFLDLSRNELSGDIPNEITGMRILNYLNLSKNHLVGSIPSSISSMQSLTSVDFSYNNLSGLVPGTGQFSYFNYTSFLGNPDLCGPYLGACKGGVANGAHQPHVKGLSSSLKLLLVVGLLLCSIAFAVAAIFKARSLKKASEARAWKLTAFQRLDFTVDDVLHCLKEDNIIGKGGAGIVYKGAMPNGDHVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNHEAHVADFGLAKFLQDSGTSECMSAIAGSYGYIAPEYAYTLKVDEKSDVYSFGVVLLELITGRKPVGEFGDGVDIVQWVRKMTDSNKEGVLKVLDPRLPSVPLHEVMHVFYVAMLCVEEQAVERPTMREVVQILTELPKPPGSKEGDLTITESSLSSSNALESPSSASKEDQNPPQSPPPDLLSI

SEQ ID NO: 17848 - protein, 272 aa, Bacillus cereus E33L
MNKQIGFIGCGNMGIAMIGGMIKKNIVSPDQIICSDLNVINLKNASNEYGITITTNNNEVANSADILILSIKPDLYSSVINQIKDQIKNDVIVVTIAAGKSIKSTENEFGRKLKVVRVMPNTPALVGEGMSALCFNEMVTEKDIKEVLNIFNIFGQTEVVNEKLMDVVTSISGSSPAYVYMFIEAMADAAVLGGMPRKQAYKFAAQAVLGSAKMVLETGIHPGELKDMVCSPGGTTIEAVVTLEEKGLRTAIISAMKRCMQKSMEMSSLTSK

SEQ ID NO: 17849 - protein, 469 aa, Rhodopseudomonas palustris CGA009
MTTAKEVLKSIKDNDVKYVDLRFTDPRGKWQHVTFDVSMIDEEIFSEGTMFDGSSIAGWKAINESDMTLMPDPATATIDPFFAETTMVITCDILEPSTGEPYNRDPRGIAKKAEAQVKALGIGDSVFVGPEAEFFVFDDVRYSASPYNTGFKLDSSELPTNSDTEYEGGNLGHRIRTKAGYFPVPPQDSVQDMRSEMLGAMAKMGVKVEKHHHEVASAQHELGMKFDTLTHMADQMQIYKYCIHQVAHIYGKTATFMPKPVFGDNGSGMHVHQSIWKDGKPTFAGNKYADLSETCLHYIGGIIKHAKAINAFTNPSTNSYKRLVPGYEAPVLLAYSARNRSASCRIPYTTSPKAKRVEVRFPDPMANPYLAFAAMLMAGLDGIKNKIDPGPAMDKDLYDLPKEELKQIPTVCGSLREALENLDKDRAFLKAGGVFDDDFIDAFIELKMTEVARFEMTPHPVEFEMYYSY

SEQ ID NO: 17850 - protein, 305 aa, Lycopersicon chilense
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSINILLDENFVPKMTDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17851 - protein, 305 aa, Lycopersicon chilense
TNSINDALSSSYLVPFESYRVPLVDLEEATNNFDHKFLIGAGVFGEVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSINILLDENFVPKMTDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17852 - protein, 247 aa, Zea mays
EAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 17853 - protein, 369 aa, Vibrio fischeri ES114
MAISSAKDIIEDIRLGKMVILMDDEDRENEGDLIIAAEKITPEAINFMATHGRGLICLTMTKDRCEKLGLPPMVQDNNAQFTTNFTVSIEAAEGVTTGISAADRSRTVEAAVAKNAVAADLVQPGHIFPLAAQEGGVLTRAGHTEAGCDLARLAGYEPAGVIVEILNDDGTMARRPDLEIFAEKHGIKLGTVADLIEYRNNNETTIERVAECKLPTEFGEFDLVTYRDTIDNQLHYALKKENTSSEAPLVRVHLQDTFTDILHSDRCAERSWTLPTAMQRIANEGGVLVILGNEESTDSIVHKVKVLERQDSGEAPTMAKKQGTSRRVGVGSQILADIGISDMRLLSSTSKRYHALSGFGLNVVEYVTK

SEQ ID NO: 17854 - protein, 305 aa, Lycopersicon chilense
TNSINDALSSSYLVPFESYRVPLVDLEEATNNFDHKFFIGHGVFGKVYKGVLRDGTKVALKRRQPESSQGIEEFETEIETLSFCRHPHLVSLIGFCGERNEMILIYKYMENGNLKSHLYGSDLPTMSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17855 - protein, 265 aa, Yarrowia lipolytica CLIB122
MSIVSLLNIDVLNNPAPFGSPYEFQITFECLEPLKHDLEWKLTYVGSSTSFEHDQELDSLLVGPVPVGVNKFVFTADPPTVDLIPASELVSVTVIILSCSYNDREFVRVGYYVNNEYDSEELRLNPPPKVQVDHVVRNILAEKPRVTRFNIVWDNEGEQGEEFPPEQPDADLEDDEEEYGAGEEEEEVEEEVEGETEADAKEDIEAEGEAEAEGDGDGDGDGEDEDLEEASDEEMEVVDDEVGEESEGEDDKEDKDDKDDKKDDK

SEQ ID NO: 17856 - protein, 98 aa, Brassica napus
  misc_feature (96)..(96): Xaa can be any naturally occurring amino acid
  unsure (1)..(98): unsure at all Xaa locations
NQWSFTRQHLLVWWDLIKCVFIWFLQAFPANEITSSFSKRLKIKKKSSSGLKYQENLKLKERTDLEKEIASLRETFDDQNVRNQRLKRIKLDLNSXRV

SEQ ID NO: 17857 - protein, 395 aa, Pseudomonas fluorescens Pf-5
MLAQLPPALQNLHLPLRLRLWDGHEFNLGPEPNVTIVVKDPQLVAQLTHPSLDALGGAFVEGKLELEGSISEVIRVCDELSQALLDDDDGNQPVRSLHDKATDAAAISYHYDLSNAFYQLWLDSDMAYSCAYFETGSESLEQAQQAKFRHLCRKLRLQPGDYLLDVGCGWGGLARYAAREFGAKVFGITLSKEQLALARERVTAEGLDDLVDLQLLDYRDLPQDGRFDKVVSVGMFEHVGHANLPEYCQTLFRAVREGGLVMNHGITAKHTDGRPVGRGAGDFIERYVFPNGELPHLAMISAFISEAGLEIVDVESLRMHYARTLDHWSERLEDNLEAAARQVPEQALRIWRLYLAGCAYAFAKGWINLHQILAVKPHADGSHELPWTRDDLYHP

SEQ ID NO: 17858 - protein, 322 aa, Saccharophagus degradans 2-40
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 17859 - protein, 476 aa, Brucella suis 1330
MSADTTEKKATRTPRRRTPAYVKSLRGVKNWKQATEWLAWRDIEDIECITPDQAGVARGKMMPSKKFTSNTSLALPSAVFMTTISGAYPEDGYGFHYPEDDGDLKLLPDLTTLSAVPWETDSTAQVICDLVYQDGRAVEFTPRNVLRNVIAAYSKRGLKPVVAPEIEFYLVRKNPDPDYPLTPPVGRSGRAIGGGQGYSIAGVNEFDELIDDIYHFSEGQGLEIDTLIHEEGAGQLEINLRHGDPVELADQVFMFKRTIREAALKHDMYATFMAKPIQGQPGSAMHIHQSIVDKKTGRNIFTNEDGSESQAFHHFLGGMQRHVPNALVMFAPYVNSYRRLTPDASAPVNVKWGYDNRTTAFRVPRSDPSARRVENRIPSSDANPYLALAASLACGLIGLVNKIEPEQPATTSVNTKEVELPRGLIDAVELFEEDAELRNLFGSSFMTTYAAIKRAEFETFMEVISPWEREFLLLNV

SEQ ID NO: 17860 - protein, 248 aa, Anabaena variabilis ATCC 29413
MTEQKRIAVITGSNRGLGYAISRKLAQIGLHVILTSRNEADGLAAKQQLSAEGLDADYCVLDVTNDVSVQRFTKWLRETYSKVDILVNNAGINPTTKPEESSLLTVQLETMRVTWETNVLAVVRITQALIPLMQVENYGRIVNISTEMASLSSISDDYYPLAPSYRLSKVGVNGITAILAKELQGTNILVNAYSPGWMKTDMGGDNAPFTAEEGAETAVYLATLPDGGVQGQFFAEMRKFGGPVQLQW

SEQ ID NO: 17861 - protein, 121 aa, Arabidopsis thaliana
  misc_feature (83)..(83): Xaa can be any naturally occurring amino acid
  unsure (1)..(121): unsure at all Xaa locations
MASFMVFFTGGGTFPAQATMVASFTGLESFASFPGTRKGHHHLTFITSHGRRSSCVKGGPPIGKKKVETFFYLPDLNDLELAXKEVTTLFRTRGFPGVKSKWNPELGSRNPGTLPGSYNGQ

SEQ ID NO: 17862 - protein, 429 aa, Mycobacterium tuberculosis CDC1551
MDNDGTIVDVTTHQLPWHTASHQRQRAFAQSAKLQDVLYEIRGPVHQHAARLEAEGHRILKLNIGNPAPFGFEAPDVIMRDIIQALPYAQGYSDSQGILSARRAVVTRYELVPGFPRFDVDDVYLGNGVSELITMTLQALLDNGDQVLIPSPDYPLWTASTSLAGGTPVHYLCDETQGWQPDIADLESKITERTKALVVINPNNPTGAVYSCEILTQMVDLARKHQLLLLADEIYDKILYDDAKHISLASIAPDMLCLTFNGLSKAYRVAGYRAGWLAITGPKEHASSFIEGIGLLANMRLCPNVPAQHAIQVALGGHQSIEDLVLPGGRLLEQRDIAWTKLNEIPGVSCVKPAGALYAFPRLDPEVYDIDDDEQLVLDLLLSEKILVTQGTGFNWPAPDHLRLVTLPWSRDLAAAIERLGNFLVSYRQ

SEQ ID NO: 17863 - protein, 386 aa, Thermoplasma volcanium GSS1
MKQSTIGRNIVDEISFGAIVKIRDQLLEMQRQGKKVYRLESGDPSFSLPPHVKEAIKQAIENNKTHYTDSTGIPELRKAIAEKLVRKNKIKDATPENVIVSNGGMNALYVTFRSLLSPGDEVIIPDPMWTEIAEIIKLAEGVPIRLPVENYIEEMQKYEDDDKVKAVFVNSPHNPTGLVFTPKQIDGIISFAESKGIFIVSDEAYEDVIFDGREHVSPGSKYDNTISLFSMSKTYAMSGLRIGYAHTNSEILYDRMKKLLRCTINGVNSATQYGAVAALTGPQEFVGQMRSEYQKRRDIIFNAVSKSRYLEPVKPGGTFYLWAKIKEYPKEVKDSWDMTYYLLDKTGVGSSPGPVFGPAGDGYIRFAFSADTEHVREASELIEKFE

SEQ ID NO: 17864 - protein, 325 aa, Agrobacterium tumefaciens
IAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVVEKHHHEVAAAQHELGVKFDTLVSSADKMQIYKYVVHQVANAYGKTATFMPKPIFGDNGSGMHVHQSIWKGGKPTFAGDEYAGLSENCLYYIGGIIKHAKAINAFTNPTTNSYKRLVPGYEAPVLLAYSARNRSASCRIPFGSNPKAKRVEVRFPDPTQNPYLGFAAMLMAGL

SEQ ID NO: 17865 - protein, 329 aa, Rhodopseudomonas palustris CGA009
MTSNTKKLLVTESLSQRGRALIAERGDIEMIEFPNMISAEDFDALLRTEAPVHGVALGATRFGERELDAAQQMRVVARIGVGYDAIDVPALNKRKVPLMTAGTANSPSVAEQALFMMLTLAKRGAELHALVKTGAWATRLGLLPFDLFGKTVLIVGFGRIGTRTAKRCLAMEMTVLVYDPYVPAAAIEAAGCKQVSDLDAALPDADFVSLHCPKTAETTGLFDAARLSKMKPTAYLINTARGGIVVEQALYEALLAGKLAGAGLDVFEQEPPPHGHKLFDLPNVIIAPHVAGVTREALDRMGEQTARNMLSVLDGDPIRVNVVNQDVLG

SEQ ID NO: 17866 - protein, 128 aa, Glycine max
MSWAGPEDIYLSTSLASYLDKKLLVLLRDGRKLMGTLRSFDQFANAVLEGACERVIVGDLYCDIPLGLYVIRGENVVLIGELDLEREELPEHMTRVSTAEIKRAQKAEREASDLKGTMRKRMEFLDFD

SEQ ID NO: 17867 - protein, 170 aa, Triticum aestivum
MPKKSKKSKSKRVTLKAKHKVLRKVKEHHRKKRKEARKEGKTGRSKVEKDPGIPNEWPFKEQELKNLEVRRAMAIKEQEDKKEARRERARKRKLGIPDDEDMANDNDAAEVTAALAVPKTNDHSERAFYKELVKVIEASDVILEVLDARDPLGTRCVDMEKMVRKADPTK

SEQ ID NO: 17868 - protein, 325 aa, Agrobacterium rubi
IAGWKAINESDMVLMPDTGTVHMDPFFAQSTMVIICDILDPISGESYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLGEMGVVVEKHHHEVASAQHELGVKFDTMVSSADKMQIYKYVVHQVANAYGKTATFMPKPIFGDNGSGMHVHQSIWKGGKPTFAGDEYAGLSETCLYYIGGIIKHAKAINAFTNPTTNSYKRLVPGYEAPVLLAYSARNRSASCRIPFGSNPKAKRVEVRFPDPAQNPYLGFAAMLMAGL

SEQ ID NO: 17869 - protein, 140 aa, Methanocaldococcus jannaschii DSM 2661
MKERTFVALKPDAVKRKLIGKIIERFENKGFEIVAMKMIKLDREMAEKYYEEHKGKEFYERLINFMTSGRMIVMVVEGENAISVVRKMIGKTNPAEAEPGTIRGDFALTTPDNIIHASDSKESAEREIKLFFKEDEIFDK

SEQ ID NO: 17870 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 17871 - protein, 325 aa, Rhizobium giardinii
IGGWKAINESDMVLMPDPATVHMDPFFAQSTMVIVCDILDPVSGEAYNRDPRGIAKKAEAYLKASGIGDTVFVGPEPEFFVFDDVKYKADPYNTGFKLDSSELPSNDDTDYETGNLGHRPRVKGGYFPVPPVDSCQDMRSEMLTVLTEMGVTVEKQHHEVAAAQHELGVKFDTLVRNADKIQIYKYVVHQVANAYGKTATFMPKPIFGDNGSGMHVHQSIWKDGKPTFAGDEYAGLSETCLFYIGGIIKHAKAINAFTNPTTNSYKRLVPGYEAPVLLAYSARNRSASCRIPFGTGPKSKRVEVRFPDPLANPYLGFAAMLMAGL

SEQ ID NO: 17872 - protein, 531 aa, Sulfitobacter sp. EE-36
MAPKVLISDKLSDAAVQIFKDRGIDVDFQPDLGKDKDKLAAVIGDYDGLAIRSATKVTEKILANATNLKVIARAGIGTDNIDKDAASKKGVIVMNTPFGNMITTAEHAIAMMFAVARQIPEASASTHAGKWEKSKFMGVELTGKTLGVIGAGNIGGIVCDRARGLKMKVAAYDPFLSEEKAKKMGVEKVELDDLLARADFITLHVPYTDQTANILSKEALAKTKKGVRIINCARGGLVDEEALAEALKSGHVAGAAFDVFKEEPATENPLFGLPNVVCTPHLGAATTEAQENVALQVAEQMSDYLLTGAVTNALNMPSVTAEEAKVMGPWITLAGHLGAFIGQMTDEAVKAINILYDGQVSEMNLNALNCAVVAGIMKRANPDVNMVSAPVVAREKGIQISTTNQDKSGVFNGYVKVTVVTEKRERSIAGTVFSDGKPRFIQIKGINIEAEVGAHMLYTTNNDVPGIIGTLGQTLGANDVNIANFTLGRSTAKGEAIALLYIDGPLPEKALKDLRDTGLFKQVKELEFEVA

SEQ ID NO: 17873 - protein, 377 aa, Bacillus cereus E33L
MKAVTYQGPNQVQVKQVDDAKLEKKDDIIVKITSTAICGSDLHLYQGNMPLPPGYIIGHEPMGIVEEVGPDVTKVKKGDRVVIPFNVACGHCFYCQHEMESQCDNSNPHYDSGGYFGYTEKFGNHPGGQAEYLKVPFGNFTPFVIPESCELEDESLLFLSDVLPTAYWSVINAGVKPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 17874 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKTIGAEQAEKTRILYGGSVNGKNAKDFKDKANVDGFLVGGASLKPEFVDIIKSRL

SEQ ID NO: 17875 - protein, 455 aa, Exiguobacterium sibiricum 255-15
MEQQGLKRDLSNRHVQLIAIGGTIGTGLFLGSGKAIQLAGPSIVFAYLLVGIAIFFVMRALGELLLSKAGYQSLTDIAEDYLGPRAAFVTGWTYWFCWIMTAMADVIAVGVYVKYWFDIPQWIPAVIALLILLGFNLLTVKLFGELEFWFALIKVVTILALIGVGIVLLVIGFNTDAGPVTVKNLWQHGGMFPNGVTGFLLSFQMVVFAYVGVELVGVSAAETADPKKNIPSAINKIPLRILFFYVGALLVLLMINPWTGLNATESPFVKTFSLIGIPVAAGIINFVVLTSAASACNSGMFSTSRILYNLGNQKQAPQSFSKLNKNHVPANALFVSTLVVSGGALLSKLLPGQAFSIVTTISAICFIWVWGVILVCHLKYKKTQPELHAASTFKAPLTPFVNYLVLGLFTLILIVMLVADETRPALLLTPVWFIGLFILYQLRTKKHQKAERHSA

SEQ ID NO: 17876 - protein, 325 aa, Rhizobium gallicum
IGGWKAINESDMVLMPDTETVHMDPFFAQSTMVIVCDILDPVSGEAYNRDPRGTAKKAEAYLKASGIGDTIFVGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFPDPTANPYLAFAAMLMAGL

SEQ ID NO: 17877 - protein, 394 aa, Streptococcus thermophilus CNRZ1066
MTVMDLTQRFNKNLDKIEVSMIRQFDQSISDVPGIKKLTLGEPDFTTPDHVKEAAKTAIDANQSHYTGMAGLPDLRQAAANFVKEKYNLTYNPDNEILVTIGATEALSASLTAILEPGDTILLPAPAYPGYEPIANLVGAKIVEIDTTANDFVLTPEMLEKAILEQGDKLKAVLLNYPTNPTGVTYSRQQIEDIAEVLKKYDIFVVSDEVYSELTYVDQHVSIAEYLPEQTILINGLSKSHAMTGWRIGFIFAPESLTAQLIKSHQYLVTAAATMAQFAAIEALSAGKDDAQPMKVEYLKRRDYILEKMTELGFKIIKPDGAFYIFAKIPEGYNQDSFKFCQDFAREKAIAIIPGVAFGKYGEGYVRLSYAASMDTIETAMTRLKEFMEEHAEA

SEQ ID NO: 17878 - protein, 303 aa, Lycopersicon chilense
TNSINDALSSSYLVPFESYRVPLLDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17879 - protein, 325 aa, Rhizobium leguminosarum
IGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFPDPTANPYLAFAAMLMAGL

SEQ ID NO: 17880 - protein, 184 aa, Arabidopsis thaliana
  misc_feature (21)..(21): Xaa can be any naturally occurring amino acid
  misc_feature (46)..(46): Xaa can be any naturally occurring amino acid
  misc_feature (88)..(88): Xaa can be any naturally occurring amino acid
  misc_feature (101)..(101): Xaa can be any naturally occurring amino acid
  misc_feature (130)..(130): Xaa can be any naturally occurring amino acid
  misc_feature (145)..(146): Xaa can be any naturally occurring amino acid
  unsure (1)..(184): unsure at all Xaa locations
MAISMLSSATMDASPDRVTMXAPFKVIHSSAAFPATRRAKKDITSXITINGRRVNCMPGCSPMGRKKFETLSYLPDHTESKLDIVDDXLMLMKGMPCGEFXLEQGFGYREDVISPRYYDCDGHCTMWKLXMIGCTDSAQVSNELXXCYKEYPNVLLYGFVGFEHTRQALCINCIGYHSEASQKS

SEQ ID NO: 17881 - protein, 303 aa, Lycopersicon chilense
TNSINDALSSSYLVPFESYRVPLLDLEEATNNFDDKFFIGEGGFGKVYKGVLRDGTKVALKSCKPESSQGIEEFETEIEVLSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKMRPESLRKFGETAVKCLALSSEDRPSMGDVLWKLEYA

SEQ ID NO: 17882 - protein, 427 aa, Mannheimia succiniciproducens MBEL55E
MTDSNTLFSRAQQVIPGGVNSPVRAFKGVGGTPVFIQKAKGAYIWDTDDKQYVDYVGSWGPMILGHNHPAILSAVIKTAENGLSFGAPTPIEIDLAELVCKLIPSMEMVRMVSSGTEATMSAIRLARGYTNRDKIIKFEGCYHGHADSLLVKAGSGALTLGQPNSPGVPADFAKHTLTCTYNDLESVKQAFEQYPQDIACIIVEPVAGNMNCVPPQNNFLQGLRELCNQYGAVFIIDEVMTGFRVALGGAQSYYNVEPDLTCLGKVIGGGMPVGAFGGKKEIMQFIAPTGPVYQAGTLSGNPIAMAAGLACLTELQKAGNQERLAQLTEKLALGLKALADKHHVPFTVNYVGGMFGLFFTDKAQVTCYQDVMACDTEKFKVFFHKMLDEGVYLAPSAFEAGFMSLAHTDADIDRTLTAADKAFAALA

SEQ ID NO: 17883 - protein, 381 aa, Haloarcula marismortui ATCC 43049
MTFEAADRVDSVPPSGIRRFFELAEEMDDIISLGVGEPDFSAPWSAREAAIASLERGQTSYTANRGKRELRERIADYEAATHNLQYDPDEEILVTAGASEGLDLAFRALLNPGDSIAIAQPCYVSYVPGATFAGIDVIDVPTRAEDEFKLTQEVLESSGAAEADALVYCFPNNPTGATMTAEEMADVAAFCRENDLLVFADEIYADLTYEHDHTSIATLPGMRERTVVFNGFSKAFAMTGFRLGYAMAPPEAVEAMNRIHQYSMLSAPTTAQHAAIEALDNCRDEVTDMAAQYDRRRKYVLTRFEEMGLDCFPAAGAFYAFPECPWDDAGEFAESLLQEKRVAVVPGTAFGEGGSGHLRVSYATGLDDLKEAMARIESFLN

SEQ ID NO: 17884 - protein, 305 aa, Lycopersicon chilense
TNSINDALSSSYVVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKSHLYGSDLPTMSMSWEQRLEICIGAARGLHYLHTRAVIHRDVKSTNILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 17885 - protein, 303 aa, Lycopersicon chilense
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDEINEMILIYKYMENGNLKRHLYGSDLPSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17886 - protein, 130 aa, Triticum turgidum subsp. durum
MAAAATATTTAAATAAAVGPGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAA

SEQ ID NO: 17887 - protein, 334 aa, Arabidopsis thaliana
MATATSHQSVVSFASLRSSPSSTISQCGFKIDSSLSFTSKKTNFCKIKAMASSVSFNNTLLSPSKTIPDNSQKKSNEAALILIRHGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 17888 - protein, 485 aa, Methylococcus capsulatus str. Bath
MSSVTVKPLILSGGVGSRLWPHSREAYPKQFLPLLGERTLFQETTGRIGGMAESRFDIRSPLIVCNEQHRFLVAEQLRQMGYDDADILLEPSGRNTAPALTIAALHVSERLGGDCILAVMPADHHIADVEGFRAGLARALGVAGRGLIGTFGIVPDRPETGYGYIRKGRSLEDGTVFELEAFVEKPDAETAAQYLSSGDYLWNSGLFVLRANVWLERIGSHRPDILESCSAAYEKATADGNFIRVDRTDFLRCPSDSIDYAVMEKLNGTGQAVVIPLDVGWCDLGSWASLSEVKPRDEHGNVVEGDVYARDTRNSLLYADSRFLAAIGVDDLLVVDTADAVLVAHKSKAQDIKQIAEHLEAANRTEHKVHRRVHRPWGTYESIDTGQRYQVKRITVTPGAALSLQMHHHRAEHWIVVRGTARVVRGEESFLLTENQSTYIPIGVHHRLENPGTIPLEIIEVQSGSYLGEDDIVRFQDHYHRTKEG

SEQ ID NO: 17889 - protein, 440 aa, Oryza sativa (japonica cultivar-group)
MGDFNVALVIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQEATELGKKARELKKAAEALHQEEKSGKKGRKWRKNVKALGKELVLLEDDMKALEEMYPQGEQAEATWALTVLGYIGKLLFGAVGLIISIAWVAHIVIYLLIDPPLSSFLNEIFVKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 17890 - protein, 510 aa, Oryza sativa (japonica cultivar-group)
MGDFNVALVIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQCAAYTAPANSQTTWTMRATFPEYVVALATIVGSVLFTIFGGVGIACLPLGLIFSFVRRPKAVITRSQYIKEATELGKKARELKKAAEALHQEEKSGKKGRKWRKNVKALGKELVLLEDDMKALEEMYPQGEQAEATWALTVLGYIGKLLFGAVGLIISIAWVAHIVIYLLIDPPLSSFLNEIFVKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 17891 - protein, 271 aa, Brucella suis 1330
MQDKVVLVGCGNMGFAMLRGWLDSGILKAGDVHVVEPAEALRERAALAHVHVYADAADLPADLQPRMVLVAVKPQMMANVLPAYKRFAPASTFVSVAAGIPVALFESHLGKDVAVIRCMPNTPAAIGKGMLVTFKNANVSDANEAFVTSLLKTSGKVASVDEEGLMDAVTAVSGSGPAYIFHFIEALTDAGVNLGLPRETAALLAMQTVMGAGALADASTDSPSKLREQVTSPNGTTAAALDVLMGGDRLKELVAEAVKAAHKRSVELGKS

SEQ ID NO: 17892 - protein, 653 aa, Oryza sativa
MDDLPDDQGQSDAHPSDPNWWSSHAEHKLGSISLTKQERNSGSPGSSHCGEGDHSLWAAQTLWCTGCLSSPIPNGFYSIIPDKKLKERFDTIPSPDDLYSLGIEGFKAEIILVDLEKDKKLSAIKQLCAALVKGLKSNPAAMIKKIAGLVSDFYKRPNPQLSPARTSSEEISHFMENRGVQLLGQIRHGSCRPRAILFKVLADAVGMDCKLLVGIPNEEYHEYDDSSKHMSVVVMLKSVEFLVDLMRFPGQLVPFSSKAIITSHISAAGESDSADYDSCDSPLEPNSPLCSQRQEQDDNNRSFKVPSLRNIMLKSTNSMEGKLRCSSHSEPNVANSFCGRSRRKVVEEHQRTASSSPEHPLSRTRGRSMLGDRQHGDGVAVSRSDGASTSNMRRGRRRSISFTPEIGDDIVRTDRNFYLLVYSAVRAMSERMRENRLSRGQNDGSPGQLNDSQKNESPHDFNDNELHVRGPDEQEGSRRQVSNQKAVSLPSSPHRLRSDGSGLRGPAEFLTADLMSTWNKVLRSSPFLNKPLLPFEEWHIEFSEITVGTRVGIGKYMGSLEKFSVPPHLSLVTEYMEMGSLYYLIHASGQKGTPEWMAPELIRNEPFTEKCDIFSLGVIMWELCTLSRPWEGIPSVQIIGWLKTHYPYSTIIH

SEQ ID NO: 17893 - protein, 325 aa, Agrobacterium rhizogenes
IAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLGEMGVTVEKHHHEVAAAQHELGIKFDTLVRNADKMQIYKYVVHQVANAYGKTATFMPKPIFGDNGSGMHVHQSIWKAGKPTFAGDEYAGLSESCLYYIGGIIKHAKALNAFTNPSTNSYKRLVPGYEAPVLLAYSARNRSASCRIPFGTNPKAKRVEVRFPDPTANPYLGFAAMLMAGL

SEQ ID NO: 17894 - protein, 321 aa, Gloeobacter violaceus PCC 7421
MTQKYGPKTTTDEVLSGIELKGKRFLITGASSGIGLETARSLVSHGASVVGAVRNLAKAEPATASVRDAASQGGSLELINLDLASLQSVRACADKLLADGQPFDAIIANAGVMATPFGRTIDGFEVQFGTNHLGHFALINQIEPLLANDGRLVVLSSLAHRGADIDLDDPNFEQQAYDPWVAYSRSKTANSLFAVEFDRRYRDRGIRAASVMPGNSLTDLPRHLSPEDLQGLLQTVDAARTEAGLPPKELKEISQAAATSVWAAVVANKDEIGGHYLEDCAVVPIDDTPNPFADGVRSYALDANRAKQLWAKSEELISAAS

SEQ ID NO: 17895 - protein, 325 aa, Rhizobium galegae
IGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFPDPLANPYLAFAAMLMAGL

SEQ ID NO: 17896 - protein, 461 aa, Mycobacterium tuberculosis CDC1551
MATATTQRPLKGPAKRMSTWTMTREAITIGFDAGDGFLGRLRGSDITRFRCAGRRFVSISHPDYVDHVLHEARLKYVKSDEYGPIRATAGLNLLTDEGDSWARHRGALNSTFARRHLRGLVGLMIDPIADVTAALVPGAQFDMHQSMVETTLRVVANALFSQDFGPLVQSMHDLATRGLRRAEKLERLGLWGLMPRTVYDTLIWCIYSGVHLPPPLREMQEITLTLDRAINSVIDRRLAEPTNSADLLNVLLSADGGIWPRQRVRDEALTFMLAGHETTANAMSWFWYLMALNPQARDHMLTELDDVLGMRRPTADDLGKLAWTTACLQESQRYFSSVWIIAREAVDDDIIDGHRIRRGTTVVIPIHHIHHDPRWWPDPDRFDPGRFLRCPTDRPRCAYLPFGGGRRICIGQSFALMEMVLMAAIMSQHFTFDLAPGYHVELEATLTLRPKHGVHVIGRRR

SEQ ID NO: 17897 - protein, 749 aa, Coccidioides immitis RS
MAEGPKFTVRPVARQPRNDSKDAFRIFMSPASLLQVHCIVGEPCQLRLDGGPPKTAIAWSAPERIHDNVVQTSKLLQTLYGFKLGDKVTVTRAEDSLRDIGVVRLEECSDPAVTSTCVKLDEKDQPYWEWALEHPLSKCEILAVDMVFECELKKCRRTFKVVEIDPGRERSANTIARFTSESKVKIGSVKFVSTPKSGLEVDSSGLGGLGPQIKQINERLRDFTAEAQKIDMPPFFKNSGGILIYGSKGTGKTSLLAKIEAAGWRNVFTVKSSIIGRSTVDGEAKLRKIFAEALKSQPSLIAIDQLDFLAPRRGSNDAMSMASVLCENLDSLQNNHVLVVACTRHPNDVDDTLRTPHRLGIEIELPVPTGNDRAEILRALRGSADQPCDDLLAKIAAQTHGYVGADLFSLLQLSCRKAQTRQLSQSVKEEAGLDQNQAPAENPELEEPSRIPLEIREEDVALALQETRPTAMREVFLETPAVRWKDIGGQRDIKRYLQKAVERPLRHPERMKRFNVSGKKGVLLYGPPGCSKTLTVKALATEAGLNFLAVKGAEILSMYVGESERALREIFRKARAARPSIIFFDEIDAIAGRRGPGSQSGINVLTTLLNEMDGIEELKNVLVVAATNKPETLDPALMRPGRLDNILYVGLPDMEARKEILDIWFSKSEVHDEVDPIALASRTEGYSGAELVNVCETAADAALDEEEELGEEGKIKWEHFEKALGQVPKQISPAVIREYDRWSKEFGNR

SEQ ID NO: 17898 - protein, 325 aa, Rhizobium huautlense
IGGWKAINESDMVLMPDPATVHMDPFFAQSTMVIFCDILDPISGEAYNRDPRGTAKKAEAYLKASGIGDTIFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPVFGDNGSGMHVHQSIWKDGKPTFAGDEYAGLSESCLYYIGGIIKHAKAINAFTNPTTNSYKRLVPGYEAPVLLAYSARNRSASCRIPFGTGPKSKRVEVRFPDPLANPYLGFAAMLMAGL

SEQ ID NO: 17899 - protein, 108 aa, Triticum aestivum
VQSQPQCLCSALGGDSSSLGGMTINKTRALELPKACNVQTPPASKCNGGGTAPGAATPTTPEVQTPAGSGSKTTPSAYLQENGGSSLQGPAGLVLALAAAAVYAVSSL

SEQ ID NO: 17900 - protein, 305 aa, Lycopersicon chilense
TNSINDALSSSYVVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKSHLYGSDLPTMSMSWEQRPEICIGAARGLHYLHTRAVIHRDVKSTNILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 17901 - protein, 466 aa, Exiguobacterium sibiricum 255-15
MKEGTFRRKMESRHIVMLSLGGVIGTGLFLSTGYTLEQAGRVGTILSYLVGALAIYLVMLCLGELAVHMPETGAFHSYATKYIGSGTGYTVAWLYWLTWTVALGSEFTAAGLLMQRWFTDVPVWLFSALFVVMILGINVLTVRLFAEVEFWFSAVKVLTILVFIVLGTAAIVGFLPLADGSQAPLLAPLTEGGLFPNGAFAILMTMLAVNFAYSGTELIGIAAGEAVDPKRTVPLAIRTTVFRLVLFFVGTIIVLAILLPNDSKGVLESPFVAVFERIGLPFAADIMNFVILTAILSAANSGLYAASRMLWSLSDQRMITPYFSKLNASGVPTRAVLFSMLGGLLALFSSVYAPGSVYIALVSISGLAVVVVWMSISASQFMFRKRYLQEGHDLNDLVYRTPWYLFVPILSFLMCLASLIGIAFDPTQRVALYFGVPFIAVCYIVHHLTKTSWKRSVEDVKEQQSS

SEQ ID NO: 17902 - protein, 228 aa, Pyrus communis
MGITGMIYMVTVVFSLIVLILSSSAVKFDYFQFTQQYQPAVCNSNPTPCKDPPDKLFTVHGLWPSNVNGSDPKKCKTTILKPRTIRNLKAQLEIIWPNVSYSKGSVRFWRKQWRKHGTCGYPTIADDMHYFSTVIEMYTTKKQNVSEILLKAKIKPEGRFRTRDDIVNAISQSIDDKEPKLKCKNNNNITELVEVGICSDNNLTQFINCPHPFPQGSPYLCPTNNIQY

SEQ ID NO: 17903 - protein, 303 aa, Lycopersicon chilense
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDEINEMILIYKYMENGNLKRHLYGSDLPSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNPADKIRPESLRKFGETAVKCLALSSEDRPSMGDVLWKLEYA

SEQ ID NO: 17904 - protein, 229 aa, Pyrus communis
MGITGMIYMVTMVFSLIVLILSSSAAKYDYLQFTQQYQPAACKFHHTPCKDPLDKLFTVHGLWPSNFNGPDPENCKVKPTASQTIDTSLKPQLEIIWPNVFNRADHESFWQKQWDKHGTCGSPTIIDKNHYFQTVIRMYITEKQNVSYILSKANINPDGKGRTRKDIQIAIRNSTNDKEPKLKCQTKNGITELVEVSLCSNYLGKNFINCPNKTPGKTRYSCPTNDIHY

SEQ ID NO: 17905 - protein, 303 aa, Lycopersicon chilense
TNSINDALSSSYLVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSINILLDENFVPKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17906 - protein, 807 aa, Novosphingobium aromaticivorans DSM 12444
MSLDKNSRAAEIDAQIIDVLRHRVGKDERAAKPHDWYTATVLTLRDAIIDRWMESTRKTYAESGKRVYYLSLEFLIGRLLRDALSNMGLTRDMELALREHGFDLSALEDLEPDAALGNGGLGRLAACFMESLASLDIPAYGYGIRYVNGMFRQRIDDGWQVELPETWLSHGNPWEFDRRESAYIIGFGGEVVEKADGVEWRPAEKVEASAVDTPVVGWRGKRVNTLRLWTAHAFDPLRLDAFNAGDHFGALAEQVRADSLVRVLYPADSTPAGQELRLRQEYFFTSASIQDIVRRHVQYNGDIRTLPEKAAIQLNDTHPAVAVAELMRLMVDVHGLEFNEAWEVTKATVGYTNHTLLPEALESWPLPLFERLLPRHMQIVYAINSRVLREARKAGLDDAAISAISLIDEGGERRVRMANLAFSGAHSVNGVAALHTELMKTTVFSDLHKLYPARINNKTNGVTPRRWLQQCNPGLTSVLKDAIGDCFLDDAEKLSDLNALADDPALGERIAEVKRTNKIALAKHVKELMGIRLDPDALFDVQIKRIHEYKRQLLNLIETVALYDQIRSHPERDWVPRVKIFGGKAASSYHNAKLIIKLANDIARRVNSDPSVGGLLKVVFVPNYNVSLAEKIIPAADLSEQISTAGMEASGTGNMKFALNGALTIGTLDGANIEIKDRVGDANIEIFGLTAQEVEDKRANGYNPREVIESSRELQQAIAAIATGVFSPDDPQRYAGLMGGIYDHDWFMVAADFDAYHAAQRNIDRRWEQQPSWRASAIRNIANVGWFSSDRTIGEYARDIWGVRDRA

SEQ ID NO: 17907 - protein, 228 aa, Pyrus communis
MGITGMIHIVTMVFSLIVLILSSSTVGYDYFQFTQQYQPAVCYFNPTPCKDPPDKLFTVHGLWPSNLNGPHPENCTNATVNSQRITNIQAQLKIIWPNVLDRTNHVGFWNKQWIKHGSCGNPPIMNDTHYFQTVINMYIIKKQNVFEILSNAKIEPEGKNRTRKDIVKAIRSGTNGKRPKLKCQKNNRTTELVEVTLCSDRNLTRLINCPNLIKPKSPYFCPLKSIQY

SEQ ID NO: 17908 - protein, 466 aa, Nostoc punctiforme PCC 73102
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 17909 - protein, 227 aa, Pyrus communis
MGNTGMIYMFTMVFSLIVLILSSSTVGYDYFQFTQQYQPAVCNSNPTPCNDRPEKLFTVHGLWPSNKKGPDPEKCKNIQMNSQKIGNMAAQLEIIWPNVLNRTDHVGFWEREWLKHGTCGYPTIRDDMHYLKTVIKMYITQKQNVSAILSKAMIQPNGQNRSLVDIENAIRSGTNNTKPKFKCQKNTRTTTELVEVTLCSDRDLTKFINCPQPQQGSRYLCPADVQY

SEQ ID NO: 17910 - protein, 249 aa, Silicibacter pomeroyi DSS-3
MSDWPQGYGKRVLDEVDSTLNEAARIAPTLSGPEWIMARRQTAARGRRGRAWTQAQGNLAATLVMRPVGEAKQAALRSFVAALALFDACVAVTGRAEGLALKWPNDVLLNGGKLAGILLESTGHGSGVAHLAIGIGVNLADAPGADAVEPGAVRPVSLVSETGAQVEPELFLTELAAAFARYETQFLTYGFAPIRSAWLARAARLGEVITARTATSQTVGTFETVDAEGNLVLNTAQGRVSIPAAEVYF

SEQ ID NO: 17911 - protein, 164 aa, Oryza sativa
HEGLKVRAGIVGYPNVGKSSLINRLLKRRMCPAAPRPGVTRELKWVRFGKDLELLDSPGILPMRISDQTAALKLAICDDIGERSYDFADVAAILVQILFRHPAVGSEAFRKRYKIDVDSDCGKLFVTKLSVHLFNGDTTQAAFRILSDFRKGRFGWVALERPPT

SEQ ID NO: 17912 - protein, 639 aa, Cryptococcus neoformans var. grubii
MASPATQTANAIAAINNRSNLVIPEIDFTQHQLENGEIVSTTERVIKDVQAPAMYVPTDDQFWSKVDKTKPDIAFLKNHFYREGRLTEEQALYILEKGGELLRSEPNLLEVDAPITVCGDIHGQYYDLMKLFEVGGNPADTRYLFLGDYVDRGYFSIECVLYLWSLKMWYPDTLFLLRGNHECRHLTDYFTFKLECKHKYSETVYNACMESFCNLPLAAVMNKQFLCIHGGLSPELHTLDDLRSINRFREPPTQGLMCDILWADPLEDFGSEKTNENFLHNHVRGCSYFFTYNAACQFLERNNLLSIIRAHEAQDAGYRMYRKTKTTGFPSVMTIFSAPNYLDVYSNKAAVLKYESNVMNIRQFNCTPHPYWLPNFMDVFTWSLPFVGEKITDMLIAILNCCTKEELEEEDEEFPLNAPEPTDAESAAERRQIIKNKILAVGRMSRVFSLLREESERVSELKSISGSNALPAGMLASGAEGIKEAIQGFEDARKSDIENERLPPDIIDPDEDKPASPSASPIMPATPEEIPSEIPYDSPITGTPRTPISSAIASGSPGSPGTPTSPSIGGPPLTAWRPGHGRRTSLGTTKTSPSTRRRSLENTMHLIRDVVGGKDAQGDGQLERLAEVISSPTKGGQGE

SEQ ID NO: 17913 - protein, 165 aa, Oryza sativa (japonica cultivar-group)
MAGGGRADDERRIGVAMDYSASSKRALDWAIANLLRRGDHLVVLHVLHHGGEEAKHALWGKSGSPLIPLSEFRDPTAMQQYGVHCDAEVLDMLDTAARQLELTVVAKLYWGDAREKLCDAVEEQKIDTLVMGSRGLGSIQRILLGSVTNYVLSNASCPVTVVKGK

SEQ ID NO: 17914 - protein, 539 aa, delta proteobacterium MLMS-1
MNTQVRPVLLAILDGWGEAPAGPGNAVALAATPNMDRWRRQYPLTTLVAHNGAVGLPKGQMGNSEVGHLNIGAGRTVYQEFTRISLAVENGEFYDNPTLVETVERVRETGGALHLLGLLSDGGVHSHLEHLIALLELARRRGLAKVYIHAFMDGRDTSPHGGRGYMETLLAAIDRLGVGQVATVCGRYYAMDRDKRWERLQLAWEAVVEGSGQYTAAEPLAAVDEAYNRGETDEFIKPTVVVAAGAAPVKIDHGDGVIFFNFRADRARQLTAALSQDDFAGFERPRRPALSALTTMTRYEKDFELPVAFPPQTLERIMGEEVSRHGLKQLRIAETEKYAHVTYFFNGGREEPFDGEERALIPSAREVATYDLKPEMSAAEVTAELLRRLQPAAAPAAAANAAAGGPATTSPYALVVLNFANGDMVGHSGVLPAAIKACEAVDHCIGQVVEAFTAVGGAVLITADHGNAEEMLDEQGNPMTAHSCNPVPLLLIDPGARQPGTLRDDGTLTALAPTILDLMGLPVPREMDGGSLLQPAGGR

SEQ ID NO: 17915 - protein, 340 aa, Taxus baccata
MGSTGKIKIGINGFGRIGRLVARVALQRDDIELVAVNDPFISTESLTSLFKYDSVHGQWKKHEVKVKDEKTLLFGEKHVAVFGCRNPEEIPWGEVGAEYVVESTGVFTDKDKAAAHLKGGAKKVVISAPSKDAPMFVVGVNEHEYKSDLTIVSNASCTTNCLAPLAKVINDRFGIVEGLMTTVHSITATQKTVDGPSNKDWRGGRAAGFNIIPSSTGAAKAVGKVLPVLNGKLTGMCFRVPTQDVSVVDLTVKLEKSATYGEIKAAIKEESEGKLKGILGYTEDDVVSTDFIGDSRSSIFDAKAGIALNDNFVKLVSWYDNEWGYSSRVIDLIVHMDSTA

SEQ ID NO: 17916 - protein, 545 aa, Triticum aestivum
MGNKKGGSSWLTAVKRAFRSPSKEDSPKKSARLREDPDADEDKTKRERRRWLFRRSSSPSPSPASAPAPPEQQQSASRSAPAPAVTDEQRHAIALAVATAATAEAAVATAQAAAEVVRLTRPSSSFVREHYAAIVVQTAFRGYLARRALRALKGLVKLQALVRGHNVRKQANMTLRCMQALVRVQARVRDQRLRLSQESLSAAGAAACGSSKSSYSVDTSAFWDSKYTQEYAERRSVERSRDGSSFAAEDWDDRPRTIEEIQAMLQTRKDAALKRERALSYAFSHQIWRNAAPSVEEEMNVDGQPRWAEKWMASRASFDTNRSSARTAAAAAAAAPGRASTDHRDQVKTLEIDTARPFSYSTPRRHAPPSQHGNGSPMHRAHHQASVTPSPGKARPPIQVRSASPRVERGTSGGGGSYTPSLHSQRHASSGSAVPNYMAATESAKARIRSQSAPRQRPATPERDRPQTAYNPAGGSAKKRLSFPVPQDPYGVGYAQSLRSPSFKSATGRFTSEQRSTVSSLSCAESVGGEPVSPSSTTDLRRWLR

SEQ ID NO: 17917 - protein, 487 aa, Saccharomyces cerevisiae
MDALLTKFNEDRSLQDENLSQPRTRVRIVDDNLYNKSNPFQLCYKKRDYGSQYYHIYQYRLKTFRERVLKECDKRWDAGFTLNGQLVLKKDKVLDIQGNQPCWCVGSIYCEMKYKPNVLDEVINDTYGAPDLTKSYTDKEGGSDEIMLEDESGRVLLVGDFIRSTPFITGVVVGILGMEAEAGTFQVLDICYPTPLPQNPFPAPIATCPTRGKIALVSGLNLNNTSPDRLLRLEILREFLMGRINNKIDDISLIGRLLICGNSVDFDIKSVNKDELMISLTEFSKFLHNILPSISVDIMPGTNDPSDKSLPQQPFHKSLFDKSLESYFNGSNKEILNLVTNPYEFSYNGVDVLAVSGKNINDICKYVIPSNDNGESENKVEEGESNDFKDDIEHRLDLMECTMKWQNIAPTAPDTLWCYPYTDKDPFVLDKWPHVYIVANQPYFGTRVVEIGGKNIKIISVPEFSSTGMIILLDLETLEAETVKIDI

SEQ ID NO: 17918 - protein, 572 aa, Xylella fastidiosa Dixon
MHHDTSLIDIIAVGLSLAFVLGALAQRLKLSTLVGYLVAGICVGPFTPGFVADQQIANQLSELGVMLLMFGVGLHFSLEDLLEVKAIAIPGALVQIAAATLLGWGLAWTMGWPMVQGVVFGLALSVASTVVLLRALEERRLIDTQRGRIAVGWLIVEDLVMVLALVLLPALAQMLNGNESVAGHTQNADSDSNAMLTALGWTLLKMTGFVAVMLVVGRRVIPWSLEKVAATGSRELFTLAVLGIALGVAFGSAKLFGVSFALGAFFAGMVLKGSETSHAAATDSLPLRDAFAVLFFVAVGMLFNPAILIEHPFQVLATFLTITIGKSAAAFLIVRAFGHPTSTALTISTSLAQIGEFSFILAGLGIQLAILPETGRDLILAGALLSIIANPFLFTWLDRWQAQQTAEETTLVEPELPPGPSPDLYNHAIVIGYGRVGSMLAQLLQSRHVPLLVIDDNSEHVLKAHAAGIPAIRGSAAADLVLAEAHPERAKIAVLAIPQPLEAGEILAKLRALNPELTLVARAQNDAEVKHLLGHGADATVVAEHEMAHSLAEMVLSSTNHPNSTRLQPAIA

SEQ ID NO: 17919 - protein, 332 aa, Saccharomyces cerevisiae
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 17920 - protein, 406 aa, Nicotiana tabacum
MLEAPKFVELIDLNQNLSQNFYHKLGEGSNMSTESYGSLQMSSGGGSVAMSMDNSSVGSNDSHTRILNHQSLNRVHNNYSVAASVNRVRVSNGLSNDALAQALIDPRFPTIGLENYDEWTIDLRKLNMGPAFAQGAFGKLYKGTYNGEDVAIKLLERPEHDLERAHLMEQQFQQEVMMLANLKHPNIVRFIGACRKPMVWCIVTEYAKGGSVRQFLTRRHNRSVPLKLAVKQALDVARGMEYVHALNLIHRDLKSDNLLIAADKSIKIADFGVARIEVQTEGMTPETGTYRWMAPEMIQHRPYTQKVDVYSFGIVLWELITGMLPFQNMTAVQAAFAVVNKGVRPTIPNDCLPVLSEIMTRCWDADPDNRPPFSQVVRMLEAAETEIMTTVRKARFRCCIQPMTTD

SEQ ID NO: 17921 - protein, 248 aa, Oceanospirillum sp. MED92
MLMNTATSLTLIDKKYLSPRSLELSYQSDKPLKYLAGQFYSLRFPCGDGFKSRSYSVVNNKRADQNEEFTLSFVITLVEGGAASEYFRSAKPGSEIEASGPFGNLVLPRSNPKRFILIATGAGVAPYRSMLDELTNRLHAEPELKTELILGVRNREELLYGEEFKALSAREERFGFNAVFSRENNNLAEGEFSGHVTELYTLLEASPNDDMIYLCGHPQMIDDSVSFFENLGFSAANLKREKYLFSAI

SEQ ID NO: 17922 - protein, 325 aa, Sinorhizobium arboris
IAGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDCSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGTNPKAKRVEVRFPDPTANPYLAFAAMLMAGL

SEQ ID NO: 17923 - protein, 168 aa, Arabidopsis thaliana
MEMGLVFLTVFMAVMSSTMVSAQSSCTNALISMSPCLNYITGNSTSPNQQCCNQLSRVVQSSPDCLCQVLNGGGSQLGINVNQTQALGLPRACNVQTPPVSRCNTGGGGGGSTSDSPAESPNSSGPGNGSKTVPVGEGDGPPSSDGSSIKFSFPLIAFFSAVSYMAIF

SEQ ID NO: 17924 - protein, 374 aa, Zea mays
PTRTPPHHWSTNLSCTVLSAAAQPHRNSTPPHPHSNSHLMEKAAHVAAGATQEQESSPNRLDDAARHHGSAEAIPERLAVVTGGNKGVGLEVCRQLALKGVTVILTARDEKRGKDAADTLRRECQLPNIIFHQLDVRDDDSATTLARYVERRYGKLDILVNNAAISGIVADEEGLKALNIDAETWTSGRAANLLKEVFQNTNDEAFNCLNTNYYGCKRVTEALLPLLKLSTSGGARIVNASSLASELKRMPNEKLRNDLSNIDIWDEDRIEAVLDTFLEDLRSGRLEEAGWPVMLPAYSVSKMVINLYTRIMARRYPEMRINCVRPGFVKTDINWNLGVLTPEQGARGPVMLALLPDDGPTGCYFDQTEMVNVW

SEQ ID NO: 17925 - protein, 325 aa, Sinorhizobium meliloti
IGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFPDPTANPYLAFAAMLMAGL

SEQ ID NO: 17926 - protein, 232 aa, Pyrus communis
MGITRMIYMVTMAFSLIVLILSSSTMGYDYFQFTQQYQPAACNSNPTPCKDPTEKLFTVHGLWPSNSNGPDPVNCKPKTKVPQAQQPIDPSLKPQLEIIWPNVFNRADNESFWNKQWDKHGTCGYPTIKDKNHYLQTVIKMYITQKQNVSQILSKANINPDGIGRTRKLIENAIRNGTNDKEPKLKCQKNNGTIELVEVSLCSNYLGKHFINCPNKIPQGSRYFCPIKDIQY

SEQ ID NO: 17927 - protein, 182 aa, Triticum aestivum
MAARARAVAAMSSSSSVLLAAAVALALLVASASAQSGCTSVLIGLYPCMNYISGSGTAPTKSCCSQLASVVQSQPQCLCSALGGDSPSLGGVTINKTRALELPNACNVQTPPASKCNGAGGGSAPGASANTPTTPAVQTPAGLGSKTTPSAYLQGSGGSSLHGPAGLVFALAVAAVYAVSAV

SEQ ID NO: 17928 - protein, 435 aa, Raphanus sativus
MKGVRKTYNNSYTLSFLLVFFMLILFRPAFSINTLSATESLTISNNRTLVSPGNVFELGFFRTTSNSRWYLGIWYKKLSERTYVWVANRDNPLSNSIGTLKISGNNLVLQGHSNISVWSTNRTRGNERSPVVAELLANGNFAMRDSNNNDANQFLWQSFDYPTDTLLPGMKLGYDLKTGLNRFLTSWRSSDDPSSGDYSYKLENRRLPEFYLWSEEFRVHRSGPWNGIRFSGIPEDQKLSYMVYNFTENSEEVAYTFLMTNNSFYSRLTLNSEGYLERLTWAPSSVVWNVFWSSPNHQCDMYRVCGPYSYCDVNTSPVCNCIQGFRPKNRLQWDLRIPLSGCIRRTRLSCSGDGFTRIKNMKLPETTMAIVDRSIGVKECEKRCVSECNCTAFANADIPNGGTGCVIWTGRLDDMRNYDADGQDLYVRLAAADLV

SEQ ID NO: 17929 - protein, 226 aa, Pyrus communis
MGTGMIYMVMMVFSLIVLILSSSTVGFDYYQFTQQYQPAVCNSNPTPCKDPPDKLFTVHGLWPSDSNGNDPKYCKAPPYQTMKILEPHLVIIWPNVLNRNDHEVFWRKQWDKHGSCASSPIQNQTHYFDTVIKMYTTQKQNVSEILSKANIKPGRKSRRLVDIENAIRKVINNMTPKFKCQKNPRTSLTELVEVGLCSDSNLTQFINCPHPFPQGSRYFCPTNIQY

SEQ ID NO: 17930 - protein, 502 aa, Oryza sativa
MAHSLPLDVWGWITNLPPFSQWRSNAMSLCICPTPSASESSQPSVNLSVVKTPPTQPSFVTFSIFANYRVPISLWTSKPVHLKSYTQQSLDEQEMLELFVDIVDWVLRSGPNKKLSFQFPRAQIHGNLKDVFNIVFLSLAFLVCIYEAPHALRCRCLESLRTQLTGPKCKDAAKTFVRMLGANLEEQWMQTMNLAVTNWIVEQRSSHHSFGVPSPLFSYALSASGLWKVQLYCPLIAMSMEDPAVPTQDERLLFSLTYQQLEGVIQLAYKTIRRDNWIDVEIKVDNIRCDVDSLVSEILMTERGHGSEEKHFPSRVMLQITPMQQSDVLSVSVSKSSDNPTHEFGLEKGIEGSFDPPNTFGLKASVSESLTLTMKPWKFEQSVHGNTTTLNWFLHDGVNGREVYSSKPSKLSLLQPRAWFRDRYSTVYRPFTKKGGVIFARDEYGDSVWWKICGAALGKTMDWEIRGWIWLTYWPNKQKTFHSETRRLEFRECLQLPLMKSP

SEQ ID NO: 17931 - protein, 303 aa, Lycopersicon peruvianum
TNSINDALSSSYLVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 17932 - protein, 295 aa, Solibacter usitatus Ellin6076
MRKLIALVACMAFAAPAGQIYSLAWGPVIAVGGYKETRLRDGATLKGNAEAVRAVAFSRDGKLLAAAGGLPARKGEVLVWDMASQKVKVTISGHSDCIYAVAFSPDGATLATAGYDKLIKLWDASSGKELRTLRDHIDAIYALAFTPDGKRIVTGSADRAVKVWDAASGERLFTLSESTDAVNTLALSPDGKRVAAGGLDKTIRIWSLGEKEGTLLHTLIAHEDAILRLAWSADGQWLASASADRSIKIFRAADLTELRAITKLPDWAFGLEFAPDGNSLAAGFFNGQLEIYSRQ

SEQ ID NO: 17933 - protein, 228 aa, Pyrus communis
MGITGIIYMVTMVFLLIVLILPSPTVGYDYFQFTQQYQLAVCHFNPTPCKDPPDKLFTVHGLWPSNSTGNDPMYCKNTTLNSTKIANLTAQLEIIWPNVLDRTDHITFWNKQWNKHGSCGRPAIQNDMHYLQTVIKMYITQKQNVSEILSKAKIEPVGRFWTQKEIEKAIRKGTNNKEPKLKCQRNTQGTELVEVTICSDRNLKQFIDCPRPILNGSRYYCPTNNILY

SEQ ID NO: 17934 - protein, 303 aa, Lycopersicon peruvianum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLLEVLCARSAIVQSLPREMVNLAEWAVESHNNGQLEQIVDPNIADKIRPESLRKFGETAVKCLALSSEDRPSMGDVLWKLEYA

SEQ ID NO: 17935 - protein, 227 aa, Pyrus communis
MGITGMIYMVTMVFSLLVSILSSSTVGFDYFQFTQQYQPAACNSNPTPCKDPTDKLFTVHGLWPSNKIGGDPEYCKIRNPRKRAKKLEPQLEIIWPNVLDRTNHTGFWSRQWKKHGACGYPTIQNENDYFETVIKMYITEKQNVSRILSNAKIEPDGKSRALVDIENAIRNGTNNKLPKLKCQKKTRVTELVEITLCSDKNRAHFIDCPNPFLPGSPYLCPNNSIHY

SEQ ID NO: 17936 - protein, 284 aa, Aspergillus nidulans FGSC A4
MATSTKQTYPVLPKNLLLISLKMYFEPSRTLEYCRALLDPKNDIVRPENRSKLLLALIPDFLTIYPCAEIIKEYVSTLPKDDSPSLPAPFLLGAQDCFWEPLGAYTGEVSPLSLSSLGVSIVELAHAERRSIFGETDEQAARKAAAACAQGMVPLVCIGEISAPGPVASAAVGLAVRECEPLVRAILNAIPADAPIIFAYEPVWAIGKPKPASVDHISAVVDGLRALIGRRSGDVRILYGGSAGPGLWGPGGLGKAVDGMFLGRFAHDIEGVRKVVREVEESLT

SEQ ID NO: 17937 - protein, 494 aa, Synechococcus sp. CC9605
MVVSAGIFSRDMGQFDLNRRTKIVATIGPATESPERIKELVKAGATTFRLNFSHGDHSEHAARIATIRQVSEELGQTIGILQDLQGPKIRLGRFAEGPITLANGDPFTLTSRPVSCDKTIATVTYDKLADEVTAGSRILLDDGRVEMKVDTVDKAEQTLHCTVTVGGVLSNNKGVNFPDVQLSVRALTDKDKTDLAFGLSQGVDWVALSFVRNPSDMEEIRGLICEQGHETPVVAKIEKFEAIDQIDSILPLCDGVMVARGDLGVEMPAEEVPLLQKELIRKANSLGIPIITATQMLDSMASSPRPTRAEVSDVANAILDGTDAVMLSNETAVGDFPVEAVQTMATIARRIEKDYPQRSIDSHLPSTIPNALSGAVSTIASQLNASAILPLTRSGATARNVSKFRPAAPILAITPDRTVACRLQLVWGVTPLVIPEGERTTQTFQAAMLKAKELNLLKESDLVVQSAGTHAGVSGSTDLVKVSIVGNEAEATLI

SEQ ID NO: 17938 - protein, 228 aa, Pyrus communis
MGITGMIYMVTMVFSLIVLILSSSAVKFDYFQFTQQYQPAVCNSNPTPCKDPPDKLFTVHGLWPSNVNGSDPKKCKATILNPQTITDLKAQLEIIWPNVLNRKAHVRFWRKQWRKHGACGYPTIADDMHYFSTVIEMYITKKQNVSEILSKANIKPEGRFRTRDDIVNAISPSIDYKKPKLKCKINNQTTELVEVGLCSDNNLTQFINCPNPFPQGSPYFCPTNNIQY

SEQ ID NO: 17939 - protein, 342 aa, Zea mays
MAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANIIIQRPGCTYPEKPDFN

SEQ ID NO: 17940 - protein, 323 aa, Triticum aestivum
MSGGHGDAGMASGKMAKLKELLQKSENRICADCSAPDPNWASANIGVFICVKCSGVHRSVGTHISKVMSVTLDKWSDDEIDSMVEVGGNSQANAIYEAFLPEGYRKPHPDSAQEERQKFIKSKYELQEFLEPSLRIVSNHPSDAGKQASNSHSASSKSEIGMVEFIGILNVKVIGGTKLAIRDMSSSDPYVVLTLGQQKAQTSVIKGNLNPVWNEELKLSVPQKYGPLKLQVLDHDMVSKDDLMGEAEIDLQPMINAAASFGDPELLGDIQIGRWLKSGDNALTADSAVMVTGGKVKQEVTLKLQHTESGEVTVEMEWMALNI

SEQ ID NO: 17941 - protein, 720 aa, Zea mays
  misc_feature (28)..(28): Xaa can be any naturally occurring amino acid
  unsure (1)..(720): unsure at all Xaa locations
GRGDERRRRGGGVLRVAGRRALLLLLLXSDDDDDDSDHPRRRRRDGAASTAAAAALDVWTSEPAPVQERRRKLLQMLGLAGDPALARLEMGRSVSYDDGPVPVRPAPASPPISRSRSDGGAVPASATKPPLGGRSPGSSEATPEGEEEEEEEADPRCLIRNLDDGSEFVVKEGSELREVGTGRQLTMEEFVDLCVGRSPIVQELMRRRENVASSGSSTPVQRSNSDSSNGATRHRRRRRHSSWLRGIRNVAGSVVASSRDRRSSDDKDTCSEKGGRRSSSATDDSQDSAGAVRHGPVRVKVRQYGKSYKELSGLFMNQEIQAHDGSIWSIRFSPDGRYLASAGEDCVIHVWEVSEFERKREENGACNPFVAMVCNGSPEPTLAVASSVDGSNREKKRRARFLEGRRSVSSDRLMLPEHVFALSEKPIRTFMGHSEDVLDLCWSKSQYLLSSSMDKTVKLWHISSTSCLKTFSHSDYDNKLLQKKQIDLQNKKKKSSQKKITGFQFLPGSTSRVLITSADSRIRVFDGLNLVHKYKGFRNTNSQISACLAANGRYVISASEDSHVYIWRNDGSLEKGRSKANVTVTSSYEHFHCQDVTVAVAPPSNGSAVVSRSNSTKHDERDSVLEHPLLHAVPEKLQDSSDLQPQSGNILSTSSNHSGDRATWPEELMTPTKQSPQSSASLLSGADQAPCWSAWGTVIVTAGRGGQIRAFQNFGFPARV

SEQ ID NO: 17942 - protein, 447 aa, Parvularcula bermudensis HTCC2503
MSEDDYKQGSLTLAGTVAMGTGVMIGAGIFALTGQVAEFAGDLFPLAFLTAAIISGFSAYSYIKVSNKYPSAGGIAMILQRAYGPSTVTGSAALLMAFSMIINESLVARTFGTYTLQLFGVEGGIFVPLLAIGLIILAFVINIAGNQVIGGVSKVTAILKIGGILIFALIAIWAAGFSFQPAADGFADSASAGGFLAGVALAILAYKGFTTITNSGDEVKQPTRNVGRAIMISLAICTFIYLLVCFAVGSTLTVSEIVAAKDYALAEAARPALGNYGLWFTVTIAIIATASGLLASLFAVSRMLAMLTDMNLIPHRHFGMPGTVQRHTLVYTVVAAGLLAAFFDLSRIASLGAIFYLVMDIIIHWGVFRHLRKDVGAAPAILICAIALDAVVLIAFLLLKWQADPVIILIAAFGMVVVFSFEHFFLKRLRDNPPGEESGNDQHKAHS

SEQ ID NO: 17943 - protein, 327 aa, Zea mays
MSSSSPSLLSSRLLSPAILFTKKPASLRSISSATARHGVRVVVAAASAAAASPVSAARVRPSAAEVARTVVELAASGTLSMVGPDGWPLGVGAHFVADSAGAPALCLSAARVAAPDAPASFHVEFRQSGARTPQCTMLGALTKPSDESVLKKLSTRWQKKFGEEIDQDLLYLISVDRILHMEDFNEAGHSTYNYLVIMSGLLMDGMWVVPSDYTSAEPDPLRNFAENIVEEFNNKNAEDVRRIYNIYVESDLQVADVKMIWVDRLGFDLHAHSAEGVLAVRVPFPREVSDEKGVKSSFNMMSHHAWEVEKSYASPEFEKVQFLKKVR

SEQ ID NO: 17944 - protein, 157 aa, Magnetospirillum magnetotacticum MS-1
MAEASRENILPVILCGGSGTRLWPASRESMPKQFTPLVDPETSTFQATVRRVADGSVFARPTVIASAESRFIVAEQLAQARIAADILLEPERRDSAAAVAVAALHGARLGPETVVLVMAADHVIEDSAAFTQAAQQAAIGARLGQIMTLGITPTRAA

SEQ ID NO: 17945 - protein, 480 aa, Saccharophagus degradans 2-40
MFRRTKIVSTLGPATDEPGILEKLILAGVNVVRLNFSHGSPEDHKRRADEVRSLAAKHGKFVAVLGDLQGPKIRIARFADGPISLAVGDKFLLDASLERDAGNQHQVGIDYKELPNDVNPGDSLLLDDGRVVLKVLSVEGTKVHTEVTVAGKLSNNKGINRQGGGLTAPALTDKDRADIKTAVAIDVDYLAVSFPRSAEDMNLARQLVVEAGGNIHLVAKIERAESVENQEVLDDLIRASDAVMVARGDLGVEIGDAALIGMQKLIIERARALNRCVITATQMMESMISSPLPTRAEVFDVANAVLDGTDAVMLSAETAAGQFPVQTVEAMVRVILGAEKHPRAETRPVRADGDYSAIDESIALAAMYTAHQLKGVKCIASMTESGSTPMLMSRFGARLPIFAFSRDIRTLRRAALFRGVQTILFDNNAIPPGEMYDRALEIMREQKIIEDGDLVILSKGDTSEHGGTNTMKILQVGSTN

SEQ ID NO: 17946 - protein, 241 aa, Trichodesmium erythraeum IMS101
MRKTIIAGNWKMYKTQLEAKEFLEGLMSQLTKTPEEREVVLCTPFTALDFMSKILHGSLIRLGAQNVHWEDEGAYTGEISGLMLKDVGVSYVIVGHSERRQYFGETDETVNMRLKAAQKHGLTPILCVGETKQQRDSGETESHIFSQLANDLVDVDQENLVIAYEPIWAIGTGDTCEAKEANRVIGLIRGKLNNSNVTIQYGGSVKPNNVDDIMAQEEIDGALVGGASLNPESFSRLVNYQ

SEQ ID NO: 17947 - protein, 447 aa, Pseudomonas syringae pv. syringae B728a
MTGNDPHSQKEMLMGIDEVECVTPDLNGVPRGKVMTAEGFLEGRRLQLARGVLLQCIMGGYPPARFYGSDDGDLALISDPQQLHRLPWSTSPRALAICDAQDLDGQPCMLSTRNQLKAVIARYVAQGLVPVVATELEFFVFAPNPEPLYPFEPPTGLDGRREQGHSAFSVSSNNGLRTFFAEVYACMAALGLPRDTVMHEMGVSQFEINLLHGDPLLLADQTFLFKHLLKEVALKHGLIVVCMAKPLAHTAGSSMHIHQSVVAAEGAVNVFSDAQGEPSDTFGHFIAGQQACMADFTALFAPNVNSYQRLCHPYASPNNACWSYDNRAAGLRIPSSAAAARRVENRLPGADANPYLAIAASLAAGLHGIEQRLEPTPPLQGELEVPEELLLPCTLHAALERLKSSQLAKELFGHEFIEGYIASKALELTSFFDEITPWERRVLAAQV

SEQ ID NO: 17948 - protein, 232 aa, Triticum aestivum
  misc_feature (49)..(49): Xaa can be any naturally occurring amino acid
  misc_feature (197)..(197): Xaa can be any naturally occurring amino acid
  misc_feature (225)..(225): Xaa can be any naturally occurring amino acid
  unsure (1)..(232): unsure at all Xaa locations
NKFVQKSRLVPVRNSRDIVDPRVRGFNYIKESFDKGTLHLIGLLSDGGXHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRXADRMVMLAKALEFPDFDKFDRVRVPKIXYAGDASI

SEQ ID NO: 17949 - protein, 268 aa, Prunus persica
RATMIMRLKAKIQALEEQMSSVSEKSSKYGQIAAEEVPKSLYCLGIQLTGEWFRNSDLQRKTKDRKQIDMKLKDNNLYHFCVFSDNILATSVVVNSTSINSKSPDKIVFHLVTDEINYAAMKAWFSINSFRGVVIEVQKFADFTWLNASYVPVLKQLQDSETQSYYFSGNNDDGRTPIKFRNPKYLPMLNHLRFYIPEVFPALKKEVFLDDDVVVQKDVSDLFSIDLNGNVNGAVETCMETFHRYHKYLNYSHPLIRAHFDPDACGCA

SEQ ID NO: 17950 - protein, 363 aa, Candidatus Kuenenia stuttgartiensis
MIASRMSNIDSSGIRKVFDLAQKMKSPVNLSIGQPDFDVPGEIKEVAIKSINEGANKYTLTQGIPELRNVLMDRLKKDREVTTEDIMVTSGVSGALTLAIMTLVDQEDEVIIPDPAFVIYKHMVNFCSGKSVFVDTYPDFKLSAERIEPHITKKTKIIVINSPANPTGVMNTPQELKDIAELAKKHDLLVISDEIYHDYDYNNEFESIGKYYNKTLILDGFSKSFAMTGWRLGYAAGPETIIKEMIKLQQYTFVCAPSFSQYAVFRSWGFDLSKYIADYRKKRDMMYEGLKDKFRIIKPEGAFYFFPQVPWGTDEEFVMAAIKNNLLIIPGSVFSERHTHFRISYAATEETIEKGIKILNGLA

SEQ ID NO: 17951 - protein, 435 aa, Raphanus sativus
MKGVRKTYDNSYTLSFLFVFYVLILLRPAFSINTLSSTESLTISSNRTLVSPGNVFELGFFRTTSSSRWYLGIWYKKLSERTYVWVANRDNPLSNSIGTLKISGNNLVLLGHSNKSVWSTNLTRGSERSTVVAELLANGNFVMRDSNNNDASEFLWQSFDFPTDTLLPEMKLGYDLKTGLNRFLTSWRSSDDPSSGDYSYKLDTQRGLPEFYLLQGDAREHRSGPWNGIGFNGIPEDQKWSYMYNFTENSEEVAYTFLMTNNSFYSRLTLSPSGYFQRLTLNPSTVDWNVFWSSPNHQCDMYRMCGPYSYCDVNTSPSCNCIQGFNPENVQQWALRISISGCIRRTRLSCSGDGFTRMKNMKLPETAMAVVDRSIGVKECKKRCLSNCNCTAFANADIRNGGTGCVIWTGRLDDMRNYVTDGQDLYVRLAAADLV

SEQ ID NO: 17952 - protein, 227 aa, Triticum aestivum
MDHAAEAQRTDLMTIDCGVSIGTIFGIYMIKDKDNATLEDVLQPGTDMIAAGYCMYGSSCTLVLSTGNGVNGFTLDPSLGEFILTHPNIKIPNKGKIYSVNEGNARNWDAPTAKYVERCKFPQDGSSPKSLRYIGSMVADVHRTLLYGGIFLYPADKKSPNGKLRVLYEVFPMSFLMEQAGGQSFTGKQRALEIVPAEIHQRSPIFLGSYDDVEEIKSLYASESSTA

SEQ ID NO: 17953 - protein, 105 aa, Glycine max
  misc_feature (86)..(86): Xaa can be any naturally occurring amino acid
  unsure (1)..(105): unsure at all Xaa locations
MAPRTMSSSSSILLAAAVAALLVASASAQSGCTAALVGLYPCLNYISGNDTAPTKSCCSQLSSVVQSQPQCLCSALGGDSSSLGGXTINKTRALELPKACNVQTP

SEQ ID NO: 17954 - protein, 425 aa, Mycobacterium tuberculosis CDC1551
MTRLDSVERAVADIAAGKAVIVIDDEDRENEGDLIFAAEKATPEMVAFMVRYTSGYLCVPLDGAICDRLGLLPMYAVNQDKHGTAYTVTVDARNGIGTGISASDRATTMRLLADPTSVADDFTRPGHVVPLRAKDGGVLRRPGHTEAAVDLARMAGLQPAGAICEIVSQKDEGSMAHTDELRVFADEHGLALITIADLIEWRRKHEKHIERVAEARIPTRHGEFRAIGYTSIYEDVEHVALVRGEIAGPNADGDDVLVRVHSECLTGDVFGSRRCDCGPQLDAALAMVAREGRGVVLYMRGHEGRGIGLMHKLQAYQLQDAGADTVDANLKLGLPADARDYGIGAQILVDLGVRSMRLLTNNPAKRVGLDGYGLHIIERVPLPVRANAENIRYLMTKRDKLGHDLAGLDDFHESVHLPGEFGGAL

SEQ ID NO: 17955 - protein, 325 aa, Sinorhizobium medicae
IGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFPDPTANPYLAFAAMLMAGL

SEQ ID NO: 17956 - protein, 436 aa, Raphanus sativus
MKGVRKTYDNSYTLSFSLVFFVFILFRPAFSINTLSSTESLTISSNRTLVSPGDVFELGFFTPGSSSRWYLGIWYKKLSDRTYVWVANRDNPLPNSIGTLKISNMNFVLLGDSNKSVWSTNLIRGNERSPVVAELLANGNFVMRDTNNNDASGFLWQSFDFPTDTLLPEMKLGYDLKTGLNRFLTSWRSSDDPSSGEFSYKLELLKIPEFYLSSGYFPVHRVGPWNGIRFSGIPEDQKLSYMVYNFTENSEEVAYTFLMTNNSIYSRLTISSSGYFERLTWTPSSGMWNVFWSSPVDLQCDVYKICGPYSYCDVNTSPVCNCIQGFDPWNVQQWDLRAWSGGCIRRTRLSCSRDGFTRIKNMKLPETTMATVNRSIGVKECEKRCLSDCNCTAFANADIRNGGTGCVIWTGRLNDMRNYAADGQDLYVRLAAADLV

SEQ ID NO: 17957 - protein, 386 aa, Ralstonia eutropha JMP134
MEQLLVDSVVFLAAALIAVPLSVRAGFGSVLGYLIAGVVIGPWVLRLVTDVDSILDISELGIVLMMFIIGIEMDLKKLWAMRRAIFGYGGIQVALCAALLAAIFTIFGAPWRVGVAAGFALSLSSTAMVIAILEQNREMDTPVGQTCFGILLFQDIAAIPMIALLPLLAPAPIEDNDPSGWLMTARALAMLAAVVFGGRFILQHALRIIQRSGTREIFTIFALLWVIGIALLMHVVHLSMSLGAFVAGMLLAGSESRHEIEADMAPFKGILLGLFFIAVGMSIDFRVLAERPWLVAILVVVLVGGKLLALMFLASKINLPREQRIYFAILLSQGGEFAFVVTAAAQAARLLDNEQLSIVTVVVALSMATTPLLLLAFRKLMAVQPA

SEQ ID NO: 17958 - protein, 441 aa, Raphanus sativus
MKGVRKTYDNSYTLSFLRVFFILILHRPAFSIHTLSSPESLTISSNRTLVSSGNVFELGFFTIGFFTTGSSSRWYLGIWYKKVSGRTYVWVANRDNPLSSSIGTLRFSNMNLVLLDQSNKSVWWANLTRGNERSPVVAELLANGNFVIRDCSNNDASGFLWQSFDYPTDTLLPEMKLGYDLKKGLNRFLTSWRNSDDPSSGNISYKLDTQRGMPEFFLLKDGLRAHRSGPWNGVQFSGIPEDQKLSYMVYNFTENSEEVAYTFRMTNSSIYSRLKISSEGFLERWTTPTSIPWNLFWSAPVDLKCDVYKTCGPYSYCDLNTSPLCNCIQGFMPSNVQQWDLRDPSAGCIRRTRLSCSGDGFTRMKNMKLPETRMAIVDRSIGVKECEKRCLSDCNCTAFANADIRNGGTGCVIWTGELEDIRTYLADGQDLYVRLAAADLV

SEQ ID NO: 17959 - protein, 432 aa, Zea mays
MASGGNPNPTGAPSQPRPMHQQQQQPQTGGSPATPMTHLRPPSLAGSPFQGLFHTPPTHNPAFQIHMGASSSPQTPLMAATAGSAKRPPQKPPVRPLAPGSTSSAAAASAAAAYKAAAAAAAVANSGGVDLTPAARRSKKRKLPEKQLPDRVAALLPESALYTQLLEFEARVDAALARKKVDIQEALKTPPSLQRTLRIYVFNTFANQGPRTIPPPKNADPPTWSLKIIGRVLEDGAELDPSSVVPKHNPVYPKFSQFFKRVTIALDPSLYPENPLIIWENARTAAQQEGFEVKRKGDKEFVANIRLEMNYNPEKFKLSQPLMEVLGVEVDTRARVIAALWQYIKAKKLQNPNDPSFFMCDPQLKKVFGEDKLKFAMLSQRISGVESAREGERREDRREPRRARRAPGRESSRAPEKTTQTGRGSVLRNGLP

SEQ ID NO: 17960 - protein, 249 aa, Legionella pneumophila subsp. pneumophila str. Philadelphia 1
MRQKIVAGNWKMNGQIQQVTELVSQIEELIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 17961 - protein, 303 aa, Lycopersicon peruvianum
TNSINDALSSSYLVPFESYRVPLVDLEEATNNFDHKFLIGHGVFGKVYKGVLRDGAKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSSNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 17962 - protein, 325 aa, Sinorhizobium saheli
IAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFPDPSANPYLAFAAMLMAGL

SEQ ID NO: 17963 - protein, 303 aa, Lycopersicon peruvianum
TNSINDALSSSYLVPFESYRVPLVDLEEATNNFDHKFLIGHGLFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLLEVLCARSAIVQSLPREMVNLAEWAVESHNNGQLEQIVDPNIADKIRPESLRKFGETAVKCLALSSEDRPSMGDVLWKLEYA

SEQ ID NO: 17964 - protein, 303 aa, Lycopersicon peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWRLEYA

SEQ ID NO: 17965 - protein, 363 aa, Neisseria meningitidis MC58
MSHISPIPEILADIKAGKMVIITDAEDRENEGDLLMAAQFVTPEAINFMIKHARGLVCLPMDGEMVEKLGLPMMTQKNGAQYGTNFTVSIEAAHGITTGISAADRALTIQTAVSPTAKPEDIVQPGHIFPLRAQKGGVLVRAGHTEAGVDLAQMNGLIPASVICEIINDDGTMARMPELMKFAEEHKLKIGTIADLIEYRSRTESLLEDMGNAPVQTPWGEFQQHVYVDKLSGETHLALVKGTPAADTETLVRVHEPFSVMDFIQANPRHSWSLPKALEHIQQAESGVVILLHRTEDGASLLDRTLPKGANQAYKWDSKSYGIGAQILAGLNVKKLRVLGQPSSFTGLTGFGLEVVGFEEAEK

SEQ ID NO: 17966 - protein, 303 aa, Lycopersicon peruvianum
TNSINDALSSSYLVPFESYRVPLVDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLLFMSWEQRLEICIGAARGLHYLHTRAIIHRDVKSINILLDENFVAKITDFGISKKGTELDQTHVSTVVKGTLGYLDPEYFIKGGLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 17967 - protein, 405 aa, Silicibacter pomeroyi DSS-3
MMDGGKGFEDALTGEQKIRNFNINFGPQHPAAHGVLRMVLELDGEIVERCDPHIGLLHRGTEKLMESRTYLQNLPYFDRLDYVAPMNQEHAWCLAIEKLTGVEVPRRASLIRVLYSEIGRILNHLLNVTTQAMDVGALTPPLWGFEEREKLMVFYERACGARLHAAYFRPGGVHQDLPDALLDDIEAWSHTFPNVLDDIDGLLTENRIFKQRNCDIGVVSEEEILQYGFSGVMVRGSGLAWDLRRAQPYECYDEFEFQVPVGKNGDCYDRYLCRMEEMRQSISIIRQAIAKLRDCPGDVLARGKLTPPKRGDMKTSMESLIHHFKLYTEGFHVPAGEVYAAVEAPKGEFGVYLVADGTNKPYRSKIRAPGYLHLQAMDHVARGHQLADVAAIIGTMDIVFGEIDR

SEQ ID NO: 17968 - protein, 303 aa, Lycopersicon peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSTNILLDENFVTKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 17969 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTMVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 17970 - protein, 491 aa, Zea mays
MEMEKMYIALVLLGRTHESNPRTHHHPRVTCAHRPPAAPQVAITSPPCRLRCLFVSSSFSPPCRGRGLSPSRAEPQSPGAKPRVFPLRARQVPAGALPRPPSKLRFHHNVSLTVSLAVGKPPQNVTMVFDTGSELSWLLCATGRQGSAGAASAMGESFRPRDSATFAAVPCGSAQCSSRDLPAPPSCDGASRQCSVSLSYADGSTSDGALATDVFAVGDAPPLRSAFGCMSTAYDSSPDGVATAGLLGMNRGTLSFVTQASTRRFSYCISDRDDAGVLLLGHSDLPFLPLNYTPLYQPTLPLPYFDRVAYSVQLLGIRVGGKPLPIPASVLAPDHTGAGQTMVDSGTQFTFLLGDAYSAVKAEFLKQTKPLLPALGDPSFAFQEALDTCFRVPKGRPPPSARLPPVTLLFNGAQMSVAGDRLLYKVPGERRGADGVWCLTFGNADMVPLTAYVIGHHHQMNLWVEYDLERGRVGITPVKCDVASERLGLML

SEQ ID NO: 17971 - protein, 484 aa, Oceanospirillum sp. MED92
MIRRDPNSGIDMIIPVIMAGGAGTRLWPLSRKQKPKQFLNLLSPDYSMLQTTYQRISGLKWNKSILVCNEEHRFLAAEQIRKLEMASGTDIILEPEGKNTAPTVALAAHHAQSNVGSADGEPILLVLSADHEINDICGFEKAVSKAITLAKKGKLVTFGTIPSRPETGYGYIKSGAAEDEGFEVVAFEEKPDLKRATEFLNTGGYLWNTGMFMFKASTYLSELQKYAGDIHKACEQAYQKKAHDLDFVRVGASEFINCPSNSIDYAIMEHTKLSSVIPIDVGWSDVGSWKTLWDSSDKDSDNNVILGDVLTTDTQNSYIRAENRLVTTIGVNDLIVIESQDSVLVAPKSASERIKDIVTQLQTNNRHEHISHPLVHRPWGHYYSIFKQDRYQVKHITVKPGAKLSTQMHHHRSEHWIIVSGAAQVTKGEQSFLLAENESTYIPIGTIHALENPGLIPLELIEVQAGPYLGEDDIIRFDDRYGRS

SEQ ID NO: 17972 - protein, 393 aa, Gluconobacter oxydans 621H
MKALTWQKKGKITCESVRDPEIIEGRDVIIKVTACAICGSDLHLMDGLMPTMKCGDILGHETMGEVVEVGKDNKRLSVGDRIVVPFTISCGECRQCKWGNWSCCERTNPNRRQQAETFGYPLAGLFGYSHITGGFSGGQAEYLRVPYADVGPIIVPEGLEDEQVLFLSDIFPTGYQAAENCEITPESEKTIAVWGCGPVGQMAIRSCFLLGAKRVIAIDEVPERLAMARAAGAETIDFRTQNIQETLVEMTDGLGPDAVIEAVGMEAHGADTMMQKVGSALLSATTLERPFALNQAILGCRPGGILSMPGVYAGALGPVMIGILMNKGLTLRTGQTNTQKYLKPLLERIQKGEIDPSFVISHRSSNLEDGPALYEKFRDKKDRCTKVVFRPHG

SEQ ID NO: 17973 - protein, 545 aa, Shewanella sp. MR-7
MEPAILIITLICGMLVSRIGLPPLIGYLVAGFVLFVFGIEKESLPLLQELANLGVTLLLFAIGLKLDIRSLFKAEVWAGSSIHLVLSMVLFIPILKILGLIGLSQLDGLSVAQLSLIAFALSFSSTVFAIKVLEDKGDVQSLYGRVAIGILIMQDIFAVVFLTISKGAVPSVWALALLLLPLAKPLIYKAFDRVGHGELLVLFGLVMALVVGAWLFESVGLKPDLGALIIGIFLAGHKKASELAKSLFYFKELFLVAFFLTIGLNGLPTVSDVVLAALLVLLVPLKILLFVYILTRFKLRSRTSMLASFNLGNFSEFGLIVAAVATSKGWLPPQWLVIIAVALSFSFLFAAPLNATVGNIYQRFQQRLIRLEKPPLHPEDRPIAIGNPRFLILGMGRIGSGAYDELRARFDGEILGIEHKQELVDLHRANGRNVVQGDAADTDFWEKLDKAPNLELVLLAMPHHAGNLFAVEQLKKLNYQGKLSAIVQYGDDAASLRASGVHSVYNLYEAAGAGFVDHVIHELLPDSETRAAVEANAEDTNSRTA

SEQ ID NO: 17974 - protein, 155 aa, Triticum aestivum
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 17975 - protein, 508 aa, Mycoplasma genitalium G37
MIDHLKRTKIIATCGPALTKSLVSLKMLDDNEYAAIKKVAYANIEAIIKSGVSVIRLNFSHGTHEEQQVRIKIVRDVAKAMNIPVSIMLDTNGPEIRIVETKKEGLKITKDSEVIINTMSKMIASDNQFAVSDASGKYNMVNDVNIGQKILVDDGKLTLVVTRVDKQHNQVICVAKNDHTVFTKKRLNLPNAQYSIPFLSEKDLKDIDFGLSQGIDYIAASFVNTVADIKQLRDYLKLKNASGVKIIAKIESNHALNNIDKIIKASDGIMVARGDLGLEIPYYQVPYWQRYMIKACRFFNKRSITATQMLDSLEKNIQPTRAEVTDVYFAVDRGNDATMLSGETASGLYPLNAVAVMQKIDKQSETFFDYQYNVNYYLKNSTANKSRFWHNVVLPLTKKTVPKRKLVNSAFKYDFIVYPTNNINRIYALSNARLAAAVIILTNNKRVYTGHGVDYGIFCYLIDKNPNQLTKAELIELAWKAINHYQAYGDLEKLKQCLAVYNETIINL

SEQ ID NO: 17976 - protein, 457 aa, Legionella pneumophila subsp. pneumophila str. Philadelphia 1
MLNPREIRTIEDAKRIVEERQLTHVKVGLFDIDGVMLGKYMSRNKFFSALEHGFAFCDVILGWDSKDKLYDNVKYTGWHTGYPDASVRIVPSTCREILFEENQLLFMAEFSQAAEAICPRGILRRVINKAAGMGYDVYAALEYEFFVFDETPDSVRAKGFRNLKPVTPDNFGYSIIRNTVHAEFYHQILTMAEKMDFPIEGLHTETGPGVLEAAIAVDDAEAAGDKAALFKTFMKILAQRNNKMATFMAKWSGDYPGQSGHIHLSLRDRDGGKSAFYESGREYNMSKIQRHFLAGQQKLMPEFLAMLSPTVNSYSRLIPGYWAPTEATWGVENRTTALRVIPGSDKSQRIEYRLGSADANPYLALAAAIGSGLYGIENELEPEAEVKGNSYEQHHSPALALPRTLWESAQNLKNSSAAYELFGQEFVEHFAASREWEEREFRKHITDWELDRYFEII

SEQ ID NO: 17977 - protein, 440 aa, Raphanus sativus
MKGVRKTYDNSYTLSFLFVFFVFILFCPAFSINTLSSTESLTISSNRTLVSPGNVFELGFFRTNSSSRWYLGLWYRKLSERTYVWVANRDSPLSSSIGTLKISGNDLVILGHSNRSVWSTNVTRRNERSPVVAELLANGNFVMRDSNNNNASGFLWQSFDYPTDTLLPEMKLGYDLKKGLNKKGLNRFLTSWRSLDDPSRGDYSYKLEPRRLPEFYLFNDDFRVHRSGPWNGVRFSGIPEDKLSYMIYNFFENSEEAAYTFLMTNNSFYSRLKISSSGYLQRLTWTPSSFVWNLFWSSPVNTQCDLYMACGPYSYCDVNTSPMCNCFQGFMPWDKQQWELRKPSGGCIRRTRLSCSGDSFTRMKNMKLPDTTMATVDRSIDVKECEKRCLSDCNCTAFANADIRDGGTGCVIWTGDLEDIRTYHAEGQDLYVRVAAAGLV

SEQ ID NO: 17978 - protein, 178 aa, Pyrus communis
FTQQYQPAACNSNPTPCKDPTDKLFTVHGLWPSNKIGGDPEYCKIRNPRKRAKKLEPQLEIIWPNVLDRTNHTGFWSRQWKKHGACGYPAIQNENDYFETVIKMYITEKQNVSRILSNAKIEPDGKSRALVDIENAVRNGTNNKLPKLKCQKKTRVTELVEITLCSDKNRAHFINCPH

SEQ ID NO: 17979 - protein, 325 aa, Sinorhizobium kostiense
IAGWKAINESDMVLMPDPETAHMDPFFAQSTMVIICDILDPVSGEAYNRDPRGTAKKAEAYLKASGVGDTIFVGPEAEFFVFDDVKYKADPYNTGFKLDSSELPSNDDTDYETGNLGHRPRIKGGYFPVPPVDSVQDMRSEMLTVLTEMGVTVEKHHHEVAAAQHELGVKFDTLVRNADKMQIYKYVVHQVANAYGKTATFMPKPVFGDNGSGMHVHMSIWKDGRPTFAGDEYAGLSETCLYFIGGIIKHAKAINAFTNPSTNSYKRLVPGYEAPVLLAYSARNRSASCRIPFGSNPKAKRVEIRFPDPSANAYLAFAAMLMAGL

SEQ ID NO: 17980 - protein, 180 aa, Pyrus communis
FTQQYQPAVCNSNPTPCNDRPEKLFTVHGLWPSNKKGPDPEKCKNIQMNSQKIGNMAAQLEIIWPNVLNRTDHVGFWEREWLKHGTCGYPTIRDDMHYLKTVIKMYITQKQNVSAILSKAMIQPNGQNRSLVDIENAIRSGTNNTKPKFKCQKNTRTTTELVEVTLCSDRDLTKFINLPP

SEQ ID NO: 17981 - protein, 349 aa, Magnaporthe grisea 70-15
MAKTEKAFTNAEKILMAKAWIYGIRPFFKHGKNFNPTRDIPPQTGKTMLVTGGASGIGAAFVAEIARHSPAQVWIADLRPEAAEKAISAISAECPDVKIDFLQIDLGDAESVKRAASEFLSRTERLDVLLNNAGILPAKGWTTKDGYESMFGVNFVGHARLTELLLPRLMETAAIPGADVRVVSVASGGHGVHPKPDGVRLSSGGALLKEPTCGGMTAMQRYAQSKLAVILWVRRLAREFPAITIVSAHPGTVATSIANDLSGSTRQPPAFFVKLTGTKTPEMGCYNQLWCATAPRDQLVSGKYYCPVGLPDQEFGIARDRKKADELEERLWVWLQKELKGDSFVKVDA

SEQ ID NO: 17982 - protein, 819 aa, Aspergillus fumigatus
MSAEPDHAHDKKRVHLHDASGAEKKEELDTSTAILKKKKKPNSLIVTDAVNDDNSVIALSNNTMETLQLFRGDTVLVKGKKRKDTVLIVLADDDLDDGSARINRVVRHNLRVKHGDIITVHPCPDIKYAKRIAVLPIADTVEGLTGSLFDVYLAPYFREAYRPVKQGDLFTVRGGMRQVEFKVVEVDPPEYGIVAQDTIIHCEGEPIQREDEEGNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILSIHTKNMKLAEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKFQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALVRPGRLDTLVYVPLPDQASRESILRAQLRKTPVAPDVDIPFIASKTHGFSGADLGFVTQRAVKLAIKESIAAEIERQKQREAAGEDIKMDDEGEEEDPVPQLTRAHFEEAMKSARRSVSDVEIRRYEAFAQSLKNSGGSSFFRFPSSGEIQNNDTFGDAGNDDSLYD

SEQ ID NO: 17983 - protein, 185 aa, Aspergillus fumigatus
MRQLTEQELQTLLAKLAGYTGRSLNNLIVPQSDSEDDRHVFRLQGNRVYYVKKSLADLSTSFPRDTLLSLGTCIGKFTKTGKFRIHITALDVIAPHARYKVWIKDNGIMPYLYGSNVVKAHVGRWSEDIPEHTGVLVYDSNDTPLGFGVTARSTAEIRKLDPTAIAVFRQADIGEYLREVRRSIS

SEQ ID NO: 17984 - protein, 303 aa, Lycopersicon peruvianum
TNSINDALSSSYLVPFESYRVPLVDLEEATNNFDHKFLIGHGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHYLHTRAVIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 17985 - protein, 240 aa, Ehrlichia ruminantium
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSESFPKNGKFIIAYEPVWAIGNNKIPSTDVIIEALEIIRSYDYVSDIIYGGAVNHTNVGDIVSINQLSGVLVGSASLDMESFFNIICSAINVRQS

SEQ ID NO: 17986 - protein, 377 aa, Arabidopsis thaliana
MGKSEKTSLGRSLVKHHNHMIQESKDKGKYYKNLQKKVLESVTEVSDIDAIIEQAEEAERLYTINHSSSTPLSINLDTNSSSSVIAAEEWREQQKIEEALHASSLQVPRRPPWTPEMSVEELDANEKQAFLNWRRMLVSLEENEKLVLTPFEKNLDIWRQLWRVLERSDLIVMVVDARDPLFYRCPDLEAYAQEIDEHKKIMLLVNKADLLPTDVREKWAEYFRLNNILFVFWSTIAATATLEGKVLKEQWRQPDNLQKTDDPDIMIYGRDELLSRLQFEAQEIVKVRNSRAASVSSQSWTGEYQRDQAVVGFVGYPNVGKSSTINALVGQKRTGVTSTPGKTKHFQTLIISDELMLCDCPGLVFPSFSSSSYSGGG

SEQ ID NO: 17987 - protein, 305 aa, Lycopersicon peruvianum
TNSINDALSSSYLVPFESYRVPLVDLEEATNNFDDKFFIGGGGFGKVYKGVLRDGTKVALKSCKPESSQGIEEFETEIEILSFCRHPHLVSLIGFCDERNEMILIYKYMENGNLKRHLYGSDLPTMSMSWEQRLEICIGAARGLHYLHTRAVIHRDVKSTNILLDENFVAKITDFGISKKGTELDQTHLSTIVKGTLGYLDPEYFIKGRLTEKSDVYSFGVVLFEVLCARSAIVQSLPREMVNLAEWAVESHNNGQLEQIVDPNLADKIRPESLRKFGETAVKCLALSSEDRPSMGDVLWKLEYA

SEQ ID NO: 17988 - protein, 299 aa, Oryza sativa
  misc_feature (135)..(135): Xaa can be any naturally occurring amino acid
  unsure (1)..(299): unsure at all Xaa locations
MREASGMSGGEDVRKVSRQDIQLVQNLIERCLQLYMNQKEVVETLSFQAKLEPSFTELVWQKLEEENREFFKAYYVRLMLKNQIMVFNKLLEDQYRLMCKEQPSGVPSMPPTTNGSNMGTYTTPSTAMPDSLLPXGSSSGIVNGTPSSDQFIYAGKVIHGLPSSMDASSSLLAAHNSTAGRFNGDNGTTIKTEASYSGNSDFGFCNESAFLEPCQSIGDASGGSFSSSELNGQPLGDPIMDMDSSSFGFLSQIPRNFSFSDLTEDFSQSAEILENYGRSPFIPSEPNNFSESTPGDHAG

SEQ ID NO: 17989 - protein, 303 aa, Lycopersicon peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 17990 - protein, 510 aa, Arabidopsis thaliana
MASSISFLEASVAIFCFLILHYLFKTTTYNGRFPRNWPVLGMLPCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 17991 - protein, 370 aa, Solibacter usitatus Ellin6076
MPDSTFLDSTELVLNMGPQHPSTHGVLRVILKLDGEKVLGTDCIIGYLHRGVEKIAENRTYAQFNPYVDRMDYVAAVSNGLGYCLAIEKLLNVEAPPRAQCIRVILTELNRIASHLLWLGTHALDIGAITPVFYCLREREEALKIFEKYCGARLTTHAFRIGGLLYETYDGFEQEIRDFCKMFIPKVDEYEELLTNNRIWVGRLKDVGILSADECKEFGVTGPVLRAAGVKWDLRKAQPYSGYEKYDFEIPTRVNGDTYDRYIVRMEEMRQSVRIMQQAVDGIPEGPIMGKVGKVIKPPIGEAYVSIEAPKGELGYYAVSDGSTQPYRIRVRPPSFVNLQALDRMIRGGLIADVVAVIGTLDIVLGEIDR

SEQ ID NO: 17992 - protein, 303 aa, Lycopersicon peruvianum
TNSINDALSSSYLVPFESYRVPLVDLEEATNNFDHKFLIGHGLFGKVYKGVLRDGTKVALKRRQPESSQGIEEFETEIATLSFCRHPHLVSLIGFCDERNEMILIYDYMENGNLKSHLYGSDLPSMSWEQRLEICIGAARGLHYLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIIDPNLADKIRPESLRKFGETAVKCLALSSEDRPSMGDVLWKLEYA

SEQ ID NO: 17993 - protein, 73 aa, Glycine max
MNIMSGCSESSTKPNTIINNSPKSKPPFKPAKDDTKPVLQDPILRSDPIETEEAVLRLPPFKIPTSTSTPEMA

SEQ ID NO: 17994 - protein, 404 aa, Shewanella sp. MR-4
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLIPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 17995 - protein, 455 aa, Mesorhizobium sp. BNC1
MSGYSFEDLKADVSAGRIDTVIACQVDMQGRLMGKRFHAQFFIDGGYTETHSCNYLLATDLEMETVPGYKATSWQAGYGDYVMKPDLSTLRRVPWLEATAMVLCDVLDHHSHREVSHSPRAVLKGQIARLEAMGFQAFMATELEFFLFNQSYEEAREQGYRGLRTVGGYNEDYHIFQTTKEEDVMRAIRNGLQGAGIPVENTKGEASAGQGEVNVRYADALTMADRHVIIKNACKEIAWSRGKSITFLAKWNANAAGSSSHIHQSLWSADGKTPMFLDEGAEFGMSSLMRHYVAGLLAHASEITAFLAPYVNSYKRFVAGTFAPTKAVWSRDNRTAGYRLCGEGTKGIRIECRVGGSDLNPYLAMAALIAAGIDGIERELPLEAPFVGDAYGGTQVREIPKTLREATVALDESSLLRSAFGDEVVDHYVRAARWEQEVADKLIADWEIARGFERC

SEQ ID NO: 17996 - protein, 395 aa, Idiomarina loihiensis L2TR
MDYQLSDRINAIQPSPTLAVTQKANELRQQGKDVIGLGVGEPDFDTPDFIKEAAIQAIRDGKTKYTAVDGIDELKDAVIKKLQRDNNLSYERKEIIVSAGGKHSIFNLLSAWLNPGDEVIIPAPYWVSYPDMTKLVGAEPVIVKAGIDQRFKITPEQLREALTDKTRLMFINSPSNPAGTAYTADELKALAEVLRDYPKVLIATDDMYEHILWSDSAFANFPMVAPDLKDRTVILTGVSKAYAMTGWRIGYAAGPKPIIAAMKKMQSQSTSNPTSISQYAAAAALNGDQSCIDTMVSAFKERHDYLVDALNSIDGVNCVPGDGTFYAFAQVDELMAKAKVSSDVELCEKLLTEANVALVPGSAFGTDGYCRLSFATSMDVLKEAVKRIKDFSESL

SEQ ID NO: 17997 - protein, 201 aa, Glycine max
  misc_feature (131)..(131): Xaa can be any naturally occurring amino acid
  misc_feature (199)..(199): Xaa can be any naturally occurring amino acid
  unsure (1)..(201): unsure at all Xaa locations
MVAQKFVVDLNKPLVFQVGHLGEAYDEWVHDPIVSKEGPRFFQNGFLELFTRTAWWVIPTVWVPVASWFISNSVKSGLPSLDVALLVFLGIFVWTLAEYTLHRFLFHVKTKSYWGNTLHYLLHGCHHKHPXMDSYRLGFPPVACSYISPPIWNLVKLICTPSVAPAGFGGILLGFVMYDCTHYYLHHGQPKSDVPQSLXIP

SEQ ID NO: 17998 - protein, 275 aa, Brucella suis 1330
MTVPTVKLNDGNHIPQLGYGVWQISNDEAVSAVSEALKAGYRHIDTATIYGNEKGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 17999 - protein, 681 aa, Aspergillus oryzae
MTSAGPNTTGKRVNVLVYTGIGTTVDSVRHCLYTLRRLLAPHYAVIPVTADMLIKEPWTLTCALLVIPGGADLGYCRALNGPGNRRIEQFVRRGGAYLGFCAGGYYGCKRCEFEVGDKTYEVIGDRELAFFPGICRGCAFPGFVYHSEAGARAAVLKVSKDALNVGIVPESFRSYYNGGGVFVDAPSYADKGVEVLASYAEELNVDSGSGAAAVVYCKVGEGAAVLTGPHPEFAAVNLDKSAGGPEYGKMVDALAADDRARTDFLKACLTKLGLQVTQNTTTVPSLSSLHISSLDPADTSSILSSLQELITTDGEHQYLKDENDTFRIEKPEAWNMESLQEALPDDSKEDSGKAEEGIVDYNAIVKHLVIHEDVPLSKMTPYFNHHAFYSNLRQYQSQMREGAREFGSSIVYGEVITSTNTILEKNPKLLRNLPNGFTATATTQVAGRGRGSNVWVSPAGALMFSTVVRHPMEKMQSAPVVFIQYLAAMAVVQGIKSYDKGFEEMPVKMKWPNDIYALDPENADKKRYTKICGILVNSHYSAGEYTSVVGVGVNATNASPTTSLNALAAHFLGNKTAPITLEKLLARILTTFEELHTRFLRTGFDKTFEDMYYSDWLHMHQVVTLEEEGGAKARIKGITRDYGLLLAEELGWDDRPTGRIWQLQSDSNSFDFLRGLVRRKV

SEQ ID NO: 18000 - protein, 631 aa, Schizosaccharomyces pombe
MNVLIYNGNGASKICLLRTFQSLLPFVVPLYAMRFVDASTLEKEPWPASTALLVMPGGRDMGYCSSFNETIYRKITDFVKRGGAYLGLCAGGYFGSAVVDFRMPDSDLNVVGKRKLQFFPGTCAGPTFPGFTYDSEDGARRASIIVDGMQSSPVHTHIYFNGGGSFLETENYSNVKVVARYQETDFEKSAAIIYVKVGKGNVVLTGIHPEFSAEGSPILDKRDEKTRLELLSYILKLLGLKVPKDTSKCGQPTLTDQYLFPNNVETKRFIEKALTNKVKNQDEDTLYTFQFSDISSEIPEHQLANLDISADLSDSDNEIVKIWYGDEEKICKKAKPSFDLELYAKLINGCRFGLPIIVAPVIRSTQTLLDKNYRFLDSTNTGFTVLGNYQTAGRGRGQNMWVSPYGTLAFSFIINVDAKNFSTTPIALFQYLMALAVVRGIREYAPGYENIPAFIKWPNDVYVRVDKGGINFQGKQYMKLSGIIVTSNYRKNVLHLVVGCGINVSNLGPTVSLNTLVDEWNKNSDNPRLEKFSFEKLLASVLNQFDRYHRLLLEEGFSLILPEYYQYWLHSNQTVNLASGGKAIIQGITSDFGFLLAQLLNENNEPTTKVVHLQPDGNSFDLMRNLITRKT

SEQ ID NO: 18001 - protein, 518 aa, Aspergillus oryzae
MIPLLILAALAVVFRLVWSIFTSLRHAQNARKWHCGAIPTYPGDILGINTLKEVLRADKEKLIPVLSAQRVETMTAREGRYVSTFRLRQMGRESIFTSDPKNMQAILATQFKEFELGSLRRNSLHPLLGSGIFSTDGEAWSRSRSLLRPQFTRDQVSDLDLEERHVQKAMAGMLADPATKWTPEIDIQSIFFRLTIDSATEFLFGDSVESQTAALSGSRIIEDKFPSYFDRGQWYAAQRARFEKLYWIVNNKESRETDRFVHAYVDRFIDAALAAVKEGKIDPEKRNSDHYVFLHGLTTATQDPVELRSQLLNILLAGRDTTASLLSWCVLLLARHPDIFQKLRNTILADFGDYRNPRNITFSSLKSCRYLHYFMNEVLRLYPIVPGNRRVALKDTTLPRGGGPDGSEPVYVRKGQPVVYSVFVTHRRKDIWGADAEVFNPDRWEDLKVGWEYLPFNGGPRICIGQQFALTEAGYVLVRLLQRFDQIVDARPEREIRFNATLTSAPWENVIVRLREGA

SEQ ID NO: 18002 - protein, 676 aa, Oceanospirillum sp. MED92
MKVLMIVQARLGSSRLAGKVLKEVVGQPLLKIMLSRLSKSKCADQIVVATGEEHENASLIEAVKSWGYSIYAGSQHDVLKRFYDCAEQYNPEYVVRLTGDCPLIDVTLVDEVIESILNSDFEYVCNNYPATYPDGLDAEVFTFDALKNAYLNAVDSYDREHVTPYLRKPGFFKTHTLSADKNHSDKRWTLDQIEDLEVIKFVFEALAPDVHFGWKEVLELQCEQPAKFEANCEIQRNEGSTMSSGTKLWRRAKQLIPGGNMLLSKRPEMFLPDGWPTYFSEASGIVVKDLDGNSFTDMALMGVGTNTLGYGHPKVDEAVQRTVRQGNMSSLNCPEEVMLAERMVALHPWADMVRFSRAGGEANSIAIRIARAATGRDKIAVCGYHGWHDWYLSVNLSSDDSLDQHLLPGLDPKGVPKDLEGSVITFMPNDIERLRGIIEGDEIAVVKMEVKRNIEPEDGYLQAVRELCDKHGVVLIFDECTSGFRETFGGLHLKYGVNPDMAVFGKALGNGYPITAVIGTRDVMDAAQSTFISSTFWTERIGPSAALATLEVMEQEQSWLQITDYGCKVRDAWKHLAERYKLDIECFGLPALGGFSLKGEQAVVLKTLISQELLKQGILASNALYPSIAHTEDHLLSYLKHLEAVFSTFSSCIKQGDDPMGLLDGALCHSTFKRLN

SEQ ID NO: 18003 - protein, 514 aa, Shewanella sp. MR-7
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDAAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYDLITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 18004 - protein, 291 aa, Clostridium acetobutylicum ATCC 824
MEKFRTIAITGATSGLGKLVAIELVKRDAHLILTARNKERAEATKKMLESINPKAKIDFFFGDLSVMRDVKRVGEEIKAVHPRIDVLVNNAGLHAFEQRVTSDGLAEMMAVNYLAPWLLTNTLLQSLIASRNARIVNVASEASRNHGELKLPGDLTDISEFTSRESSAIYGKTKLLNIMFTAELARRLSGTGIIVNALNPGFNVTGLGRELWFATALERILKFFHIGDPRKGADIILRLSIDAQYNSVTGGYFNVITGNPISPIYPGGDKVMQNKLWSDTETLLKQRGFIE

SEQ ID NO: 18005 - protein, 324 aa, Hypocrea jecorina
MASPTLKLNSGYDMPQVGFGLWKVDNAVCADTVYNAIKAGYRLFDGACDYGNEKECGEGVARAIKDGLVKREDLFIVSKLWQTFHDEDKVEPITRRQLADWQIDYFDLFLVHFPAALEYVDPSVRYPPGWFYDGKSEVRWSKTTTLQQTWGAMERLVDKGLARSIGVSNYQAQSVYDALIYARIKPATLQIEHHPYLQQPDLVSLAQTEGIVVTAYSSFGPTGFMELDMPRAKSVAPLMDSPVIKALADKHRRTPAQVLLRWATQRGIAVIPKTSRPEVMAQNLDNTSFDLDSEDLAKIADMDLNIRFNKPTNYFSANKLYLFG

SEQ ID NO: 18006 - protein, 469 aa, Vibrio fischeri ES114
MSVENVLALIQENEVKFIDLRFTDTKGKEQHISIPSHQIDADFFEEGKMFDGSSVAGWKGINESDMVMMPDPASAVLDPFTEDSTLNIRCDILEPATLQGYDRDPRSIAKRSEEYMRSTGIADTVLIGPEPEFFLFDDVRFNTDMSGSFFKIDDIEAAWNSGTEYEGGNKGHRPGVKGGYFPVAPVDSSQDIRSAMCLIMEEMGLVVEAHHHEVATAGQNEIATRFNTLTTKADETQIYKYVVHNVAHAFGKTATFMPKPLVGDNGSGMHVHQSLAKDGVNLFAGDKYGGLSELAIYYIGGIIKHARAINAFANPSTNSYKRLVPGFEAPVMLAYSARNRSASIRIPVVPSPKARRIEVRFGDPAANPYLCYSAMLMAGLDGIKNKIHPGEAMDKDLYDLPAEEAAEIPTVAESLDIALKALDEDREFLTAGGVFSDDFIDSYIGLKSQDVEAINTAVHPLEFEMYYSV

SEQ ID NO: 18007 - protein, 325 aa, Sinorhizobium xinjiangense
IAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFPDPTANPYLAFAAMLMAGL

SEQ ID NO: 18008 - protein, 360 aa, Triticum aestivum
  misc_feature (94)..(94): Xaa can be any naturally occurring amino acid
  misc_feature (105)..(105): Xaa can be any naturally occurring amino acid
  misc_feature (122)..(122): Xaa can be any naturally occurring amino acid
  misc_feature (332)..(332): Xaa can be any naturally occurring amino acid
  unsure (1)..(360): unsure at all Xaa locations
RWSFCPRARSALFFIRPEDRGEFFGSPGQRGNFSRGQSRAERGVPPWAEWHTGGFLPRDPEKLIRYFQGGRRDLPLKVRNAPRGAGLVKFFGDXQVRVDMLADKXLGGVEYSHVCKYACSEXVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGXSKNEIIRFEETLYGSSRLAAKANVGATA

SEQ ID NO: 18009 - protein, 309 aa, Candidatus Pelagibacter ubique HTCC1002
MKILGIGNAIVDVICKVDDQYLINNQLIKSTMKLVDEIEFKKLLSSLKIEQTISGGSVANSIVGLSQLGNDVGFIGKVNDDNLGQKYEEGLTKEKVQYFYNKKKEISPTGTCLILITPDAERTMVTFLGIAGKISPSDINEKAIQESKMIFLEGYLWDEGEPKSAFDKAMSMSNTKAMSLSDQFCVDRHKSDFLDLVKNKLDITFANEQEIRSLINAKNFEEVIEFGKQLGKLLIITRGEKGSIAVKNQEITECKSKPNLKIVDLTGAGDLFAAGFLHGLINNSSTKECLEKGTAMSSKIIQKIGARLD

SEQ ID NO: 18010 - protein, 303 aa, Lycopersicon peruvianum
TNSINDALSSSYLVPFESYRVPLLDLEEATNNFDDKFFIGEGGFGKVYKGVLRDGTKVALKSCKPESSQGIEEFETEIEILSFCRHPHLVSLIGFCDERNEMILIYKYMENGNLKRHLYGSDLPSMSWEQRLEICIGAARGLHFLHTRAVIHRDVKSINILLDENFVAKITDFGISKKGTELDQTHVSTIVKGTLGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 18011 - protein, 261 aa, Mycobacterium tuberculosis CDC1551
MSRKPLIAGNWKMNLNHYEAIALVQKIAFSLPDKYYDRVDVAVIPPFTDLRSVQTLVDGDKLRLTYGAQDLSPHDSGAYTGDVSGAFLAKLGCSYVVVGHSERRTYHNEDDALVAAKAATALKHGLTPIVCIGEHLDVREAGNHVAHNIEQLRGSLAGLLAEQIGSVVIAYEPVWAIGTGRVASAADAQEVCAAIRKELASLASPRIADTVRVLYGGSVNAKNVGDIVAQDDVDGGLVGGASLDGEHFATLAAIAAGGPLP

SEQ ID NO: 18012 - protein, 89 aa, Oryza sativa
  misc_feature (44)..(44): Xaa can be any naturally occurring amino acid
  misc_feature (47)..(47): Xaa can be any naturally occurring amino acid
  misc_feature (83)..(83): Xaa can be any naturally occurring amino acid
  unsure (1)..(89): unsure at all Xaa locations
ARGWARDALICQENGLVPIVEPEILVDGEHGIEACAEGTERVLXVSXKALSDHHGVGEGTLLKPNMGTPGSDAARAPPEVVAXHTVRAL

SEQ ID NO: 18013 - protein, 253 aa, Borrelia garinii PBi
MVGTFLGTGASSGVPMLNCSCRVCTSSFSKNKRLRSSFFLKLSSDIKLLIDTGPDIRQQLLRENIDKLDLVLYTHEHYDHIMGFDDIKFYTREAPLNIYARDTTMAHIMNAFPHNFSSKPSLSGKANIIPNVIRDFEPIFFKGLEIVPIPLIHGEIVSLGYRIGNLAYLTDVKFIPEESYDYLKNLDLLIIDAIRIKSHPAHLNFSEAICEVRKINPKISYFTHIAHDIMHEEFDYLEKDNIYLAYDGLKIYF

SEQ ID NO: 18014 - protein, 303 aa, Lycopersicon peruvianum
TNSINDALSSSYLVPFESYRVPLVDLEEATNNFDHKFLIGAGVFGKVYKGVLRDGTKVALKRRQPESSQGIEEFETEIETLSFCRHPHLVSLIGFCDERNEMILIYDYMENGNLKRHLYGSDLPSMSWEQRLEICIGAARGLHFLHTRAVIHRDVKSINILLDENFVAKITDFGISKKGTELDQTHLSTVVKGTFGYLDPEYFIKGRLTEKSDVYSFGVVLFEVLCARSAIVQSLPREMVNLAEWAVESHNNGQLEQIVDPNIADKIRPESLRKFGETAVKCLALSSEDRPSMGDVLWKLEYA

SEQ ID NO: 18015 - protein, 305 aa, Lycopersicon peruvianum
TNSINDALSSSYLVPFESYRVPLVDLEEATNNFDDKFFIGHGVFGKVYKGVLRDGTKVALKRRQPESSQGIEEFETEIETLSFCRHPHLVSLIGFCDERNEMVLIYKYMENGNLKRYLYGSDLPTMSMSWEQRLEICIGAARGLHYLHTRAVIHRDVKSINILLDENFVAKITDFGISKKGTELDQTHLSTIVKGTLGYLDPEYFIKGRLTEKSDVYSFGVVLFEVLCARSAIVQSLPREMVNLAEWAVESHNKGQLEQIVDPNLADKIRPESLRKFGETAVKCLALSSEDRPSMGDVLWKLEYA

SEQ ID NO: 18016 - protein, 479 aa, Shewanella sp. MR-4
MFRRTKIVTTLGPATDRDDNLRRIIAAGANVVRLNFSHGSPEDHLKRATQAREIAKELGVHVAILGDLQGPKIRVSTFKDNKKVQLNLGQAYILDAELGKGEGDENQVGIDYKQLPDDVKIGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASEEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCIGAESHPSVKVSKHRLDARFTSVEETIALSTMYAANHLEGVKAIIALTESGATPKLMSRISSSLPILGLSRHETTLAKMALYRGVLPIYFDSTIYPADELAQKALESLTTAGYLQSGDLVLMTKGDAMETIGGTNTCKVLIVA

SEQ ID NO: 18017 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 18018 - protein, 271 aa, Oryza sativa (japonica cultivar-group)
MAAATSHSAIVHTQSHRWRPNQAAIWFWFCLCIEVFGGGAGESSLILIRHGESLWNEKNLFTGCVDVPLTPKGVEEAIEAGKRICSIPIDVIFTSSLIRAQMTAMLAMMQHRRKKVYSEETRKQSIPVITAWQLNERMYGELQGLNKQETADRFGNEQVHKWRRSYDIPPPNGESLEMCAERAVAYFKEHVVPQLTAGKHVMIAAHGNSLRSIIMQLDKLTSQEVISLELSTGIPMLYIFKEGKFIRRGSPVGPSEASVCAYTRVRVFSNL

SEQ ID NO: 18019 - protein, 266 aa, Prosthecochloris aestuarii DSM 271
MQQLSIGFVGTGRIARALISGLVNDPANRICGYDKDPDAIAAVVKQFGIEGTSSAAEVARDARIIILAVKPYQIGEVVEELRPHLTTGHLLISVAAGITSEFIRQHSIDAMRVIRVMPNTPAFTGQGMTALSKGIMATQEDIALATTMFSAIGRVAVLDERLMDAATAVSGSGPAYMFSLIASIAEGGRQCGLSMQDAILLSAQTMLGAATMVLNGEKTPEELIREVTTPGGTTEAGLKQMDAHHVRQAMIETVKAAAARSNELKQ

SEQ ID NO: 18020 - protein, 337 aa, Yersinia pestis CO92
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 18021 - protein, 404 aa, Oryza sativa
MGEGRARCIADVRAAAGSTTFLAGTLSLKEENEVHLIRFSPAESELVCDGLFYHPNEIWDLKSCPFDHRVFSTVYTSGEGYGASVWKIPELHGQSNSPPLEQLFTLDEHTGKIRCVLWWPLGKHDKLISIDDRNIFLWNIDASNKSAKVMQKGSADMLPNLRGGSWDPHDHNSIAAITDSSLHCWDLRSMKKSNAIEHAHFRDVDYNPKKQHLITTAEDEFGIRLWDLRMLKYPLKNLPGHSHWTWAVRHNPEHDQLILSAGTDSTVNLWFAKVGTDDSGPESPPGSPTREEEPLLNSYTDYEDSIYGCFRISQALLAEKMKLHVLSVVRAHNSTSLLDFLLAILYTVLWPAVIAKFSLVQLPNTAPRVILECHISEKGWCQLLRYVVKYNRSEFCRTVEIDKI

SEQ ID NO: 18022 - protein, 141 aa, Burkholderia sp. 383
MAIERTLSIIKPDAVAKNVIGQIYSRFEGAGLKIVASRMAHLSRADAEKFYAVHAARPFFKDLVDFMISGPVMIQVLEGEGAILKNRDLMGATDPKKAEKGTIRADFADSIDANAVHGSDAAETAAVEVAFFFPEMNVYSR

SEQ ID NO: 18023 - protein, 481 aa, Glycine max
ACLLTLSLLIFLPHIKASQANKLDELILSRSSHNPPVTLSWAEEDALKMHSAAYVAPQEGLRQADKIVTLPGQPHGVNFDQYSGHVTVDPKTGRSLFYYFVESPHNSSAKPLVLWLNGGPGCSSLGYGAFEELGPFRVNSDGKTLFHNKYAWNEVANVLFLESPAGVGFSYSNTTSDYDRSGDKSTAKDAYVFLINWLERFPEYKTREFYITGESYAGHYVPQLAYTILVNNKFSQQSINLKGIAIGNALIDDVTTIKGIFDYFWTHALNSDQTHHLIKKYCDFTSENISAACINATISSILEKGSIDSSNIYAPLCYDSSLKNGSTGSVYDFDPCSAYYVEAYLNRPEVQKALHAKPTNWTHCSGFDWKDSPTTILPIIEYLIASHIKLWIYSGDTDATVPVTSSRYSINTLRLPIQVDWHPWYSGNEVGGYVVGYKAVTFVTVRGAGHFVPSWQPARSLTMISSFLSGTLPPASPYDGF

SEQ ID NO: 18024 - protein, 479 aa, Arabidopsis thaliana
MENITAQLKRGISRQFSTGSIRRTLSRQFTRQSSLDPRRTNMRFSFGRQSSLDPIRRSPDSSKSDDEPHMSVPENLDSTMQLLFMASKGDVRGIEELLDEGIDVNSIDLDGRTALHIAACEGHLGVVKALLSRRANIDARDRWGSTAAADAKYYGNLDVYNLLKARGAKVPKTRKTPMTVSNPREVPEYELNPLEVQVRKSDGISKGAYQVAKWNGTRVSVKILDKDSYSDPERINAFRHELTLLEKVRHPNVIQFVGAVTQNIPMMIVVEYNPKGDLSVYLQKKGRLSPSKALRFALDIARGMNYLHECKPDPIIHCDLKPKNILLDRGGQLKISGFGMIRLSKISQDKAKVANHKAHIDLSNYYIAPEVYKDEIFDLRVDAHSFGVILYEITEGVPVFHPRPPEEVARMMCLEGKRPVFKTKSRSYPPDIKELIEKCWHPEAGIRPTFSEIIIRLDKIVANCSKQGWWKDTFKFPWK

SEQ ID NO: 18025 - protein, 325 aa, Ensifer adhaerens
IGGWKAINESDMVLMPDPETAHMDPFFAQSTMVIICDILDPVSGESYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 18026 - protein, 325 aa, Ensifer adhaerens
IGGWKAINESDMVLMPDPETAHMDPFFAQSTMVIICDILDPVSGESYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSETCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 18027 - protein, 176 aa, Manihot esculenta
MASSMLSTATVASINRVSPAQATMVAPFTGLKSTPVFPTTRKTNSDITSITSNGGKVQCMKVWPTLGMKKFETLSYLPPLTREQLAKPSCIGPCLEFELEHGLVYREHARVPGYYDGRYWTMWKLPMFGCTDAAQVLKELDELIKHHPDGYARIIGFDNVRQVQCISFLAYKPPGA

SEQ ID NO: 18028 - protein, 182 aa, Manihot esculenta
MASSMLSTATVASINRVSPAQATMVAPFTGLKSTPVFPTTRKTNSDITSITSNGGKVQCMKVWPTLGMKKFETLSYLPPLTREQLASEVEYLLRSGWIPCLEFELEHGLVYREHARVPGYYDGRYWTMWKLPMFGCTDAAQVLKELDELIKHHPDGYARIIGFDNVRQVQCISFLAYKPPGA

SEQ ID NO: 18029 - protein, 276 aa, Agrobacterium tumefaciens str. C58
MAAIDGLPPLRDVIQRHGLDAKKSLGQNFLFDLNLTQKIARTAGPLDGVTVIEVGPGPGGLTRAILSLGAKKVIAVERDSRCLPVLAEIEAHYPGRLEVIEGDALKTDFEALVPAGEPVRIIANLPYNVGTQLLVNWLLPREWPPFWLSMTLMFQKEVGQRIVAEEGDNHYGRLGVLAGWRTVSEMAFDVPPQAFSPPPKVTSTVVHLLPKDKPLPCDVAKLERVTEAAFGQRRKMLRQSVKSLGGETLLEKAGIDPTRRAETLSVEEFVTLANCL

SEQ ID NO: 18030 - protein, 149 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKA

SEQ ID NO: 18031 - protein, 167 aa, Triticum aestivum
  misc_feature (157)..(157): Xaa can be any naturally occurring amino acid
  unsure (1)..(167): unsure at all Xaa locations
MPRTRRLRGGFRLGRKLLTAWRWALCGRSRRRGGYLRLDTPCPVEGREAKKLAPVLRWGQSLARLLSLGRTDRGQRTLGGGGGDEAVKTPKGQVAVYVGGGGPGEPLRYVVPVVYFNHPMFGELLREAEEAFGFQHPGGITIPCAAAKFERAAAVAXAGGKKGFARW

SEQ ID NO: 18032 - protein, 602 aa, Oryza sativa
  misc_feature (302)..(302): Xaa can be any naturally occurring amino acid
  unsure (1)..(602): unsure at all Xaa locations
MPSAAQNPVKISASATATAADAAMAATAAAAHTLLHLAAPRKPSAGPPLPPATLRLPSRRLARLTASCSSGSGNNSAADFPNPNGILVAPPSAAAVAAASSHIDVDVATEADLRENGFRSTRRTKLVCTVGPATCGADELEALAVGGMNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKXDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 18033 - protein, 174 aa, Triticum aestivum
MAPAVMASSATTVAPFQGLKSTAGLPVSRRSRGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 18034 - protein, 110 aa, Glycine max
  misc_feature (86)..(86): Xaa can be any naturally occurring amino acid
  unsure (1)..(110): unsure at all Xaa locations
MASSMIWDRAVTTVNRAGAGMVAPFTGLKSMAGFPTRKTNNDITYIASNGGRVQCMHVWPPIGKRKSRLFSTWQNLVNPNLPKEVXFLLRKGWIPCLEFELEHGFLYRGP

SEQ ID NO: 18035 - protein, 792 aa, Arabidopsis thaliana
MAVSLPLFQFILFLLLLLLSRTVYAYLIGVGSYDITGPAADVNMMGYANSDQIASGIHFRLRARAFIVAEPQGNRVVFVNLDACMASQIVTIKVLERLKARYGELYTEKNVAISGIHTHAGPGGYLQYVTYIVTSLGFVRQSFDVVVNGIEQSIVQAHESLRPGSAFVNKGDLLDAGVNRSPSSYLNNPAAERSKYKYDVDKEMTLVKFVDSQLGPTGSFNWFATHGTSMSRTNSLISGDNKGAAARFMEDWFENGQKNSVSSRNIPRRVSTIVSDFSRNRESYPFLELPNVAILYIAVAERLMWKVMVLFYFVSESRLLDIAATYKSSRGHSVDKSLDVKTRVRNGSKRKFVSAFCQSNCGDVSPNTLGTFCIDTGLPCDFNHSTCNGQNELCYGRGPGYPDEFESTRIIGEKQFKMAVELFNKATEKLQGKIGYQHAYLDFSNLDVTVPKAGGGSETVKTCPAAMGFGFAAGTTDGPGAFDFKQGDDQGNVFWRLVRNVLRTPGPEQVQCQKPKPILLDTGEMKEPYDWAPSILPIQILRIGQLVILSVPGEFTTMAGRRLRDAIKSFLISSDPKEFSNNMHVVIAGLTNTYSQYIATFEEYEVQRYEGASTLYGRHTLTAYIQEFKKLATALVNGLTLPRGPQPPDLLDKQISLLSPVVVDSTPLGVKFGDVKADVPPKSTFRRGQQVNATFWSGCPRNDLMTEGSFAVVETLREGGKWAPVYDDDDFSLKFKWSRPAKLSSESQATIEWRVPESAVAGVYRIRHYGASKSLFGSISSFSGSSSAFVVV

SEQ ID NO: 18036 - protein, 156 aa, Brassica napus
  misc_feature (37)..(37): Xaa can be any naturally occurring amino acid
  unsure (1)..(156): unsure at all Xaa locations
MEQTFIMIKPDGVQRGLVGEIICKFEKKGFTLKAVLXLAWLGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 18037 - protein, 411 aa, Pseudomonas syringae pv. syringae B728a
MRALTYHGANSVKVDTVPDPVIEQADDIILRVTATAICGSDLHLYRGKIPTVEHGDIFGHEFMGVVEETGSAVTAVAKGDRVVIPFVIACGSCFFCNLDQFAACETTNTGRGAILNKKSIPPGAALFGFSHLYGGVPGGQAEYVRVPKANVGPFKVPGTLADEKVLFLSDILPTAWQAVLNAGIGQGSTVAIYGAGPVGLMSAACAKMLGAEKIFMVDHHPYRLAYAQKTYGVIPINFDEDDDPADTIIRQTAGMRGVDGVIDAVGFEAKGSTTETILATLKLEGSSGKALRQCIAAVRRGGVVSVPGVYAGFIHGFMFGDAFDKGLTFKMGQTHVHRFMPELLEHIEAGRLEPEAIITHRMSLEDAAKGYKLFDKKEEDCRKVILTPGNNTIVVPDDTTEALVGGGVPAM

SEQ ID NO: 18038 - protein, 273 aa, Corynebacterium glutamicum ATCC 13032
MGTMTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 18039 - protein, 649 aa, Brassica napus
MSSAPSPGTGSPPSPPSNSTTTTPPPASAPPPTTPSSPPPPSTIPTSPPPSSRSTPSAPPPSPSPPTPSTPGSPPPLPQPSPPAPTTPGSPPAPVTPPTRNPPPSVPGPPSNPSREGGSPRPPSSPSPPSPSSDGLSTGVVVGIAIGGVALLVIVTLICLLCKKKRRRDEEDAYYVPPPPPPGPKAGGPYGGQQQQWRQQNATPPSDHVVTSLPPPPKAPSPPRQPPPPPPPPFMSSSGGSDYSDRPVLPPPSPGLVLGFSKSTFTYEELARATNGFSEANLLGQGGFGYVHKGVLPSGKEVAVKQLKVGSGQGEREFQAEVEIISRVHHRHLVSLVGYCIAGAKRLLVYEFVPNNNLELHLHGEGRPTMEWSTRLKIALGSAKGLSYLHEDCNPKIIHRDIKASNILIDFKFEAKVADFGLAKIASDTNTHVSTRVMGTFGYLAPEYAASGKLTEKSDVFSFGVVLLELITGRRPVDANNVYVDDSLVDWARPLLNRASEQGDFEGLADAKMNNGYDREEMARMVACAAACVRHSARRRPRMSQIVRALEGNVSLSDLNEGMRPGQSNVYSSYGGSTDYDSSQYNEDMKKFRKMALGTQEYNATGEYSNPTSDYGLYPSGSSSEGQTTREMEMGKIKRTGQGYSGPSL

SEQ ID NO: 18040 - protein, 458 aa, Arabidopsis thaliana
MSGNNELNALKGPQSSLPWPFGMASASFAPSHMAPPNFQPQFQLSQDQGISAPGRRFPHKPPIGGPPAVPPSMELTPASRKKKHKLPDKSSLQERVAAVLPESALYTQLLEFESRVDAALFRKKVDIQDSLKNPPSIQKTLRIYVFNTFSNQIPGPDPPTWTLRIFGRVLDPDHTGGLVQNSNPLYPKFSSFFKTLKISLDQSLYPENHLIEWKRDRSPAPLEGFEIKRIGCQEFAAIILLEMNYVPEKFKTSPALMQVLGIEVDTRPRIIAAIWHYVKVRKLQNPNDPSFFNCDAALHSVFGEEKMKFTMLSHKISQHLSPPPPIQLVHKIKLSGNNPAISACYDVLVDIPAPVQTELSNLLANPEKNKEIEACDEAICGAIRKIHEHRRRRAFFLGFSQSPVEFTNALMESQTKDLKLVAGEASRNAEKEGRSEFFNQPWVEDAAIRYLNRKPAGG

SEQ ID NO: 18041 - protein, 450 aa, Desulfotalea psychrophila LSv54
MRYLPHTEEEIQEMLEVVGKESLDDLFSSVPAECRYQGDIPIPAALTEWQLKDHFAALMSKNRVNQEHKVLIGAGSYDHYVPEILPSLMSRSEFLTAYTPYQPEVAQGTLQGIFEYQTLTARLLGTDAVNASMYDGASALAESALMSFRIARKKKTVALSAAIHPHYREVVATYLQATDFTIIELPVDAEGRTDLSSLAGIEGLASVAIQSPNFFGVVEDLQGCGEKIHDVDALFISCFSEALAYGLLKSPGECGADIICGEGQSFGLGRSYGGPGVGMMGCRDKLVRNMPGRIVGQTLDTKGKRGFVLTLATREQHIRREKATSNICSNQGICAMTAGMYMATLGGTGIRQLARLNYDKAAYLRSELIKLGAKPLFDAPVFNEFALRFPFDFERVREALKEESVVAGLSLEAYYPDLQGAYLFCATETLKKEDIDRIVSSIKKHALQEV

SEQ ID NO: 18042 - protein, 143 aa, Arabidopsis thaliana
MIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 18043 - protein, 204 aa, Brassica napus
  misc_feature (182)..(183): Xaa can be any naturally occurring amino acid
  unsure (1)..(204): unsure at all Xaa locations
MEEKKKEIEVGEWRSNVPDEEWTRLTVPGSESPARHKHAAVVVDEKLCIVGGSRNGRYLSDVQVFHFRSLSWDSLQLKTDDDDGSLREAFSDISNHRMIKWGHRLLLIVGYITDQLSRGYGLHIDLETHLCGVVEASGNVPVSRGGHSITLVGSRVFVFGGEDKKRRLLNDLHVLDLETMTXXDVGETSQTRPVPRFDHTAATH

SEQ ID NO: 18044 - protein, 501 aa, Xanthomonas oryzae pv. oryzae KACC10331
MAGGALRRRPMAATPWTLLCMFPGEPMSSASIDGAPDAGENTRFIILISCVATIGGFLFGFDSGVINGTVDGLKQTFQSTAAETGFEVASMLLGCAIGAFFAGRLADRSGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSLLFLLLLLVIPESPRYLVVKGRREQALVVLKRLYGNAAAQTKLGEISASMSADRHKPKFSDLINQATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDLNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKCVYETKGKELEQMEG

SEQ ID NO: 18045 - protein, 184 aa, Manihot esculenta
MATSMLSTATVASINRASPAQASMVAPFTGLKSTSAFTATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 18046 - protein, 184 aa, Manihot esculenta
MATSMLSTATVASINRASPAQASMVAPFTGLKSTSAFPATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 18047 - protein, 682 aa, Kluyveromyces lactis
MSSVAASQNKINDLLEAIRQEFANVSQEANSYRLQNQKDYDFKINQQLAEMQQVRNTVYELELTHRKMKDAYEEEISRLKLELEQKDRQLASIAHGSTVGNVPGQVPQLSRNSGAQGNANIAPPNIPQPMVSQTVGTGMAPQMAPLNTQHPTQQTKSNAGEQAAANLAPVIQQQQQPQQQLPPQQQQQQQQQQQSNIPVTTAAPVQPAGGNLDQTVPNSISPQQQPTEQQQPASTATTAPATASTAPPTSAPSDQVGQDHYLVPADQRAVHAKPIPPFLLDLDSQLVPSHLKKQNNDYYVLHNPALPTDLDVELHKSLEHSSVVCCVRFSSDGEFLATGCNKTTQVYKVSTGELVARLSDDSASQPQPQPQNQTVTAETSTSNSNGSSAEDGTGNQNSAASTASSDLYIRSVCFSPDGKFLATGAEDKLIRIWDLETKKIVMTLKGHEQDIYSLDYFPSGNKLVSGSGDRTVRIWDLTTGTCSLTLSIEDGVTTVAVSPGEGKFIAAGSLDRTVRVWDSDTGFLVERLDSENELGTGHRDSVYSVVFTRDGKGVVSGSLDRSVKLWNLNGLSGQKSHAECEVTYTGHKDFVLSVATTQNDEYILSGSKDRGVLFWDTKSGNPLLMLQGHRNSVIYVTVANGHPLGPEYGVFATGSGDCKARIWKYSKKNGQQNSTQIKEIKE

SEQ ID NO: 18048 - protein, 466 aa, Shigella flexneri 2a str. 2457T
MGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDPWLTWLVIGFITFVLVVMLFRPAQQLEVISTGLLAIGIICTVPIMARWKKLVLWQKTPVHNTR

SEQ ID NO: 18049 - protein, 187 aa, Arabidopsis thaliana
  misc_feature (115)..(115): Xaa can be any naturally occurring amino acid
  unsure (1)..(187): unsure at all Xaa locations
MAGGGTEAFPDLGEHCQDPDCKLLDFLPFTCDGCKLVFCLEHRSYKSHNCPKSDHGSRTVSICETCSIAIETTGFDEKGIKSLLEKHGRSGDCDPNKEKEPTCPVKRCKEILTFXANNLTCKYCGVKFCLKHRFPTDHVCNKKIINTAGTSSRWNERFMEALSLRNQKGCGRGSSVSSKSSPSVRSF

SEQ ID NO: 18050 - protein, 312 aa, Streptomyces coelicolor A3(2)
MPRRPIDITIPDLRDTRAVVTGASDGMGLGMAIRLASAGAQVVLPVRNPRKGEAALTKIRQHAPDADVSLRSLDLSSLASVAALGKTLLEEGQPIHLLLNNAGVMTPPERQATVDGFELQFGTNHLGHFALAAHLLPLLRAGQARVTSQVSIAANQHAINWDDLNWECSYNGRKAYSQSKIALGLFALELNRRSEAGGWGITSNLSHPGVAPTSLLAARPEVGRDKDTVLVRMIRAMSARGVIVGTVETAQLPALMAATSAAAKPGGFYGPSGPGHLGGPPGEQELYSRLRSADEAQRVWRTSEELTGTHLR

SEQ ID NO: 18051 - protein, 395 aa, Silicibacter pomeroyi DSS-3
MRLSRRITGLTGGGSDGWDLFLQARRMIAEGIAVTELTIGEHDTRTHSSILDAMDRSARGGHTGYAMVPGTALLRDTVAARVQERTGQRTTRDNVLITPGGQAALFAAHSAACDPGDTALFVDPYYATYPGTIRGVGALPRAVIARAEDGFQPRPDVIEAEADGAVSLLINSPNNPTGVVYGRETLEGIAKVCQDRDLWLISDEVYDTQIWEGAHLSPRALPGMAERTLVVGSMSKSHAMTGSRCGWIVGPEAAISHLITLATHTTYGVPGFVQDAAVFALGQGRDLEEEIAAPFRRRRDLAWHILAGQNAVRLSPAQGAMYLMLDIRATGLSGEAFATALLETHHIAVMPGESFGKAAAGHVRVAMTVADDAFVKALKTLCHFAAQQASGLPEG

SEQ ID NO: 18052 - protein, 355 aa, Aspergillus nidulans FGSC A4
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 18053 - protein, 311 aa, Streptomyces coelicolor A3(2)
MTTVNHWTPGDIPDQAGRTALITGGNSGIGLETARALARHGARVILAGRSRTRLDQAAEAVRAATPEARTDTLVLDLSDLSSVRDAATRIAETETVDLLFNNGGVMNLPERRTTHDGLEMTVGTNHLGHFAFNAQVWPAVRRSPAPRVVTVSAIAARWPMGRLEDLMSEKSYRAMGAYAKSKRANIVYTLELARRTASSPVEALVVHPGAAMTNLQQHGTGPLSRMVTPIAARLLMGSAEGAAWPSLYAATSPHVQSGWFIGPAGRDQTSGTPRPAKLPTGADDPAEGRRLWAASEQLTGVPFDIEAEAAV

SEQ ID NO: 18054 - protein, 98 aa, Brassica napus
  misc_feature (36)..(36): Xaa can be any naturally occurring amino acid
  unsure (1)..(98): unsure at all Xaa locations
MAWRGKISKSLKELRILLCQSSPASASTRPFVEKNXKDLKLLNPKFPFLIPECSGIQPQMWARYDMGVERCVNLDGMNESQILKSLENLVKPGGATKA

SEQ ID NO: 18055 - protein, 519 aa, Neurospora crassa
MAPEHKACLIVIDGWGIPSEESPKNGDAIAAAETPVMDELSKSATGFSELEASSLAVGLPEGLMGNSEVGHLNIGAGRVVWQDVVRIDQTIKKGELSQNEVIKATFERAKNGNGRLHLCGLVSHGGVHSKQTHLYALLKAAKEAGVPKVFIHFFGDGRDTDPKSGAGYMQELLDTIKEIGIGELATVVGRYYAMDRDKRWERVEVALKGMILGEGEESTDPVKTIKERYEKGENDEFLKPIVVGGDERRIKEDDTVFFFNYRSDRVRQITQLMGGVDRSPLPDFPFPNIKLVTMTQYKLDYPFDVAFKPQQMDNVLAEWLGKQGVKQVHIAETEKYAHVTFFFNGGVEKVFPLETRDESQDLVPSNKSVATYDKAPEMSADGVANQVVKRLGEQEFPFVMNNFAPPDMVGHTGVYEAAIVGCAATDKAIGKILEGCKKEGYILFITSDHGNAEEMKFPDGKPKTSHTTNKVPFIMANAPEGWSLKKEGGVLGDVAPTILAAMGLPQPAEMTGQNLLVKA

SEQ ID NO: 18056 - protein, 140 aa, Agrobacterium tumefaciens str. C58
MAIERTFSMIKPDATKRNLTGAITKVFEDNGLRIVASKRVWMSKREAEGFYAVHKERPFFGELVEGMTSGPTIVQVLEGENAILKNREIMGATNPAQAAEGTIRKSFALSIGENSVHGSDAPETAAQEIAYWFAETEIVG

SEQ ID NO: 18057 - protein, 635 aa, Brucella suis 1330
MPKSGVFKATSSTIFKYQEHSMVANGGSLYLQSLMILGGAIIAAPLFKRLGLGTVLGYLAAGITIGPVARLIADGEEFLHFSELGVVFLLFIIGLELNPSRLWSLRHSIFGLGTAQVLLCGAALAALGVYLAGLDTEAAIIIGFGLALSSTAFAMQVLEDRAETNQKHGQRAFAILLFQDLAIVPILAIIPALSPNEPSQASAGFHLATAIASIAALVIAGRYLINPMFRIIANTGAREVMIAAALFVVLGSASLLQYAGLSMAMGAFIAGVLLAESSYRHELEADIEPFRGIFLGLFFVAVGLSLNLSVILEYWAVILAAVPIFMATKIVIIYLLCRIFRSSHNDAVRIAFLLPQGGEFAFVLFSAASAAAIISSALGSELVAAVTVSMALTPLSVAIGSRLLIKDKADDIIEENFDGAGSDVLMIGFSRYGQIAAQILLAGGIDVTVIDSSSNRVRAAGKFGFRIYFGDGTRKDVLEAAGIRKAKIVAICTHKKSTTNHIVNLIQSEYPDVRLFVRSYDREHTLQLRAQGVEYELRETFESGLLFGQRTLEGLGLSEANAYAIREDVRQRDEDRLHVQASEGIMAGRHLLFNKPVTPEPLVKPTREGQRIDKSDDGQRAPSPQETAAAPVAAE

SEQ ID NO: 18058 - protein, 235 aa, Methanococcus maripaludis S2
MWLKLDFEIISHKNIDSTNTYAYNLGKLGKKNKIVVSETQNRGKGRLDRSWFSKKGGIYFSVLIGIEDIGKLEKINFLGSLCIIETLKSFSDQKFEIKWPNDVLFENKKICGILTELNVSKGYLVLGIGLNINNEIDPEIKNIATSLKEIENVEFNVDLILKKFIDIFVKNLKIDDELLLESYKKCSKTLFNDVNLIMHEKTVTGKVVDISYDGIHIDTGKIVEVFNVGDCIHLR

SEQ ID NO: 18059 - protein, 626 aa, Oryza sativa
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFWDIVTNYADILFANANEARAFCELSSTDSPMSAARYLSHSVPLVSVTDGILYGILRGSSDLKSIGLLASRVAAIVVAQQDSGGCLAFSDELHRRVAAPCQDRMVVATEEMAVYCFDALVSHYSGDQPPPPAFEEGIHPLFVTWKKATNGSEPRLRGCIGTLEARQIVTGFKEYALTSALRDRRFPPIQSKELPYLECTVSILTEYETALNHLDWEVGKHGLIIEFTDPDYNMRRSATYLPEVAAHEGWTHLETIDSLMRKAGYNGTITDSLRKKLRVTRYQSTLYTMHYGEYAAYVKKNRGAAPEINGAPIINGFKPGH

SEQ ID NO: 18060 - protein, 614 aa, Schizosaccharomyces pombe
MASVEDATKVQEMLDALKAEYNALAHHSFASKARGNDYESSMIQSQIQEIEAFRKTVDDMYEKQKSIRETYEKDINKLKRELEELGVEANTASYRNRGERSELAASNNQVTHIDQEHPSQTKSTSQPPSNHLPAFQQIPPIHQSAYPQNNVAEVLMPPIPPSVEASSGQNFNQGIASQNPAISTSNLPSTTPLYIPPVNYGANQVSQQPNPQLPGVSNYYNPSATSKPAVNVQPPRIPTKATPSAEPSMTASANAGSISQAGPDGEYQGREQIAPVSDTEAARKTTSQSWYVTYNPACKRVFNINLVHTLEHPSVVCCVKFSNNGKYLATGCNQAANVFDVQTGKKLFTLHEESPDPSRDLYVRTIAFSPDGKYLVTGTEDRQIKLWDLSTQKVRYVFSGHEQDIYSLDFSHNGRFIVSGSGDRTARLWDVETGQCILKLEIENGVTAIAISPNDQFIAVGSLDQIIRVWSVSGTLVERLEGHKESVYSIAFSPDSSILLSGSLDKTIKVWELQATRSVGLSAIKPEGICKATYTGHTDFVLSVAVSPDSRWGLSGSKDRSMQFWDLQTGQSYLTCQGHKNSVISVCFSPDGRQFASGSGDLRARIWSIDPASP

SEQ ID NO: 18061 - protein, 572 aa, Xylella fastidiosa 9a5c
MHHDTSLIDIIAVGLSLAFVLGALAQRLKLSPLVGYLVAGICVGPFTPGFVADQQIANQLSELGVMLLMFGVGLHFSLEDLLEVKAIAIPGALVQIAAATLLGWGLAWTMGWPMVQGVVFGLALSVASTVVLLRALEERRLIDTQRGRIAVGWLIVEDLVMVLALVLLPALAQMLNGNESVAAHTPNGSSDGNAMLTALGWTLLKMAGFVAVMLVVGRRVIPWSLEKVAATGSRELFTLAVLGIALGVAFGSAKLFGVSFALGAFFAGMVLKGSETSHAAATDSLPLRDAFAVLFFVAVGMLFNPAILIEHPLQVLATFLTITIGKSAAAFLIVRAFGHPTSTALTISTSLAQIGEFSFILAGLGIQLAILPETGRDLILAGALLSIIANPFLFTWLDRWQAQQTAEETTLVEPELPPGPSPDLYNHAIVIGYGRVGSMLAQLLQSRHVPLLVIDDNSEHVLKAHAAGIPAIRGSAAADLVLAEAHPDRAKIAVLAIPQPLEAGEILAKLRALNPELTLVARAHNDGEVKHLLEHGADATVVAEREMAHSLAEMVLSSTNHPNSTHPQPAIA

SEQ ID NO: 18062 - protein, 675 aa, Gibberella zeae PH-1
MSAARNPTNWDDYDGGGSPGESVTESMLEREQALVDDDDNNNDGGNQEGLRRRRRSSITYQLAAIADIGGVNSFRSFARSWQRAAGFHEVIPRRPSFVLAPEGEAQDLEYSRSHVQGSQPQSGLLRQHLEASSSQANGESSSAIDSSPRPMRMSRRDDETKPLLDVEAGDSSIVGSPRSSIFAVPPHLAAPDIVGSYGSFRDSSPFGTMDRSTRHRISFSEGSGWGVADEDEVEGEDAAHGEHQPILVKEVKQGNKVVLAVEGQSTLPQSVFNSINALIGVGLLSLPLAFQMTGWITGLFLLTFTAVVTSYTGKLLAKCMNFDPSLITYSDLAYVSFGTRARVIVSALFSLELIAACVALVILFADSLSLLLPGLATVNTWKVVASCLVLVLNALPLRLLSYTSVVGIFSTFCIVVIVIIDGLYKPNYPGSLREPATTYLLPENWLAVPLAYGLLASPWGAHSVFPSIYRDMRHPYKWGKAVNITFSFSYLVDTCLAVIGMLMFGDGIKDAITSNILKSKGYPDALKIIMCIFIAIIPLTKIPLNARPIITTLDVICGVHEQHHHHHDTPHSQPTRSSVLITKAVRMLVRVFVVILLLFISIVFPAFDSVCAFLGAALCTLISIILPISFYLKLYWQDVTFQEKTVSFILLVVFSILGTLGTIWTFLPKHLIGAD

SEQ ID NO: 18063 - protein, 247 aa, Triticum aestivum
  misc_feature (235)..(235): Xaa can be any naturally occurring amino acid
  unsure (1)..(247): unsure at all Xaa locations
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLXPAFVDIINATKQ

SEQ ID NO: 18064 - protein, 619 aa, Gibberella zeae PH-1
MSMYPHRAMGGGPQANSTRLNELLDQIRVEFESQMRTAENYEHQIAAQVSEMQMVREKVYQMEQTHLGLKQKYEDEISALRHQLDAARKGGMQGGIPGPPQHAAPSQPPSIAPGNGLFSGIMAGGSQGGLAPPQQGQQQSQQGQPQGAQQPQQSQQGHAPPQEQPLGPQHQMSQGPPGLPVPPHPSAQQAPYSQNYPPGPVSNGMGPRPQSTASPGPGRRGIARPPGAVGPATPQINTPTPYPGTAASPQVSHPTPDHARMAGPHASAVGNALGDLEVDNVAPHNKKTGNDWYAIFNPQVQRVLDVDLVHSLNHESVVCCVRFSHDGKYVATGCNRSAQIFDVQSGEKVCVLEDHTASDMSADLYIRSVCFSPDGRYLATGAEDKLIRVWDIQTRTIRNHFSGHEQDIYSLDFARDGRTIASGSGDRTVRLWDIEQGTNTLTLTIEDGVTTVAISPDTQFVAAGSLDKSVRVWDLHSGFLVERLEGPDGHKDSVYSVAFSPSGKDLVSGSLDRTIKMWELSAPRQGNNPGPKGGKCVKTFEGHRDFVLSVALTPDTNWVLSGSKDRGVQFWDPRTGTTQLMLQGHKNSVISVAPSPQGRFFATGSGDMKARIWSYRPYT

SEQ ID NO: 18065 - protein, 278 aa, Bacillus clausii KSM-K16
MKEHNKVVLITGANSGIGLELTKNLLLQGWEVAALIRSDFPNEQPIIIDALKKNHLRVYKADLADFSSLRNALDEIKKSETKIDMLFNNAGVSFAEYKHSKQGRELHFEVNTLVPFIITMELKELLLKGQNKTIINTSSNSLLFLKQFDLNTIINPKTPFKKLIGPYANSKLALSLWTNGIAPELSSEGIKIRSVCPGPNKTRLTKGKGMPSYILLIRNLMFTPPSKGASRLYDAAFNNEITGIFINKGKETAIKLSGHEEEVLNRLYDIYKNEFLVL

SEQ ID NO: 18066 - protein, 251 aa, Coprinopsis cinerea
MTRSFFVGGNWKLNPTSLSAAKAPVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 18067 - protein, 206 aa, Shewanella sp. ANA-3
MNKIVITATQMMESMISSPMPTRAEVMDVANAVLDGTDAVMLSAETAAGDFPEETVKAMANVCIGAESHPSVKVSKHRLDARFTSVEETIALSTMYAANHLEGVKAIIALTESGATPKLMSRISSSLPILGLSRHETTLAKMALYRGVLPIYFDSTIYPADELAQKALESLTAAGYLQSGDLVLMTKGDAMETIGGTNTCKVLIVA

SEQ ID NO: 18068 - protein, 220 aa, Chloroflexus aurantiacus
MYKTVGEATTLVRDLLAGLGELSDREAIVCPPFTALAAVALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGAL

SEQ ID NO: 18069 - protein, 255 aa, Mannheimia succiniciproducens MBEL55E
MARRPLVMGNWKLNGSKAFTKELIEGLKAELAGVEGCDVAIAPPVMYLAEAEAALAGSKIVLGSQNVDVNVKGAFTGDISTEMLKDFGAKYIIIGHSERRTYHKESDEFVAQKFGALKEAGLTPVLCIGESEAENEAGKTEEVCARQIDAVINALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAAKAKA

SEQ ID NO: 18070 - protein, 487 aa, Legionella pneumophila str. Lens
MKTNIPTLSKPIKDSGYRRGLKDRHVQLIALGGIIGSGYFLGTGEVINLVGPSVFIAYLLGGLIIYLTMLCMGELAVAIPISGSFVTYTSDFISPTVACGVGWSYWITWVAYIPAECVAGGIIMELFTGVSGYIWVVCFGLVITYINLAKVDTFGEIEFWLALIKIISLLAFVFLAILIFFGLIHGSEPPGIIGFKYLLDDGGLLPNGAMSLLTAMVLLLVNYQGSEIIGLAAGESENPARMIPHAIRNVTFRILFLYIIPVFCLVLIFPWQKAGLSNSVFADALNFYGLKWAGAVTSFVTLSATLSCANSGFYGAVRSLNALARDGMAPHVLAKFNQNSVPQNAVIATLIGVWILLGVGYFFGQTKLYIALLLVSGFTGTLAWLSLCIAQISFRNRLYKAGYSIKDLRYVTPYSPYTGILAVILMVGSLFFLLLNKDPIYKLSFIIGVVSFIIPVIIYKVFDLSKVRKKALHVKSRVKFQDLFPPQ

SEQ ID NO: 18071 - protein, 104 aa, Brassica napus
  misc_feature (85)..(85): Xaa can be any naturally occurring amino acid
  misc_feature (100)..(100): Xaa can be any naturally occurring amino acid
  unsure (1)..(104): unsure at all Xaa locations
THGQHNLSHRICRTFYPPPWCSTKEYAQRHQSLSPQEIKCAHWSENEAPLRPAVTQTALTWKGLVSVLRSGRKSKKGALTRPMTXKGCKKGVNKKGIITXQKPL

SEQ ID NO: 18072 - protein, 241 aa, Nelumbo nucifera
MASASSFQLMILVIQCLAALSVSHATSVHFFHHAQVWAGSFCASEKGSCFPNTGMVSQEFTVHGLFPCSSSGTRLMNCDRGNSLDLSQITGLLHTMQRKWPSYSCPSSDSTPFWAHEWSKHGTCSLSVFDGQYDYFKAGLDLKDKVNILQILKKEGINPDGQYYSSERITRVLQIATGVTPALDCTVDKFGKYQLYQVMFCVDKSGSEFMDCPVYPEPTCPSIIRFPPFRGSAAEGIYLRS

SEQ ID NO: 18073 - protein, 577 aa, Glycine max
MAQVVASRSIQSTPLCPTSGSARDRTQNLLKPPSFASKVFPLGENNNKRSKLRLRSLQISARKSAPSEVIPMSPEDDPKIEEHLQHLRGVQPFGENSVGMWSKPTFRRKTKIVCTIGPSTNTREMIWKLAEAGMNVARLNMSHGDHASHQKVIDLVKEYNASHEDNVIAIMLDTKGPEVRSGDLPQPITLMPGQEFTFTIQRGVGTADCVSVNYDDFVNDVEMGDMLLVDGGMMSLVVKSKTEDSVKCEVVDGGELKSRRHLNVRGKSATLPSITEKDWDDIKFGVDNKVDFYAVSFVKDAEVVHELKNYLKSCDADIHVIVKIESADSIPNLHSIITASDGAMVARGDLGAELPIEEVPLLQEEIINICRSMGKAVIVATNMLESMIVHPTPTRAEVSDIAIAVREGSDGIMLSGETAHGKFPLKAVQVMHTVALRTEATIPGGKMPPNIGQVLKNHMSEMFAYHATMMSNTLGTSTVVFTRTGFMAVLLSHYRPSGTIFAFTDEKRVQQRLALYQGVCPIYMEFCDDSEATFRRALDLLQKQAMVKEGEEVALVQSGRQPIWRFQSTHNIQVRKV

SEQ ID NO: 18074 - protein, 454 aa, Methanocaldococcus jannaschii DSM 2661
MHWGMEMNVEQAIEYVKKNNVKFIRFQFVDILGFPKNVAYPVKAGEKGIEELREIFENGVWFDGSSITGFVGIEESDMLLKPDLSTLSVLPWRPEEKSVARVICDVYKDEKTPFEGDPRSRLKAILEELKKEMNGEYFVGPEPEFFLLKRDPHNPHRWVPADDGGYFDVEPLDDAPDIRRDIVLALENLGFHVEASHHEVAPGQHEVDFKFDNALKTADSVITFKMTIKNIAKKHGLKATFMPKPFFGMNGNGMHCHQSVWFNGEPSFYDPEGPYNGLSETCLSYIAGILSHAKALVAITNPTVNSYKRLVPGYEAPVNIAWANKNRSAIIRVPAARGKATRIEFRAPDPTCNPYLAFACMLAAGLDGIKKKMTAPEPVERNIFKMSEEEKKQLGIESVPANLAAALDELECDEVLQKALGKHIYENYMEIKRAEWDDFRTAVTDWETGKYLIY

SEQ ID NO: 18075 - protein, 281 aa, Lactococcus lactis subsp. lactis Il1403
MQRKLTLNDGNVIPQFGLGLYQLPEGTETQNIVKTALELGYRHLDTSHAYQNETSVGQAIQDSEISNSEIWITSKLWPSDYEQAPEAIERMLKRLKVKQIDLLLLHQQVGNYRKAWIALENAVKEGKVKSIGISNFDGERLVDLFNFADIKPSVIQVETHPYHQQVELQEFLKPYGTKIESWYPLGHGDKNLLEEKIFKKMAKKYNKTVAQIILRWHIQEGIIVFPRSTQKEHLAENINIFDFELSCSEIKEIRKLNKKQPYFTMTYEEQEKNFLSWKLED

SEQ ID NO: 18076 - protein, 272 aa, Staphylococcus aureus subsp. aureus Mu50
MKTVSLLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 18077 - protein, 437 aa, Robiginitalea biformata HTCC2501
MDSKIFKISLIAALAGFLFGFDTVVISGAEKKLQLLWETSDAYHGTVVIGMALFGTVIGAIFGGFPTNRFGRKRTLIWIGVLYSVSAIGSALSNDPVTFGIFRFLGGIGIGASTVAAPTYISEIAPADQRGRLVGMYQFNIVFGILVAYFSNYLLNGIGDNDWRWMVGVEAFPALIYTAFAFGIPKSPRWLVTQHREEEAAGILEKLGLKLSVGDIVRDLEANVQAGAETIFMKKYRFPLLLAFLIAFFNQFSGINAFLYYAPRIFELAGLEESTALLSSIGIGVTNLVFTLLGIYLIDRLGRRTLMYYGSFGYIVSLALVAAAFFFNWTGMAVPIFLFVFIASHAIGQGAVIWVFISEVFPNHLRGSGQSFGCSVHWVLAWLIPSSVPFLMSWIGPAPVFGFFAFMMVLQLLFVHFMMPETKGISLEELSKRLLRK

SEQ ID NO: 18078 - protein, 411 aa, Francisella tularensis subsp. holarctica
MSQLSLNKKKIPILLLEGIHSNAVESFKAAGDENIELLNTALEGQELIDKLKDFKIVGLRSRTQLTKEVLEQSDHLIAIGCFCIDTNQVDLRTAQSLGIPVFNAPFSNTRSVAELVLEEAILLIRNVIDKNAKAHRGEWLKSADNANEVRGKTLGIVGYGHIGMQLGVLAENIGLNVIFYDIEEKLPLGNACQVDSLATLLQQSDVVSLHVPQLPTTANMISTKEFALMKQNAVLINASRGNVIDIDALVDALTSSKLKGAAIDVFPKDPSSKGEIFESPLRGLDNVFLTLHIGGSTIEAQENIATEVSAKLIKYSDNGSTLNAVNFSELSLPSHRETHRILHIHQNIPGIINELNRILASKNINVEGQYLRTLENIGYVVMDIKSSSDEAKELIDEFKKVKATIKARYLV

SEQ ID NO: 18079 - protein, 643 aa, Oceanobacter sp. RED65
MTEYFIQAFIYLCAAVIAVPLARRLGLGSVLGYLIAGLVIGPVLGLVGSETDTIQHFAEFGVVMMLFLVGLELDPKELWGMRNRLLGLGGLQVALTTILVAIIAWLAGLNASTALSVGLIFSLSSTAIVLQTFNEKQLTKTEGAKTSFSVLLFQDIAVIPMLALLPLLASSDLMESATAAAGHGAHGYSLVDHLSGWSYGLVVLAAIGFVVVGGHYLSYPLFRFIADSGLREMFTTSALFIVIGIAALMSLVGLSPALGAFLAGVVLANSEFRPELESHIEPFKGLLLGLFFITVGAGINLNLLQQEWFAIAAMTIGIILVKGIILYGLGRIFNVYGSNLWLFTLAMAQAGEFGFVLLNFSAQNFIISNELKQLLSLPVALSMFLTPGLFIFYEKVVVPNYRQKGEQKADEIEEQHPVIIAGSGRFGQIVNRLLIANDIPTTVLDYQSAQVDLMRRINIKSYFGDASDPKLLHTAGIEEASMVVVAIDQRDQAVDMVRYIRSIRSDIRILARAFDRGHGYTLEKSGADCVISETYHSALQLGRQALVESGMHPFSALQNMQTFEELERKQKPKLYKVWRETMDDGGFTSHYRELFMELEKQINHAMDEERDDAHAKSERGWTPPPKNYEEGLLKELDDKKSAD

SEQ ID NO: 18080 - protein, 429 aa, Yersinia pestis CO92
MSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLAVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 18081 - protein, 290 aa, Xylella fastidiosa 9a5c
MHTPHSSAQLTLLPPKHLNQLESHGMESQLFNAPAKKAFGQHFLVDRYYIDRIIHAITPQPNDHIVEIGPGQGAITLPLLKCCGSLTAIELDRDLIAPLTAAATPLGKLDIIHRDVLTVDLSILAKPGNKKLRLVGNLPYNISSPILFHVLQQAAIIADMHFMLQKEVVDRMAAPPGSKVYGRLSVMLQAWCEVTTMFVVPPDAFQPPPKVNSAITRLVPRDPTTIRIADTKRFSDIVRAAFGQRRKTLRNSLADICTPAHFEHAGIRTNARAEQLEVTEFIALANAKDT

SEQ ID NO: 18082 - protein, 755 aa, Nocardia farcinica IFM 10152
MAELALTARLNPSAADARRGVVRLHPEALTALGLREWDGVALAGSRRTAAVAGLAPAGTPAGVALLDDVTLSNAGIRENQTVVVAPATVYGARQVSVSGSVHATRSIPAATLRQALLGKVVTVGDTVSLLPRDLGPDIPSSAASQALSRTFGIAWTTELLTVTATDPARGPVSVQPNTAVSWAAGAMAAREAADRAATGAPVAAGETARGAAEAAAFAGAGANGAATGQWAVREAEARVPIEDLAGVHAQAAKLAEWLSLALDEPELLRALGANAHLGVLITGPAGVGKATLARSVAAPRRVIELDGPTVGAAESGTRLREVASAVAEVGSGQGGVLLVTDIDALLPAQPEPVATLILDQLRAAVAGPGVAFLATTAHPTEVDARLRAPDLCDRELALPLPTAPVRRALLEQLLRKVPTGDLALDEVAARTPGFVISDLAALCREAGLRAASRASREGAPPRLTQEDLLGALAVIRPLSRSGTEELAIGSLGLDDVGDMAETKQALTEAVLWPLRHPDSFARLGVDPPRGVLLYGPPGCGKTFLVRALAGSGQLSVHAVKGAELMDKWVGSSERAVRELFQRARDSAPSLIFLDEVDALAPRRGQSSDSGVADRVVAALLTELDGVEPLRDVVVLGATNRPELIDPALLRPGRLERLVFVPPPDAEARLAILRTAGRSVPLAADVDLAALAADLTGYSAADCAALLREAALAAMRRDVDTADVTAADVAAARAAVRPSLDPDQVESLRRYAESRT

SEQ ID NO: 18083 - protein, 324 aa, Glycine max
MMMMTMEGMMDKGVLDDVIRRLLEGKGGKQVQLSESEIRQLCVNARQIFLSQPILLDLRAPIRICGDIHGQYQDLLRLFEYGGYPPAANYLFLGDYVDRGKQSLETICLLLAYKIRYPDKIYLLRGNHEEAKINRIYGFYDECKRRFNVRLWKIFTDCFNCLPVAALIDEKILCMHGGLSPELENLDQIREIQRPTEIPDSGLLCDLLWSDPDASIEGWAESDRGVSCTFGADVVAEFLDKNDVDLVCRGHQVVEDGYEFFAKRRLVTIFSAPNYGGEFDNAGALLSVDDSLVCSFEILKPADRASGSGSSKMNFKKPPKLGKI

SEQ ID NO: 18084 - protein, 384 aa, Zea mays
MNCALLVLVFFQLHPGYLVRVFLDRLDSKDRSWFLTPHSLWICSCSVKGRLVSGVVGGQSFAGGEEEEQQRDSADTDRGRSANIGVFICLKCSGVHRSLGTHVSKVLSVTLDQWTDDEINSMIEVGGNSYANAIYEAFLPEGYQKPHPDSSQEERADFIRSKYELQEFLKPSLRLVSSNKGSLEATSTSSRKHMDNSVSLSASFSSEAGMVEFIGILKVKVIRGTKLAVRDLMSSDPYVVLTLGQQIISADKHQHCSLQKAKTSVSKRNLNPVWNEELKLSVPQHYGPLKLQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 18085 - protein, 108 aa, Shewanella sp. ANA-3
MSQQKICFIGAGNMTRSIISGLIRSGYPAALVQATNPSQGKLDALAADFGVRVSQDNFSAAQDADVIVLSVKPQLMEQVCQALQGIDLSNKLVITIAAGIKAERYSQY

SEQ ID NO: 18086 - protein, 130 aa, Triticum aestivum
FILSIQDGMWVVPSEYTSAEPDPLRNFAENIVEEFNSKNAEDVHRIYNIYVESDLQVADVKIIWVDRLGFDFHVHSGEGVFAVRIPFSREVTDEKGVKSSFNMMSHHAWEVEKSYASPEFEKVQFLKKVR

SEQ ID NO: 18087 - protein, 274 aa, Vigna unguiculata
MEIAPIPVDTYTLGFIGAGKMAESIARGAVRSGVLPPSRIRTAVHSNPARRTAFESFGVTVLSSNDEVVRQSNVVVLSVKPQLVKDVVSKLKPIITKDKLLVSVAAGVKLKDLQEWAGSDRFIRVMPNTPAAVGEAASVMSLGAAATEEDGNVIAKLFGSIGKIWRAEEKYFDGITGLSGSGPAYIYLAIEALADGGVAAGLPRDLSLSLASQTVLGAASMVTQSGKHPGQLKDDVTSPGGTTITGIHELENGGFRGTLMNAVVAAAKRSRELS

SEQ ID NO: 18088 - protein, 523 aa, Zea mays
MTRTTTSSTLLAAALLCLALPLLPGATANKAARRRQGDNLARLRGSPWPAESSVSLAVAATDDRASRHAASPPAGRSKEDDRVDKLPGQPSGVDFEQYAGYVTVDAAAGRALFYYLTEAVGGGAAAKPLLLWLNGGPGCSSLGYGAMEELGPFRVKSDGKTLYRNPYAWNNAANVLFLESPAGVGFSYSNRTEDYSRSGDNKTAEDALLFLLNWMEKFPEYKGRDLYLAGESYAGHYVPQLAHAILRHAAAAAAAGKPSSPINLRGIMIGNAVINDWTDTKGMYDFFWTHALISDATADAIGRHCNFSAAAAGSNDKCDEATSEADEALEDIDIYNIYAPNCQSADLVSPPITPSMDNFDPCSDYYVDAYLNDPDVQRALHANVTRLDHPWSACSDVLRRWTDSAATVLPILAELLKNDLRVWVYSGDTDGRVPVTSSRYSVNQLQLPVAAKWRAWFSSTQGAGEVGGYVVQYKGKEKGSLSLVTVRGAGHEVPSYQPKRALVLVQGFLAGKALPDCETCESG

SEQ ID NO: 18089 - protein, 314 aa, Synechococcus sp. RS9917
MLNATGFALALGIPTAAAAVGLAIWSRRNRAYHSSASVAAAYDAWTDDRLLEQLWGEHVHLGHYGEPPRRRDFRAAKADFVHALVHWSGLDQLPPGSRLLDVGCGIGGSARILAREYGFDVLGISISPAQVARATSLTPTGLSCRFAVMDALDLKLADGQFDAVWSVEAGPHMPDKQRYADELLRVLRPGGVLAVADWNRRDVSDGAMSGLERQVMHQLLTQWAHPEFASIKGFGANLNASPYNHGGTIVSADWTAATLPSWIDSIMEGVRRPGAVLSLGPKAVLQGLRETPTLLLMHWAFATGLMQFGVFRRD

SEQ ID NO: 18090 - protein, 88 aa, Brassica napus
RVDPRVRFFTFSIKFFKDYESEEKFVIPEERVSHLLPTTFQDMIVRVYAKKPELVEAVSEAFENFQVRTYGIKAQVHETPEKKKRRVM

SEQ ID NO: 18091 - protein, 102 aa, Narcissus pseudonarcissus
VNLSHFAVTYHFFHWKKGTPFGEDQGIYRALTWWEQMDDGKQLTRNRKFLTVVPVVLYLIASHTTDYQNPMLLLNTLAVFILVVAKLPNMHKVRIFGINGDL

SEQ ID NO: 18092 - protein, 262 aa, Lactococcus lactis subsp. lactis Il1403
MKTIGFIGVGKMATAIISGLDKNKFKIIISGHNLTKTQKQAETLNVTATSNHEELVQESDFIILSVKPQVLPSVLSKLINHLTKDKTLISIAAGLTLSDLKHLADSENQPIIRVMPNINAQIGQSTSAIVKNEFVDDSAYATVQEIFKSTGSVHEIAEKDFSTFAAIAGSSPAFIYMFIDAMARAGVLHGIPKDQATAIVAETVRASAEMILQSGENPWSLVDKVSSPGGTTVAGVVSLEQNHFIGTVIDAISATIEKEKNL

SEQ ID NO: 18093 - protein, 361 aa, Glycine max
MLLRNPALTASLLSATTKKLYNHRYSTPAAFMASSGVACSLLVLCGKSLAENETAKAIKTNNTLKLPEDEKLSLVLHSEMDKSVMQGFFQVHSYMDSLSTNQFGRLLVWSPDLTSTHDVVSHNFCELPIGTVCIADVQTKGRGRSKNVWESPLGCLMFSFTMQMEDGRVVPLVQYVVSLAMTEAIKDICDKNGLPSIDVKIKWPNDLYLNGSKVGGILCTSTYKSKKFNVSAGIGLNVNNKKPTTSLNTILKGFYSGAYQFQREEVLAAFFNKFEIFYDLFLNQGFQTLEELYIKTWLHSGQRVVVQEKNEDKVIEHVVTIQGLTSSGYLLAVGDDHQMCELHPDGNSFDFFKGLVRRKLE

SEQ ID NO: 18094 - protein, 516 aa, Oryza sativa
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 18095 - protein, 434 aa, Corynebacterium glutamicum ATCC 13032
MTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 18096 - protein, 238 aa, Zea mays
MSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 18097 - protein, 479 aa, Escherichia coli CFT073
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 18098 - protein, 167 aa, Arabidopsis thaliana
  misc_feature (145)..(145): Xaa can be any naturally occurring amino acid
  misc_feature (158)..(158): Xaa can be any naturally occurring amino acid
  unsure (1)..(167): unsure at all Xaa locations
RAVPNSIDMIALSFVRKGSDLVNVRKVLGSHAKSIMLMSKVENQEGVINFDEILRETDAFMVARGDLGMEIPIEKIFLAQKLMIYKCNLAGKPVVTATQMLESMIKSPRPTRAEATDVANAVLDGTDCVMLSGESPAGAFPGNSXVKVMAKICIEGRXSSLDFNTIF

SEQ ID NO: 18099 - protein, 399 aa, Ralstonia solanacearum
MTTASAARPAPSADTLAPIAPPPSRLPKVGTTIFTVMSALAAEKQAVNLGQGFPDFDCDPRIVDAVSDAMRAGFNQYPPMTGVPALRQAIAAKIATLYGHAYDAEREITVTAGATQALLTAVLCCVHPGDEVIVFEPTYDSYLPSIELAGGKAVPITLEAPDYRIPFDKLAAAITPRTRLIMLNTPHNPTGTVWHADDMRRLAEIVAPTDVLLLSDEVYEHMVYDGVPHASVSRIPELARRAFVVSSFGKTYHVTGWKVGYVAAPAALSAEFRKVHQFNVFTVNTPVQHGLAAYMADPRPYLELPAFYQHKRDLFRAGLEHTRFKLLPCQGTYFQCVDYSALSDLPEAAFAKWLTSEIGVAAIPVSAFYSQPHESGVVRFCFAKKDETLRLALERLSRL

SEQ ID NO: 18100 - protein, 412 aa, Burkholderia sp. 383
MKPIQKSNKLLNVCYDIRGPVLEHAKRLEEEGHRIIKLNIGNLAPFGFDAPDEIIQDMIRNLPTSSGYSDSKGVFSARKAVMHYTQEKGVVGVGLDDIYIGNGASELIVMATQALLNDGDEVLLPAPDYPLWTAAVSLSGGTPVHYICDEQNAWMPDPDDIRRKITPNTKAIVVINPNNPTGALYSDELLLELLAIAREHGLIVFADEVYDKIVYDGLEHTALGSLSEDVITVTFNSLSKSYRSCGYRAGWMAVSGLGGDNRRRAKDYLEGLGILSSMRLCANVPGQFAIQTALGGYQSINELIVPSGRLYKQRELAYDMLTSIPGVTCVKPQAALYMFPRLDPKLYPIQNDQQFILDLLLEERVLLVQGTGFNWTTPDHFRVVFLPNLDDLTDSINRIARFLDGYRKRHSA

SEQ ID NO: 18101 - protein, 527 aa, Halobacterium sp. NRC-1
MRVLVTDPIADAGLDRLRDAGHEVTTAYDATGDALLDAVSDAHALIVRSGTAVTDAVFEAAPDLVIVARAGIGVDNIDIDAATDHGVMVANAPAGNVRAAAEHTVALAFAAARSIPQAHARLDAGSWAKDDYLGTELSGKTLGVVGLGRVGQEVATRLDSLGMDLVAYDPYIGEDRAAQLGAELVDIETCVARADFLTIHVPLTDETDGLIGEAELARMDGGYVINVARGGVVDEDALADAAQDGVIAGAALDVFRTEPLPAASPLHDADSIITTPHLGASTKAAQENVATDTADQVVAALAGDPVVNALNAPSAERSAFDRIRPFVDLAETAGTVAAALFDPRIERVDVTYQGEVADEDVALVTAAAQQGAFAGLEWQVNAVNAPRVAEERGIAVTETKNHRSEAYQSLVSVTVGNGDAELTVSGTLFAGDDPRLVEIDGFRVEAAPNGHMLVARNHDTPGVIGFIGGVLGTAEVNIAGMFNAREARGGEALTVYNLDADVPARALDELAGDDRIVDVTSIELNGE

SEQ ID NO: 18102 - protein, 387 aa, Arabidopsis thaliana
  misc_feature (272)..(272): Xaa can be any naturally occurring amino acid
  unsure (1)..(387): unsure at all Xaa locations
TRTRPRTRPAFFRISFHFSLISRSLRPTMSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIXAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 18103 - protein, 397 aa, Salinibacter ruber DSM 13855
MDRAASPSLAARADDLQQSDIRSVTRRVEEVDGINLGQGVCDLPTPEPIKARAHQAIRDDASIYSHYAGIEPLRRAILEKEQAHNEVPATSPEDVVVGVGSTGVFVSAAFTLLEDGDEVVLFEPFYGYHRNILELTGATIRYVPLGGPDATFDRSAMEAVLTDDTKAVVVNTPANPSGKVWTREELSTLAGLLHAHDLVAITDEIYEYMLYDGAEHVSLASLPGAYERTITLSGFSKAYNVTGWRLGYGVAPAPIAEKIGLMNDLLYICAPRPLQHAALAAFEDLDDDYVAQLQADYAERRELLCETLEAIGFDVPWPDGAYYVLAHFGDLAGTQAGFADDAAACDTLIEDAHIGSVTGRSFYHDPADGQHELRLCFAKELPVLRRACEQLRAAFGG

SEQ ID NO: 18104 - protein, 452 aa, Roseovarius nubinhibens ISM
MAQWTDSLPEAANAYLEGRRLDEVECIVSDLPGIARGKAVPASKFARQDYFHLPDSIFYQTITGGWAEAAGDEGFIERDMLLRPDMSTATAAPWTADWTLQVIHDAFDKTGAPIPYSPRNVLKRVVQLYRDQGLEPVVAPEMEFFIVARNIDPAQEIQPMMGRSGRPAAARQSYSMTAVDEFGPVIDDIYDFAEAQGFEIDGITQEGGAGQLEINLNHGDPVALADEVFYFKRLIREAALRHGSFATFMAKPIADEPGSAMHIHQSVLDLKTGENIFSTPEGEETDAFRHFLGGMQKHLPAAIAVLAPYVNSYRRYVKDHAAPINLAWARDNRTTGLRIPISGPKARRIENRLAGMDCNPYLGIAASLACGLLGMMNKVEPAAEFHGDAYEGDEDIPRVQGEALDLFEEATDLHEVLGREFARVYAIVKRAEYDEFLQVISPWEREHLLLNV

SEQ ID NO: 18105 - protein, 437 aa, Salinibacter ruber DSM 13855
MSSNQRFKLFSDPVHGFISVPKNVIMDLVQTPEVQRLRRIRQLGVGHLVFPGAEHTRFNHALGAMALMQDALANLTEKGTPVRPEEQTAALAVALLHDVGHGAFSHTLEHELIEDFSHEDMSRVLLTDLNERMDGALDLALAMFDDTYDRPFFHQLVSSQLDMDRLDYLRRDSFYTGVAEGEVGVQRLLKTMRVHPLSGGADAEVMIEAKGIYAVENFLISRRLMYWQAYLHKTVLAGDELLRGILRRAQTHLDAGPAPDWLQRGSRALLFFLDHDVHADAIETPEVRDHYLQLDDTDVLFSLKQWMRGPDPVLADLCHRFVNRVFLRVRFLSERPDEAQIDAWRADVADWLVAEGLVPRSEAAAAARHYLTLNVSRHTAYDSDEELIGILGRDGTARELSEMADTTTISDLTGFVEKPYVCFPKPVDLELGAVSEG

SEQ ID NO: 18106 - protein, 81 aa, Narcissus pseudonarcissus
TNGDQRTATDAYHFLVNWFERFPQYKFRDFYLAGDSYAGHYVPQLSQLIYRKNKVIQNPFINFKGFMVGNAVTDDYNDLVG

SEQ ID NO: 18107 - protein, 271 aa, Synechococcus sp. CC9605
MRPSDLTRFKQKGQPIAVLTAWDSLSAALAEAAGADVLLIGDSLAMVALGHATTLPVSLDQMLHHTQAVARGLTTMPADQPLLVCDLPFLSYQCGEDRAVAAAGRLLKESSAAAVKLEGAEPEVVAVIDRLVRMGIPVMGHLGLTPQAVHRLGYRRQATDAISQERLLEQACTLEQKGCFSLVLEHVPAELACRVQQALTIPVIGIGAGDDCDGQVRVTADLLGLTAKQPPFSPALVDGRRLFIDALKGWVNQTRNHTPPTNGRITQADRT

SEQ ID NO: 18108 - protein, 108 aa, Glycine max
MFFQIIQGVFTGVEALALLAFAGITLGGSAVGLALSTPLFILFSPILVPATIATTLLTTGFTTSGGLGMVALRIFWKLFKRLRKKGKGTPKIPGLAPGAPDSDPVSGG

SEQ ID NO: 18109 - protein, 341 aa, Parvularcula bermudensis HTCC2503
MKALVKAHAEPGIWLQTVPEPEIGATDVLIKVKKTAICGTDIHIYEWDDWAQSTIPVPLTIGHEFMGEVVAVGSDVTNVALGDRVSAEGHITCGVCRNCRAGKRHLCRNALGLGVSRAGAFAEFVAVPAFNIYHLPDAVSDELGAIFDPFGNAVHTALSYDLVGEDVLITGAGPIGAMAAAIARFVGARHIVVTDINDFRLDLAAQMGATRTVNIGREALPDVMAELGMTEGFDVGLEMSGAAAGFRDMLDTMNHGGKIALLGLLPKGTGIDWSKVIFKGLDLKGIYGRRLFETWYKMGALTQSGLDLSPIITHRLPIEDFENGFEIMRSGRSGKIVLEWP

SEQ ID NO: 18110 - protein, 355 aa, uncultured candidate division OP8 bacterium
MAILRANWGASGLEAFVCFLRRWIMDARFDVVGIGNAIVDVLAHADDAFLTRHAMTKGSMALIDAAAADALYAAMEPGIECSGGSAANTIACLASLGGRGAFIGKVRDDELGKVFHHDIEALGVHFPTTPASAGASTARCLINVTPDAQRTMSTFLGACVELGPNDVDEDVIRASKVTYLEGYLWDREEAKAAFVKAAELAHAAGREVSLSLSDAFCVDRHRTSFIELVEGHVDVLFANEDEIKSLYQVDTFDAALQHVRGHCKVAALTRSAKGAVVVAGEEIHIVDAEAGVKVVDTTGAGDAFAAGFLHGYTSGGHNDLAQCARIGAMAAAEVIGHFGARPETPLNELVAKKLG

SEQ ID NO: 18111 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 18112 - protein, 237 aa, Caulobacter crescentus CB15
MPTLVLLRHGQSQWNLENRFTGWVDVDLTAEGEAQARKGGELIAAAGIEIDRLFTSVQTRAIRTGNLALDAAKQSFVPVTKDWRLNERHYGGLTGLNKAETAEKHGVEQVTIWRRSYDIPPPELAPGGEYDFSKDRRYKGASLPSTESLATTLVRVLPYWESDIAPHLKAGETVLIAAHGNSLRAIVKHLFNVPDDQIVGVEIPTGNPLVIDLDAALKPTGARYLDDSRAEALPKVG

SEQ ID NO: 18113 - protein, 320 aa, Burkholderia thailandensis E264
MNVATRPPTPANDGPLIDRARVDAQLAPAAREWSIEIVDTTGSTNADLGARLKTLPRRRDALAAPIARIAYEQTAGRGRQGRPWFAKPGDALLCSVACVLPHPVGALAGLSLAVGAALADAFAALPAAPGDAPRAGVGGAAPRIALKWPNDLLVATARDGEAAIVGKLAGVLIETVWNMSDATAVVIGFGVNVRAADTAAAEVDALRARDATLAGGLPPVALAAVRAGATLTDTLAAALNALAAALPAFAAEGLAPFAARWNALHAYAGREVVLLERGAELARGVAVGIDETGQLLLDTPAGRQAIAAGDVSLRAPGAPR

SEQ ID NO: 18114 - protein, 393 aa, Rubrivivax gelatinosus PM1
MKLARRLDRIEPFYVMECAKAAARIAASPACDPARGGEPMIYLNIGEPDFTAPAPVLEAAQRCLAEGRTQYTPATGLPALREALSRWYAQRFALDIDPQRIVITAGASAALQLACLALFESGDEVLMPDPSYPCNRHFVAAADATPVLLPCGPVQRYQLDAAGVERAWNARTRGVLLASPSNPTGTSIAADEMQRIAQAVRARGGVTLVDEIYLGLSYDAAYGRSALAHGDDVVSINSFSKYFSMTGWRLGWLVLPPALVAPVEKLAQNLFICPSSVAQHAALACFEPASIAEYERRRAAFRARRDYIVPALASLGLPVPVLPDGAFYAWADCSTHAGSSWDLAFALMDSAHVALTPGRDFGRHGTEHHLRLSFASSLPQLEQAVARLRRVLA

SEQ ID NO: 18115 - protein, 364 aa, Rubrivivax gelatinosus PM1
MALSPVPELIAELAAGRMVILVDEEDRENEGDLVMAAEHVTPEAINFMARYGRGLICLTLTRERCERLQLPPMAARNGTQHGTAFTVSIEAASGVTTGISAADRARTVQAAVARDAKASDLVQPGHIFPLQAQDGGVLMRAGHTEAGCDLTLMAGLTPASVICEIMKDDGTMARLPDLVLFAREHGLKIGSIADLIEYRSRNESLITRVAQRVLVTPQGPFDCQAFRDRSGAVHLALSVGQWGADDEVLVRVHEPLSVLDLLDAGRCGHSWPLPRALAALRAAERGVAVLLNCGEAGNGLLQQLTVGPDAPPTPRGQMDLRTYGVGAQILRELGIVRMKLLGSPRRMPSMVGYGLEVTGFVAAE

SEQ ID NO: 18116 - protein, 412 aa, Agrobacterium tumefaciens str. C58
MLFPSHRKITQMPSTADRLKNVSISASAAMTQRARELAAKGIKVVSLSSGEPDFPTPAHAIEAAHAAALNGETKYPPMDGTVAMKAAISRKFKRDNNLTYDASQIVVSAGGKQVIFNAMLATCNPGDEVVIPAPSWVSYADIVKFAGGVPVPVPCFEQAGFKLRAEDLEAAITPRTKWLFLNFPSNPTGAACSRKEMAAIAEVMLRHPHVWILTDDIYEHLVYDGFEFGTIADVEPRLYDRVLTMNGVSKAYAMTGWRLGYCASGSKELITAISNVNGQNGGGITTVTQAAAIAALDGPQDLLKERAAIYRERRDFVLGQLAEIDGLRCHKPEGAFYIYPNISGLIGKTTKGGRKIESDVDFVMALVDEHHVATVQGAAYGMSPYFRLSYATSMEMLGEGCARIAQFCRDIR

SEQ ID NO: 18117 - protein, 340 aa, Brassica napus
MDHEADAFRTDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 18118 - protein, 383 aa, uncultured archaeon GZfos35B7
MTVIADRVSQIEGSGIRKFFDIAQRMEGVISLGVGEPDFVTPWTIREACIFSLEKGYTSYTSNWGLLELREAISDKIYEESGVFYDPEGGILITTGVSEAFDLALRAIINPGDEVILHEPCYVSYKPCTVFAGGTPVCVATGVEDKFELRAEEVAEKITDKTKAIILSYPNNPTGAALSKKDLEEIADVATEHDLIVISDEIYDKLTYEGEHTCFSSLNGMEERTILLNGFSKAYAMTGWRIGYAAGNKAIIEAMMKIHQYIMLCAPITAQMAAIEALRCDDETDRMVSEYNRRRRLMVAGLRELGLSCFEPKGAFYTFPSIEDTGLTSEEFAERLLKEEKVVVIPGSVFGDCGEGYIRCSYAVSQYELKEALERMGRFLDTL

SEQ ID NO: 18119 - protein, 575 aa, Synechococcus sp. RS9917
MANAALPALLKELYPTHCLEDLETLSSQLLQSAGHRSANAHGSAAAQERWHAGTCVLITYADTVVAEGQPALRQLQRLLEGPLAGLSSVVHVLPFLKATSDGGFAVASHEALEERFGDWDDLAALAAGRQLMADLVLNHVSASHPWVRAFQRGAEPGSRCVLAASADPCWDRVVRPRSSALFTTLATDRGPETVWTTFGSDQVDVNWRQPEVLIGFTRLLDRFCAHGVSWLRLDAVGFVWKEPFTDCIHRPEAHRLVEVLRLLLGARCRRGVVVTETNVPEQENLSYLRSGTEAHLAYNFPLPPLLLEACISQRADLLNRWLARWPKLPAGTGLLNFSACHDGVGLRPLEGLMAEERLLRLLGACEQRGGLVSHRRLADGRDVPYEINISWWSAMESAGRDPAHRQRERFLLSQLFVLALPGVPAFYLPAVLATANDKARFRRTGHRRDLNRPQFQIERLERLLADPQSDASRVLASMRRAMALRRTQNALAPSASMTLLSGGRADCVVVQRGSGEDVLLAVHNFSEVRLSLSLTNLVQAPAGRCWHDCLADASLPDGQQWIDLEPFAVQWLIPR

SEQ ID NO: 18120 - protein, 648 aa, Kluyveromyces lactis NRRL Y-1140
MPPKETTKKWKPPKGPKPIQRKNKNTIGLGKAIQTARRKENEVQYLPDGEERFTTDKHEANWVKLRSVTQESALDEFLSTAELADKDFTADRHSNVKIIRMDNGADAATSQGFSLTNEQKSKINEKQRLHARELIVPRRPKWNESMTRFELERLEKEAFLEWRRKLAYLQEDNEDLLLTPFERNIEVWRQLWRVVERCDLVVQIVDARDPLLFRSTDLEKYVKEVDDRKQNLLLINKADLLTRKQRIIWAKYLLSRGISFTFFSAAKANEILERQEELGDEYVEEEDDEEILATEEEIEELDGEEVNKEILDKINILKIDQLEELFLDKAPNDPLLPPLPGQEPIIQIGLVGYPNVGKSSTINALVGAKKVSVSSTPGKTKHFQTIKLSDKVTLCDCPGLVFPNFAYNKGELVCNGVLPIDQLRDYIGPSTLVAERVPKYFLEAIYGIHIQTKSVEEGGNGEVPTAQELLVAYARARGYMTQGFGAADESRASRYILKDYVNGKLLYINPPPHMDDDTPYTREECKEFNKDLYTFSKLPINRQEQLAEAAKHKGIQDLDLARDLSRLTFSAHIGGDGDKVQAKSVNHGGKQAALYNVADELDKNFFHLNGVQGRLTNPFHKQTVANENGKKHNKKNKKSKKKASMFSD

SEQ ID NO: 18121 - protein, 250 aa, Lactococcus lactis subsp. lactis Il1403
MNDKLEKSIILQKNPWLTDVKIVAESESTQKDAKLDGQENCLYLTERQNKTYGRFGRQYFAAPSGGIYMSLSLKPKVELEKLPEFTLLTGAAIVSAIEKLTDKKPQIKWVNDIYLDDKKFVGILAETSLNPTQEAQVIIGVGINFSISQFPTEIEERATSLFYNEQANISRSELIAKIWSEFHRLSEGSFFEIYKSHSFILGKQVEFVQSGQTFSGRATDLTPKGELIVNLDNGQQKILSSGEISLKKWT

SEQ ID NO: 18122 - protein, 340 aa, Debaryomyces hansenii CBS767
MAPKKKPQISDKNKAKAKTKAVGDKTFGLKNKNKSKKVQGQINQIEAGADGGLAKKKEAEAKRRAAEKKAAEEAKKETAALYGIQQPKVPFGVDPKSVLCEFFRKGVCAKGPKCKFSHDLNVGRKDLKKDLYTDARTEKEEDTMDKWDEEKLRKVILSKHGNLKTTTDIVCKYFIDAVENGKYGWFWVCPNGGNECKYRHSLPPGFALKTKEQKRLERLASESAPKISLEELLELERGKLDRSKFTPITLDTFAEWKKKQIAKKADEKKREEERNGRKVLTGREIILNKFADNSYTEEDNTDQGTEWDLSEFRKNLPETEDSFKDYGDGIVDFEKKPNQE

SEQ ID NO: 18123 - protein, 292 aa, Zea mays
MPGDAYDLLCAEDDAAGSALLCTTDDDDGCCSAVEDDSAAAAAASIAELIGGEAQYSPRPDYPDRLRSRSIDPAARAESVAWILKVQEYYGFLPLTAYLAVNYMDRFLSLHRLPVEGTSRYDCFEPGTVGQMELLVLMALNWRLRSVTPFTFVDFFACKVDPGGRHTRCLIARATQVILAAMHDVEFLDHCPSSMAAAAVLCAIGETPSLESVSPGAAVSWCIGLAEEGISSCYRLMQRLVIGNVRTRVASTTTITMAAVNLCCSDEALSSHSSATSSPPPAKRRKRSPTAT

SEQ ID NO: 18124 - protein, 85 aa, Trichodesmium erythraeum IMS101
MNLEQVESMIKAKLPDAQVEVQDLTGGGDHLQAIVVSSEFEGKTLVKQHQMVYAAVKEPMASEAIHALALKTYTPEEWKTAGQTA

SEQ ID NO: 18125 - protein, 239 aa, Debaryomyces hansenii CBS767
MSSGASLVEKAKKSAAYQAVDENFPEGAKVVGVGSGSTVIYVAERISQLKNKESFVCVPTGFQSKQLIIDAGLRLGTIEQYPEVDIAFDGADEVDTELNLIKGGGACLFQEKLVAAAASKFVIVADFRKRSPSKLGIQWRKGVPIEIVPCAYAKVSKDLEAMGAKKVELRQGGSAKAGPVVTDNNNFLIDADFGEIEDPAKLHTDIKQLVGVVETGLFVQMAYKTYFGEESGEVKCWSK

SEQ ID NO: 18126 - protein, 517 aa, Schizosaccharomyces pombe
MLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRDFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 18127 - protein, 143 aa, Zea mays
  misc_feature (11)..(11): Xaa can be any naturally occurring amino acid
  unsure (1)..(143): unsure at all Xaa locations
ADNVMFEGILXKPSMVTPGAEHKNKASPETVAEYTLTMLKRRVPPAVPGIMFLSGGQSEAEATLNLNAMNQSPNPWHVSFSYARALQNSVLRTWQGKPEKIEDSQKALLVRAKANSLAQLGKYSAEGENEDAKKGMFVKGYTY

SEQ ID NO: 18128 - protein, 186 aa, Arabidopsis thaliana
  misc_feature (125)..(125): Xaa can be any naturally occurring amino acid
  misc_feature (177)..(177): Xaa can be any naturally occurring amino acid
  unsure (1)..(186): unsure at all Xaa locations
MQLQTQSFALNLLPSPNFAKPIERREFISLKRDPSRPISLRCSVSTTLDTPATASTHKPFPAEVSRSIMELSSVGTLSTLTHDGWPLGVGVRFAVDKDGTPVLCLNRSVSPDKRSALHVQVLICXFHSVSSLKKWQSLLLFGGTIMHCVCLWNQLEQCGLRTPQCTIPGSIGRPGEXTVLKRLSAT

SEQ ID NO: 18129 - protein, 310 aa, Burkholderia xenovorans LB400
MKILIPDLMTADSRERMAREHDVIYEPALVTDLPALLRVAPGADCLIVRNRTQVRGELLAALVRCRVVGRLGVGLDNIDLEACAARGIEVIPAIGANALAVAEYVMTAALSMLRPWFAASAAVLDGEWPRAALVQGHEIAGKTLGVVGFGSIGRETARLGAALGMRVIACGSGTQLAGAMTNGVRMTSFDDVLTTSDVISLHMPLTGTTRNLIDSRALAAMKPGAILINAARGGIVDETALADALRSGHLRGAALDVFTAEPLGAGSALRDAPNLLVSPHIAGVTDESETRVCDLVARRVMEALASLRPV

SEQ ID NO: 18130 - protein, 390 aa, Bacillus clausii KSM-K16
MTSYSRLSDRVSEIKPSGIRRFFDLASQMENVISLGVGEPDFVTPWNIREESIFSLERGYTAYSANAGLIELREAISHYMETRFAVSYNPDTEILVTVGASEAIDLGMRAILNEGDEVIIVEPTFVSYAPLVTMAGGVPVPVGTSAETNFEVRPADIEAAVTDKTKAIMICYPNNPTGSSISKKCLEDIAAIVRKHNLFVFSDEIYAELAYDKEHVCFATLPGMKEQTIVINGFSKAFAMTGWRVGFALAPPDLLGAMLKIHQYSLMCAPTMAQYGALEALQHGMDDVERMKLSYQQRRNFFVKTAKEIGLPCHHPDGALYAFPSIAHTGFTSEEFAEALLKEERVAVVPGSVFGEGGEGHIRCSYATSLTHLEEALERIGRFLRRLELR

SEQ ID NO: 18131 - protein, 169 aa, Triticum aestivum
MAPTVMASSATAVAPFQGLKSTATLPVARRSTTSFAKVSNGGRIRCMQVWPAYGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 18132 - protein, 354 aa, Trichodesmium erythraeum IMS101
MVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 18133 - protein, 144 aa, Glycine max
EHMPDKAKFVGELARVAAPGATIIIVTWCHRELGPDEQSLHPWEQDLLKKICDAYYLPAWGSASDYVKLLQSLSLQDIKSEDWSRFVAPFWPAVIRSALTWNGLTSLLRSGLKAIKGALAMPLMIKGYKKNLIKFAIITCRKPE

SEQ ID NO: 18134 - protein, 135 aa, Brassica napus
DAWVNGCVNVTDNTVSAVSFSHGSTLESLSLDGCKNITDASLVTVAKNCYSVNDLDVSNTLVSDHGIKALASSPNHLSLQVLSLGGCSGITDKSKACIQKLGRTLLGLNIQRCGRISSSTVDSLLEQLWRCDILY

SEQ ID NO: 18135 - protein, 583 aa, Aspergillus oryzae
MSRRATPGQAAQNQQTIKGLLKLEHNKICADCKRNKHPRWASWNLGIFVCIRCSGIHRGMGTHISRVKSVDLDSWTDEQLQSVMRWGNARANKYWEAKLAPGHVPSEAKIENFIRTKYESKRWIMDGPMPDPSTLDDGDDDVPLAVVQEKAKIERSASQRVAASSQPPAAHRQQASIDLFADDDIAPPARPSTTDPTPRAAPKQPQSAPKPTRPGDSLLGLDFFGSAQPAANSHPSSTASTPGGSTGISRPDLKQSILSLYSKPQPAPAQHGRTSSFGDFGDLASPAPPSASPSSNLGGLTDAFSGLSFPSTTSPPPQKPAEKSSPFANLTSFATKKSSPAAPKVSSPTASAGSGGGSLFDSLASPTIPAAKPQSRTTSISSNGFDSGFTSFASPPPSKPNPPPSSSLSNDLFGLSSPAPVAPSKVSSPPAPTAISPQNELKAAFNLNPPVPAPVSAAPKPSMSATTASIASALPASIDPWGGGNAWSTPDPAPAAEPSGPSMMKVPDTLTANDIGAGWGATASTSGGSKQAPTVAADEDFGGWTSAAPISSTTAATTTNMSVPSKPAGGFSGADDLFSNVWE

SEQ ID NO: 18136 - protein, 311 aa, Triticum aestivum
NTNFGSPVMEAGNLEFGEKECTNYLQEKRSLKLGAGDAHALYQYFLRMQSKDPAFFHVMDVAEDGRLRNVFWADARSRAAYESYWDVITFDTTYLTNKYRIPLATFVGVNHHGESVLLGCGLLSNEDTETFVWLFKSWLCCMSCKPPNAIVTDQCKPMQNAIEEVFPQARHRWCTCHIMKKIPENLSGYENIKSSLSNVVYDSLTKHGFDKAWVEMINKYDLQDNEWLAGLYDNKNLWVPAYVKDTFWAGMSSTKRSESVNAFFDGYVNARTTLKQFVEQYENALREKVEKENKADSKSFQEQIPCITHYD

SEQ ID NO: 18137 - protein, 371 aa, Idiomarina loihiensis L2TR
MSLHSTEEIIEDIRQGKMVILMDDEDRENEGDIIIAAECVTPETINFMARYGRGLICLTLTEERCEQLNLPLMVDKNNAPYATSFTVSIEAAEGVTTGISAADRAKTVLDAVKKDAKPEDLVMPGHIFPLKAKSGGVLNRAGHTEAGCDLARLAGFEPAAVIVEVLNEDGTMARRADLEAFSEEHGIKVGTIADLIEYRSIQEKTIERVAECNLPTAFGKFRLITYQDTIDEQVHYALVHGDLSQDKVTNVRVHLQDTFHDTFLTERAAKRSWPIQKAMSYIAEHDGVLVIIGRQQTPESIIAQVCEFEAQDKGEQKPTTSASNASRNVGLGSQILADLNIHKMHLMSSPKRYSALSGFGLEVVDFIEDKD

SEQ ID NO: 18138 - protein, 502 aa, Mycobacterium bovis AF2122/97
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 18139 - protein, 511 aa, Desulfovibrio vulgaris subsp. vulgaris str. Hildenborough
MSLKPTLLLILDGWGKAPAGPGNAVTLAGMPHLSSLLRQAGCTELACSGRAVGLPEGFMGNSEVGHMNIGAGRVVYQDMTRIDIAVERGELASNPALTGLFEAVRATGGRVHLMGLLSDGGVHSHIAHVEALALAARDAGVEVVVHAFLDGRDTAPTSGVGYVKRLASFLESNRAGRIGSLVGRYYAMDRDKRWDRNLLAWAMLTRGEGAPADDPVGAVEAAYAAGETDEFVKPRVVVEGGSPIGTIRDGDGVFFFNFRADRARQLSHMFVDGTFEHGDRGHVPSLAGFATMTSYDPALGLPVAFDKQPLDGTLGEVVANQGLRQLRIAETEKYAHVTYFLNCGREEPFPGEERRLLPSPRDVATYDLKPEMSAEAVTDTLLEEWAGGGYTLAVCNVANLDMVGHTGVIPAAVRACETVDACVRRIADAVLASGGRLVITADHGNAEELLDESGNPQTAHSMNRVPFTVVEQGRVHTFREGGVLGDIAPTILGLWGVPASAGMTGTSLITE

SEQ ID NO: 18140 - protein, 320 aa, Desulfitobacterium hafniense DCB-2
MAQYTVLSTSPTFTKYSPQAAGILEKKGCRLVMIPPNGLREREDFKAVLAEAHVWVVGINKVYAEDLEAAPNLKLIIKHGTGVDSIDLKAAAARGITVANAPGTNANSVADLAFGFMLSLARQIVSADKRTRDGFWGTVMGKDVYGKTLGVLGLGQIGKGVIRRASGFDMNILGYDLVHHSQFEKEYRVRAATLEEIMSEADYISVHLPLLESTKNIIDRSLLEKMRPTAFLINTSRGGVVDETALYDLLKEKRIAGAALDVFATEPPRQSPFFELDNVIVAPHMGAYTEGAMGAVSEILAESIVRVLAGKEPLSVIKTN

SEQ ID NO: 18141 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 18142 - protein, 276 aa, Leccinum duriusculum
  misc_feature (143)..(152): Xaa can be any naturally occurring amino acid
  misc_feature (177)..(177): Xaa can be any naturally occurring amino acid
  unsure (1)..(276): unsure at all Xaa locations
INIVAVNDPFINLDYMVYMFKYDSVHGRFKGDVHAKDGKLYINGKAITVYAERDPANIKWGAVGAEYIVESTGVFTTIEKAAAHLKGGAKKVIISAPSADAPMFVCGVNLDKYDPKYTVISNASCTTNCLAPLAKVINDKFGXXXXXXXXXXATTATQKTVDGPSAKDWRGGRAVNXNIIPSSTGAAKAVGKVIPTLNGKLTGLAFRVPTNDVSVVDLVVRLEKSASYDDIKAAVKAASESPELKGIIDYTDEAVVSTDFTGNPASSIFDASGGSM

SEQ ID NO: 18143 - protein, 497 aa, Legionella pneumophila subsp. pneumophila str. Philadelphia 1
MLLKIPAKMQVNYATIWNVMTTPLYPIILAGGSGTRLWPLSRQNFPKQFLKLNGELSLIQQTMKRAMGLPGNQTIIVSNDAHYFICQDQLQDFNAQTTYLLEPCARNTAPAIACAAHYLANTVGKDAVMLVLPSDHWIADDEIWLAAMLEGGQFASENNAIVTFGIKPDSPKTGYGYIEAGTTLSSDIKQVLSFREKPDAHTAAQFVSKGNYFWNSGMFICRAGVYLEELEQFEANIYQFSQQALTLAQHHHDFLRLDLDCFSQCKEESIDYAIMEKTDKAVVIPISIQWSDLGCWTAVADANKQDEQGNTLIGNVIAQDSHNCLINSEELLVTTVGIQDQIIVATSDAVLVADKRYSQQVKDLVHSLRKDHPHLTQDHQRVPRPWGYYEVLAEGTSFKVKRLMVKPGAKLSLQTHQHRAEHWVIVGGEAEVVNGNNTFRLSKNQSTYIPKNALHRLSNPHNEPLYVIEVQSGSYLGEDDIKRFDDIYLRKEVELAE

SEQ ID NO: 18144 - protein, 265 aa, Triticum aestivum
  misc_feature (199)..(199): Xaa can be any naturally occurring amino acid
  misc_feature (206)..(206): Xaa can be any naturally occurring amino acid
  unsure (1)..(265): unsure at all Xaa locations
MSAFVGKYADELIKTAKYIATPGKGILAADESTGTIGKRLASINVENVESNRQALREMLFTAPGALEYLSGVILFEETLYQTAADGTPFVDILKAGNVIPGIKVDKGTVDIAGTVGETTTQGLDSLGARCAKYYEAGARFAKWRAVLKIGPGAEPSELAVKQNAEGLARYALICQENGLVPIVEPEILTDGPHDIQACXAATERVXLAPAFRSFNDHQVPPQGTFLSPLGHPRSNSPSWREVKRDHCGRLCHCAAGCPGVSFCAK

SEQ ID NO: 18145 - protein, 524 aa, Zea mays
  misc_feature (501)..(501): Xaa can be any naturally occurring amino acid
  unsure (1)..(524): unsure at all Xaa locations
MKPTTSSTLLLAAAVLCLALPLLPGATAKAARARQGDYLARLRGSSPWPAESASLAVAATDRASRHAASPGVGRKEDDRVDRLPGQPSGVDFEQYAGYVTVDAAAGRALFYYLAEAVGGGSASAAKPLLLWLNGGPGCSSLGYGAMEELGPFRVKSDGKTLYRNPYAWNNAANVLFLESPAGVGFSYSNTTEDYSRSGDNKTAEDALRFLLNWMEKFPEYKGRDLYLAGESYAGHYVPQLAHAILGHAAAGKPSSSSPLNLRGIMIGNAVINDWTDTKGMYDFFWTHALISDATADAIGRHCNFSAAADADAAASNDKCNEATSEADEALQDIDIYNIYAPNCQSPGLVSPPITPSMDRFDPCSDYYVNAYLNDPDVQRALHANVTRLDHPWSACSDVLRRWTDSATTVLPILTELLNNDIRVWVYSGDTDGRVPVTSSRYSVNQLQLPVAAKWRAWFSSTQGAGEVGGYAVQYKGKEKGSLSLVTVRGAGHEVPSYQPRXALVLVQGFLAGKTLPDCKTCESA

SEQ ID NO: 18146 - protein, 287 aa, Oryza sativa
  misc_feature (107)..(107): Xaa can be any naturally occurring amino acid
  misc_feature (120)..(120): Xaa can be any naturally occurring amino acid
  unsure (1)..(287): unsure at all Xaa locations
MDFLACVCLLHLLFLATSRVAAQASSPARALDAMLQDHAYRAFVHPHTGIVYNATVPANLTGVALSAVRLRSGSLRRKGFSDYFDFTVPTGIVVQPYVERVVLVYHXLGNWSDHYYPLPXAELVASGSPISINFSDVRSVPAGGPAPRCVWFDLDGVPQFRDLEASNVCSTYRRGHFSIVVNSSAIPPGPVPSGNITPPIPTPTGRSKGSSKGWKIAVGVVGGVIALVLLASLVVCLARYKRDKKLELMEQNAETGETLRMAQVGRSQAPVALGTRTQPVIESEYVA

SEQ ID NO: 18147 - protein, 404 aa, Prosthecochloris aestuarii DSM 271
MPYTHSPVFTPAQRVQNYNYAIRNIVTHARKLEAQGKKITYLNIGDPVLYGFQPPEELIEANVLALRHGHNGYSPSSGRKEAVEAIAEDACRRGISTSPDNVIITFGASEAADLVCTSMLNPGDEVLCPSPGYPLYNAIIAKLNAREVRYSLDPANDWLPDPEQVEKSITPRTKILVVINPNNPTGELYSRETLDMFVDIARRHKLLIITDEVYHKLVYEGEHIPLASLASDDVAVITIDSLSKNYMAPGWRTGWLMITNSALIPDVRQAFIKLADARLCAPMAPQYTIKAAMTMGPEYNETILSRLRAQRELTIDRLNAIEGFSCNKPSGAFYVMGKLDLDATPFKTDEEFVLKLLQEKQVLFVHGSGFGTDPASGYARIVYLPDVTILEKVYADVADFINSL

SEQ ID NO: 18148 - protein, 360 aa, Bacteroides fragilis NCTC 9343
MTSKDNYCVIMGGGIGSRFWPFSRKTMPKQFLDFFGTGRSLLQQTFDRFNKIIPTENILIVTNAIYADLVKEQLPELDPKQILLEPARRNTAPCIAWASYHIRALNPNANIVVAPSDHLILKEGEFLAAIEKGLDFVSKSDKLLTLGIKPNRPETGYGYIQIAEQEGDNFYKVKTFTEKPELELAKVFVESGEFYWNSGLFMWNVNTIIKAGETLLPELASKLAPGREIYGTPEEKDFIEENFPACPNVSIDFGIMEKADNVYVSLGDFGWSDLGTWGSLYDLSPKDEQRNVTLKCDSLIYNSNDNIVVLPKGKLAVIEGLEGFLVAESDNVLLICKKDEEHAIRKYVNDAQMKLGEDYI

SEQ ID NO: 18149 - protein, 516 aa, Escherichia coli CFT073
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFLSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 18150 - protein, 458 aa, Methanococcus maripaludis S2
MSKLKIIRDPIHKDIKLNEEEISIVDMPEIQRLRNIKQTGLTCLVYPSANHTRFEHSIGTMHVAGEIAKNLENIDKNLTKIVALLHDIGHPPFSHTLEVAGYDHEEFTKEKIKRMNFENYTSKEVLDVYSSKGLEGSLIHGDVDADRMDYLVRDSHHTGVAYGSIDIPRLIRSIVVIEDTNKLGIIEKGRTTVESLLTARYQMYPTVYMHPTSRISETMIKNATIDAIKDDIFKLRDLSLMDDIDLICTLRRSEGSSNEIMRKIDKRDLFKSISVQRYNELSPKERWNLINLSENELGIIENEMSDFFGSRIFLDIPKPPKMAEHRITVIMGDKKQRLDEISPLAESLKDAYKKSWSVMVYSEPETAKKSSEIVKDKNKFLFDFISDEIIDNSILNVLNEQGTVQGVTKLAGLVKKSPNDTEFHSELQKLIFCGLVDKKVEPVRGTYRYDYTAAKLDD

SEQ ID NO: 18151 - protein, 463 aa, Pseudomonas putida KT2440
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 18152 - protein, 788 aa, Methanococcus maripaludis S2
MVDLMVAEAYQGDVGKGIVRIDPLTMEKLSLKAGDAIEIAGKEKTYATVWRGYLEDQGKGIIRMDGILRQNTKAGIGDKVKITVVEVKEAKKITLAPMQAVRFSTGFESYVGSRLVEQVVDKGSKVVIGVLGTAFPFIVTGTTPKGPVKINEYTQIELKTEPVTELKETKVPNVTYEDIGGLKEEVKKIREMVELPMRYPELFDKLGIEPPKGVLLAGPPGTGKTLLAKAVANEAGANFYTINGPEIMSKYVGETEENLRKIFEEAEENSPSIIFIDEIDAVAPKRDEASGEVERRMVAQLLTLMDGLESRGQLVILAATNRPDSIDMALRRPGRLDREITIGIPDRHGRNEILQIHTRNMPLQPDYEKSDVISILNELVGEYDRSKIESLVKLVEKASSEEEIEKILKDGEVEDKVKVKLNQLMVKELADKTHGFAGADLAALSKEAAMKTLRRFLPDIDLEKEEIPREVLDKIKVTKEDFVGGLKEVEPSALREVLVEVPNIKWSDVGGLEDIKQDLKEAVEWPIKNKEMFERMGIRPPKGVLLFGPPGTGKTLLAKAVANESEANFISVKGPEIFSKWVGESEKAIREIFRKARQAAPTVIFFDEIDSVAPKRGMDFGSSGVTEKVVNQLLTELDGLEEPKDVVIIAATNRPDILDQALLRPGRLDRIVLVPIPNETARLEIFKVHTKGMPIGKDVNLEKLAKETKGYTGADIEAVCREAAMIALRENINSEHVESRHFDGAFKRIAPSVKDDDMDEYKDLAKEYGQNAGVSEIEKGPENTGYHG

SEQ ID NO: 18153 - protein, 92 aa, Idiomarina loihiensis L2TR
MARAHALHILVETKDEAEKLKEQLTKGAKFAELARKHSLCPSGKKGGDLGEFSRGQMVPAFDKVVFGKPTLEVHGPVKTQFGWHLIKTLSRS

SEQ ID NO: 18154 - protein, 520 aa, Triticum aestivum
  misc_feature (8)..(8): Xaa can be any naturally occurring amino acid
  misc_feature (79)..(79): Xaa can be any naturally occurring amino acid
  misc_feature (435)..(435): Xaa can be any naturally occurring amino acid
  misc_feature (445)..(445): Xaa can be any naturally occurring amino acid
  misc_feature (472)..(472): Xaa can be any naturally occurring amino acid
  misc_feature (485)..(485): Xaa can be any naturally occurring amino acid
  unsure (1)..(520): unsure at all Xaa locations
FGLGSAQXLVTTAAVGLAAHRFAALPGPAAIVVGSGLALSSTAVVLQVLQERGESTSRHGRATFSVLLFQDLAVVVLLXLIPLISPNSSKGGVGFQAILEAMGMAAVKAIAAITAIIAGGRLFLRPIYRQIAENRNAEIFSANTLLVIFGTSLLTARAGLSMALGAFLAGLLLAETEFSLQVESDIAPYRGLLLGLFFMTVGMSIDPKLFLSNFPAVSLILGLLIIGKTLLVTFIGRVFGVSTIAAVRVGLLLAPGGEFAFVAFGEAVNQGLLSPQLSSLLFLVVGLSMAMTPYLAAGGQFLASKFEQHDVRSLLPVESETDDLQGHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKXGASTVVPETXEQVSIGCAVLLKQNFKSEMHNTTIQNXIADYELVRLTELXTSGSSLGYGFSRVMSKTKPVVSDDESDTIDGALAI

SEQ ID NO: 18155 - protein, 164 aa, Arabidopsis thaliana
MEIDSEKIHERKQSDYNSLDERFEIQKEMYRGQQYSQIYFARLHLMRTLLYSLAPTWKSHLPVCKVLGLEKGKECIIVGTLFKHMKLKPCVLDEYSKERSVTPLVKPHNFMHPDDNLILEDESGRVKLAGSALSPAIYVTGVVVALHGKETNCLNTIKLEREGG

SEQ ID NO: 18156 - protein, 336 aa, Rubrivivax gelatinosus PM1
MTRRISLTQYLVEEQRERGRIPAQLRLLLEVVARACKSIAISVNKGALGGVLGSAGSENVQGEVQKKLDIIANEVLIEANEWGGALAAMASEEMDSIYVVPNRYPQGEYLLLFDPLDGSSNIDVNVSIGTIFSVLKKQSDTPGVSTQDFLQPGSAQVAAGYCVYGPQTTLVLTVGDGVAMFTLDREQGSWVLTTDEVRIPEDTREFAVNMSNQRHWAPPMQRYIDECLQGKDGPRGKDFNMRWVASMVADVHRILCRGGVFMYPWDKREPAKAGKLRLMYEANPMGFIVEQAGGAATNGKQRVLDLQPSQLHERVSVILGSKNEVERASAYHREAG

SEQ ID NO: 18157 - protein, 287 aa, Leccinum vulpinum
  misc_feature (145)..(155): Xaa can be any naturally occurring amino acid
  unsure (1)..(287): unsure at all Xaa locations
EINVVAVNDPFIDLDYMVYMFKYDSVHGRFKGDVHAKEGKLYINGKAITVYAERDPANIKWGAVGADYVVESTGVFTTIEKAAAHLKGGAKKVIISAPSADAPMFVCGVNLDKYDPKYTVISNASCTTNCLAPLAKVINDKFGIXXXXXXXXXXXTATQKTVDGPSAKDWRGGRAVNGNIIPSSTGAAKAVGKVIPALNGKLTGLAFRVPTNNVSVVDLVVRLEKSASYDEIKLAVKEASESSGLKGIIDYTDESVVSTDFIGNPASSIFDASGGIMLNPNFVKLIA

SEQ ID NO: 18158 - protein, 324 aa, Clostridium acetobutylicum ATCC 824
MKIVVLDGYTLNPGDMSWEAFKEIGDLTVYDRTDYTGKEEEKTIERARDAEAILTNKTIITSKVIEKLPKLKYIGVLATGYNVVDLEFAKKKGIVVTNIPQYSTSSVVQMSMALILEICGHVGQHNASVKKGDWQNCADFSYLKYPIIELSGKTIGLVGYGSIGKAMQKAAEALGMKVFVYTPHPDKKYENESMKFVSLDTLFKEADVISLHCPLKDDNKEMINKASIKKMKNGVIIINTARGGLINERDLYEALKENKVYAAALDVVSFEPIKEDNPLLKAENCIITPHIAWATSEARQRLMNIAVNNLKQFVDGCPINVVNK

SEQ ID NO: 18159 - protein, 254 aa, Chlamydophila caviae
MERKSYVFGNWKMHKTAKEAKDFLSIFCPFVKEISPASLVGIAPAFTTLSACCESIKEMDSSIWLGAQNVHQDSSGAFTGEVSLPMLQEFHVNFVLLGHSECRHIFHEEDATIALKVGAAARSGVVPVLCIGETLEARENGTTKEVLSNQLMLGLAQLPETAPVIIAYEPVWAIGTGKVASTADVQEVHAFCREVLSRIFSKEKSEIISILYGGSVKADNAEGFARCPDVDGLLVGGASLDPQGFANVLRNFNL

SEQ ID NO: 18160 - protein, 260 aa, Mannheimia succiniciproducens MBEL55E
MKKYYFGTNLKMYKGIADTTRFLAQLSELTHDIRANNDIELFVIPSYTAIQSAIQTTLATSHDNPIIIGAQNMNPNDNGQYTGDISPLMLKEIGTQLVMIGHSERRHKFGETDRQENEKVLSALKHDLTTLLCVGETLEQKNYNISDEVLRTQLKIGLSGINTNQLAKLRIAYEPVWAIGESGIPATADYANEKHAVIKQCLIELFGDAGKDIPVFYGGSVNAENSNELFGQQYIDGLFIGRSAWDAENFFKIIERIVNK

SEQ ID NO: 18161 - protein, 665 aa, Oryza sativa
  misc_feature (446)..(446): Xaa can be any naturally occurring amino acid
  unsure (1)..(665): unsure at all Xaa locations
MPPFHDYRDGGVLVMEPAASAALFGGVRSRKRARVTAVPPCGFVSAAAEAVEVVEEEGLTAAKRQKQLQQQREAPSLDALPDECLFEILRRVKGARARCASAAVSRRWLALLGGIRSSEIKREPAAAAVPDLNQVFVDEDEEEEDEFEVPLGGGCSSERCLEGREATDVGLMAVAVADALRGSLESLVIRGSHPTRGVTDAGISAAARGCPSLLSLALWHVPQVTDAGLAEIAAGCPSLARLDITGCPLITDKGLAAIAQGCPDLKVVTVEACPGVADEGLKAIGRCCAKLQSVNIKNCAHVGDQGVSGLVCSAAASLAKVRLQGLSITDASLSVIGYYGKAITDLTLARLPAVGERGFWVMANALGLQKLRFMSVSSCPGVTDLALASIAKFCPSLKQLNLQKCGQVSDGRLKDFAESAKVLESLQIEECNNVTLMGILAFLLNXCSPKFKALSLVKCNGINDICSAPAQLPLCKSLRSLTINDCPGFTDASLAVVGMICPQLENVDLSGLGAVTDNGLLPLIKSSESGLVHVDLNGCENLTDATVSALVNAHGNSLARLSLQCCSRITDASLFAISEGCTDLAELDLSNCMVSDYGVAVLASARQLKLRVLSLSGCLKVTQKSVPFLGSMSASLEGLNLQFNFIGNHNIASLEKQLWWCDILA

SEQ ID NO: 18162 - protein, 140 aa, Brassica napus
  misc_feature (132)..(132): Xaa can be any naturally occurring amino acid
  unsure (1)..(140): unsure at all Xaa locations
MSNYSAGLGKPGSGKRRIRDLLNQPDNRVCADCGAPDPKWASANIGVFICLKCCGVHRSLGTHISKVLSVTLDDWSDEEVDSMIEIGGNASANSIYEAFVPEGSSKPGPDVSHDQRLRFIRSKYELQEFLKXPPFRKPLP

SEQ ID NO: 18163 - protein, 304 aa, Triticum aestivum
MEGGSSCRRVALVTGANRGIGLEVCRQLASGSATVVLTARDEKRGAAAVDALRELGLSDVVFCQLDVGEPSSAARLADFLRDRFGRLDILVNNAGVSGVRMDVGDPAALHQVRTSMSAAERLEWFNQKTAEPFEEAEECLRTNYHGTKNVTEALLPLLLSSSDARVVNVSSSYGLLRYFSGEELKHELDDIDNLSAERLDELSGLFLKDFKNGRLDHRGWPVGGFSAYKVSKALINAYTRILAKKHTSMRLNCLDPGYVKTDINFHTGVLTVEEGARGPVMLALMPKEGPTGSYFNGTEQAAFM

SEQ ID NO: 18164 - protein, 395 aa, Anaplasma phagocytophilum HZ
MSDSSDGYAKPMTINFGPQHPAAHGVMRLILEMSGEVIERIDPHIGLLHRGTEKLIEYKTYLQALPYFDRLDYVSPMSQEHAYSLCVERLLGCEVPIRAKYLRVIFCELTRLLNHLLNVACQALDSGATTPLLWIFEEREKILSFYERASGARFHSAYIRPGGLAADVPDGLLDDIHEFTNYFPKLLDSVDDLLTENSIWKQRNVEIGKVTKQQALDWGFSGPMLRACGIPWDLRKSQPYEIYDILDFKVPVGSNGDCYDRYLVRMAEIRESLYILEQCLRDIPSGPVKTDDRKIAPPKREELKYSMEALIHHFKLFSEGYKVPEGEAYAAVEAPKGEFGVYIVSDGTNKPYRCRIRSPGFAHLQAIDAMARGHMLADLPVIIGSLDIVFGEIDR

SEQ ID NO: 18165 - protein, 272 aa, Triticum aestivum
MAAAATAVRFHTAAARRAAPRRPARFAVRADAAQAATALTQDDLKRLAAVRAVEQVQSGMVLGLGTGSTAAFAVAEIGALLANGKLSGIVGVPTSKRTFEQAMSLGIPLSTLDDHPVIDLAIDGADEVDPDLNLVKGRGGALLREKMVEAASGKFVVVVDETKLVTGLGGSGLAMPVEVVQFCWKYNQVSLQGLFNEEGCEAKLRLNEDGKPYVTDNSKYIVDLYFKTPIKDALGAGKEIAALEGVVEHGLFLNMASSVIIAGSDGVSVKTK

SEQ ID NO: 18166 - protein, 207 aa, Triticum aestivum
MDFVLCVCLLQLLFLRSSPVAALQPTPPPARALDAKLQEYAYRALVRPRTGIVYNATVPGNLTGVSVSALRLRSGSLRRKGLSQYFHFGLPTGVIAQPRVERMVLVYHNLGNWSQHYYPPPPGYTYLSPVLGLLAYDAVNLSAVGLPELNIVASGSPILVHFSNVRAAPAGGPAPRCVWFDLDGVPQFRDQEASNVCATYRQGPFLI
